United States Patent 6,783,961 (EXPRESSED SEQUENCE TAGS AND ENCODED HUMAN PROTEINS) - sequence listing, part 4

SEQ ID NO: 22952 - DNA, 358 bp, Homo sapiens
  misc_feature 11: k=g or t
  misc_feature 12: s=g or c
  misc_feature 13: s=g or c
  misc_feature 355: s=g or c
atttccttgcksstcttcccaccgtctaaatcgccatataatctgatggatggggtcctcgcgcggttcagctcctgggcgacagcgtaacccgtcgctcctccctctgcgggagggcgtggacggggcacgggatttggagcgtggaaggaatcgggacctaaaggagtcccaggacaccggaaccaggactccccggcgcacccggagagtttccgagctcctttgaagtatgaatcagaacttctggatgggaatcctggagccaccacttgccctatggtcgcaatgggcaagtcgctcaacctcccagatcctgttttctcatgagtagaacggggattataatacccasccg

SEQ ID NO: 22953 - DNA, 217 bp, Homo sapiens
  misc_feature 10: r=a or g
  misc_feature 11: s=g or c
  misc_feature 12: m=a or c
  misc_feature 41: y=c or t
  misc_feature 45: w=a or t
  misc_feature 79: y=c or t
aagagaaggrsmagcagccccagctatgactgccgcatgtyaatwgctgccgctgggtccctcggctgctgctggagayagagcctgactccgaagttgtgcaactgtggactgggagagacatttgaaccctcttttcttttcgctccccttttgcccccttggggtgtgtgaagcgaggaacgtaaaggaaggcgaacatttggctctctttttc

SEQ ID NO: 22954 - DNA, 152 bp, Homo sapiens
tgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacgc

SEQ ID NO: 22955 - DNA, 277 bp, Homo sapiens
  misc_feature 10: d=a or g or t
  misc_feature 11: k=g or t
  misc_feature 12: k=g or t
  misc_feature 33: y=c or t
attctggacdkkgagccggagcttgcgcatccycccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctcccaccaccaacg

SEQ ID NO: 22956 - DNA, 247 bp, Homo sapiens
  misc_feature 12: k=g or t
  misc_feature 50: k=g or t
  misc_feature 54: s=g or c
  misc_feature 55: y=c or t
atggatggggakgtgaatactaatggagcaggactggccatggattgatkgttsytgattctgggtgaccagtagatacatgaaggttcattgtattattttttctccttttgggtatgtttcatgtcttcaatttagcaattcacttgcatttttattgagatcttgtaaatttatagagaaatgaacttgcttcttttattcattccacattactatatatagtcctcttccttttttttttttt

SEQ ID NO: 22957 - DNA, 227 bp, Homo sapiens
  misc_feature 11: k=g or t
  misc_feature 33: k=g or t
agaggctgagkcgggggaatcacttgaacccakgagttcgagaccagcctgggcaacataacgagacaccgtctacaaattattttaattagctgggagtgatagtgaatgcctgtgagggaggctgaggctggaggatcacttgagcccaggaggtgggccgtgtttgcaccactgcactccagcttggatgacaaggtgagaccgtctctcaaaaaaaaaaaaaa

SEQ ID NO: 22958 - DNA, 64 bp, Homo sapiens
tggaaataccaggaccagtttatgtttgtggttttgggaaaaattatttgtgttgggggccacg

SEQ ID NO: 22959 - DNA, 247 bp, Homo sapiens
  misc_feature 16: r=a or g
  misc_feature 18: h=a or c or t
  misc_feature 60: k=g or t
gctccgcgaggtagarghtgccctgggtgtcgatggcgatgctcgtcgggaagtgcagtkgggcggcagtaccaacgccatcctcatagccgctctcgccgttgcccgcgagggtggtgaccatgccgtccggcgtgatcttgcggacggtgttgccgtcgtattccacgaagtagacggtgccgtccgtgtcgacgacgaggccgtcggaatcgaagatcctggcgttgaggcccttgccgtcccg

SEQ ID NO: 22960 - DNA, 105 bp, Homo sapiens
  misc_feature 20: w=a or t
caataccagtaataatagtwactgacaatacttactatgcaccggccatgctccagcctctgttctaagtgtttgcctcatttatttaaaactcgctaccaccca

SEQ ID NO: 22961 - DNA, 213 bp, Homo sapiens
attgccgcttccctggtgccgggagcagtcgccgctgccgcctccgcccgcggccaggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcc

SEQ ID NO: 22962 - DNA, 315 bp, Homo sapiens
  misc_feature 57: k=g or t
  misc_feature 58: k=g or t
  misc_feature 204: w=a or t
cctagagaaaggtccatttgcacttgagaaaaacgtgtgtactgctgttgtgtctgkkaggtccagctggtatgatgctgttcaagttctgtcttgcgactgatcttctgtctggttgtcctatccgttactgaaagtgggctactgcagtctcctactcttactgtagaactatccatttcttcctttgattctgtcaatgtwtgtttcatatattttgggctctgatgtttggtgcatatatattacatcttggtgaattttcaaactttttaaatttcaacatgaagatgaaattataggatgtctgggatt

SEQ ID NO: 22963 - DNA, 430 bp, Homo sapiens
  misc_feature 8: w=a or t
  misc_feature 9: w=a or t
  misc_feature 10: d=a or g or t
  misc_feature 11: w=a or t
  misc_feature 360: r=a or g
tattgagwwdwaaatccattttgaaatgtataatttttatgagttgattcagttttaagaaaacatgaatgaactagaagatattaaaaacatttgacattggtaagaaatattgatactgatattgatttttatataggtatttatttcagaattgatattttgagaaaaatacatgtgagtcattttttctgtttctcttttctcttaacgattatcactgtaattctgaatctgaaaggtaaaacaattagtcaaaatattattgccatcattctacctgtgttatgaaactacttattcatagttaattctcattaacacttacatttccataaagaaaactcaagtattaataaragagactttactggcttaagagggctgtgaaagatttttgatagtgaatcatgaccctaagggagagatt

SEQ ID NO: 22964 - DNA, 280 bp, Homo sapiens
  misc_feature 248: s=g or c
ctttttgtcttggtcctgcatgatttaggggtagttgatgtgtctgtgtgtctacgtgtgtgcactggtgctttgattttattttgggaagagtaggagagtcaaatgaacaattttctttcaggcacctccgctgagcttttaaaccaagtcattgggacttagcgtctttctacccggcagggaagggaggagttggcaagaatttggctcacccattccccctgcaagcctccagcgtcgcggasactagacatctactatgactgacaccgtgttc

SEQ ID NO: 22965 - DNA, 164 bp, Homo sapiens
atcgaaggatgtcaactggcgagaatgttatgctatgtaaaatgatgaggtacaatataacacattcttataaattaaaatgtaatttttaaatatatgtttcaaaaaactttttaaaacagtcttagaatcaactatcacaataaagattttatactcatact

SEQ ID NO: 22966 - DNA, 125 bp, Homo sapiens
  misc_feature 20: k=g or t
cttcccatcggaggtggttkgtgcagatggaagtttctgtctgctggccctcaagagagtgttttgccagggacacagtctgttcctcctcagaaaacaccccccaaatgctaacaacatccccg

SEQ ID NO: 22967 - DNA, 201 bp, Homo sapiens
  misc_feature 10: b=c or g or t
cattaagatbtctaatctgttttgagtctttacaaaatagccagttataaaatggggcttgatttgtttagactgaaggaagacgttttcccaaaatatactacagaagtgctacaatatttgcgatattaaaatgcctgcagattgaaaatgggggccactcatttcagaactgcaggaatggtgtagttacagatgcga

SEQ ID NO: 22968 - DNA, 246 bp, Homo sapiens
  misc_feature 161: w=a or t
atatgccaaatataagtgggtgagcctcttcaggttatttgtgctcgtgaaatcctttgtttccatgaatcacccagactccaaaggtttaaaatggtatgattgtagtttcccaaagtggtgtattacaggtcatgcttacatatttttgcaggtgaatwttgtggtttttcaaattacccaggaactgtaactatccctctactttttgtgtatgtgtggcagtgtggagataataaaagagtc

SEQ ID NO: 22969 - DNA, 310 bp, Homo sapiens
  misc_feature 11: b=c or g or t
  misc_feature 12: h=a or c or t
tttttttttgbhgacggggtcgcgctcttgtcacccaggctggcttgcagtgtggggatctcagctcactgcaacctccacatcctgggtcaagcaattctccattacaggcgcccactaccacgctcagctaatttttgtattttttagtagagatggggtttcaccatgttgaccagactggacctcaggcgatctgcccacctcggcctcctaaagtgctgggattacaggcgggaggatagcttgagcccaggagttcgagacctgcctgggcaatatagcgagaccccgttctccagaaaaagga

SEQ ID NO: 22970 - DNA, 286 bp, Homo sapiens
tgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatct

SEQ ID NO: 22971 - DNA, 377 bp, Homo sapiens
attttgttaatttagctacatcaagctgaatgctgcagctaaggcgaggcaggatttagctttcgctacgtcttgaggagttataattttttcttctcagctattgctctggtcactggaaggactgagcgcattcaggagcctggaggaactcatcttggacaacaatcagctgggggacgaccttgtgttgccagggttacccagactgcataccttaaccctcaacaagaaccgaatcactgatttggagaacctgctggatcacttggcagaagtgacaccagctctggagtacctcagtctgctgggcaacgtggcctgtcccaacgagctggtcagcttggaaaaggatgaggaagactacaagagataca

SEQ ID NO: 22972 - DNA, 285 bp, Homo sapiens
  misc_feature 142: s=g or c
  misc_feature 143: r=a or g
taaactgaaaaatctatataaagcttattatatagagccaagtgcatacagctccattaatggtagtggcttttattattccaggaaaaggaaactatttgcaaagaatggatatgtaagagtatgccaggctctgaactasragttgttcagtctggcttgtgagtaggttatatatagagagagaatggaagtgatccggagagctaggcagagaccacattatgaataatgaggggtctaccatcaagacttttctcaaagaggtgacagatagggtgccct

SEQ ID NO: 22973 - DNA, 206 bp, Homo sapiens
ttcatctgattgtggggaccaagtccctgagtagagggccaagagctagggacagggggaagagactggcccaggtggtagggaggaaagaactcccagagtttcctttagccaggaaacctgctctactgaccccgtgacttggacagtcagacatcaccctgagagtgacaagtgtaaaatgactcccttcctcccccgtcccc

SEQ ID NO: 22974 - DNA, 129 bp, Homo sapiens
ctgccctcggggatgtcggcgcagtgcaccgcgtgggctcgcgtcccggcggccctttgcctcggcgcgccggcgtacgggaaggtgcggaccttggattgagggccgaggatgcccattgccaagtcc

SEQ ID NO: 22975 - DNA, 134 bp, Homo sapiens
  misc_feature 37: m=a or c
  misc_feature 93: w=a or t
aaacaaaaagaactaaaaaaaaaaccaggtggaattmgttttaacagatggaatttagtatatctaaaatattatgtttttgatgtgaatcawtataaaattatcaataagattcaaaaaaatctttttttttt

SEQ ID NO: 22976 - DNA, 304 bp, Homo sapiens
cggtgagatactacctcatacccattaggatggccactatcaacataaagcgttggtgaggatatggagaaattggaagccttgtgcactattggtgggaatgtaaaatggcatagctgcaatggaaaatagtatggtgattcttcaaaaaattaaaaatagaatatgatcatatgatccagcaattccacttctggactcctgggtagatacctaaaagaattgaaagcagggtcttaagagattcatacacccgtgttcatagcaacattattcacaatagccaagagatggaagcaaccca

SEQ ID NO: 22977 - DNA, 87 bp, Homo sapiens
agtttataaatagtttcagatctttgtggaaatacacagagaaactggcagaaaatgaatccatggagattttgacaagaccctcaa

SEQ ID NO: 22978 - DNA, 367 bp, Homo sapiens
tgcatttcggaagaggacgtcaacgggaaggaattccccctctgggtgcgggctccgagagggggcgacttgcaggaggctccccccgggggcggaggcgaagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgc

SEQ ID NO: 22979 - DNA, 152 bp, Homo sapiens
gtttaaaagatgaaggctgagaaggatttaatatgctcacagtactaagtgtttcactttatgcatttattcccaaagttgggagttttctctcaattttaggtctttattacgtttgtattttatacacagttttataacaagcacaggaa

SEQ ID NO: 22980 - DNA, 236 bp, Homo sapiens
tcatttgattcagagctaaatattcaccataatccaggagggtctccttccccactgcagaggcagaacgtccaagaatggagtaaggttagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatg

SEQ ID NO: 22981 - DNA, 323 bp, Homo sapiens
  misc_feature 6: w=a or t
  misc_feature 12: m=a or c
  misc_feature 13: w=a or t
  misc_feature 14: d=a or g or t
tttgtwttttgmwdtttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaact

SEQ ID NO: 22982 - DNA, 212 bp, Homo sapiens
  misc_feature 65: w=a or t
tgctcttatcattttgaaatgggctcttgattaatagacccatattttttagtggcttctatgtwgtatatttgtctaaaatgaaagctcttttgcgttctaaaactacaatatatgtcatcttattttccctgagtatccaagtatagtgcagattctatgtaaaactactaaatgacactggaatatgtttagtagattagggggaatat

SEQ ID NO: 22983 - DNA, 133 bp, Homo sapiens
  misc_feature 32: s=g or c
aactttttgatgtgggcatttagtgctatgastttctctcttaacagtgccttagcagtgtctcagagattctgaccccctggttgtggaatacgaggcattgctggtacaactacccctatcagccacttac

SEQ ID NO: 22984 - DNA, 277 bp, Homo sapiens
  misc_feature 43: n=a, g, c or t
tattgcttaacagtgctacggatcctctgagcctaagtgagtngtaatctttttgctggtggaaggtcttaccttagtgtttatagctactgatcaggatggttgttgcttgaagtttggggtagctatggtaattactttcttgcctttttctttttttttcataagggcagccccctgaaccagaataggttcaagatagactccctcattctatgacatagaatgagatgtgtcctgattttaaataaaattgaaaaaaaaacaacaacccggt

SEQ ID NO: 22985 - DNA, 226 bp, Homo sapiens
  misc_feature 215: y=c or t
taaaagagaaactcaccataatagtgccgtctaaaaatctttgtaaagttaatttaatgtcctttagaagtgggagtctggtggaactgtgttggatttaagataccttttcactcttccgtatgtcatgagccttgtgcgtcacctcactgtggtgcatgtgcaagggcgtgtgcacgcctgtgctttgccatcccatgttgtaaacagctgtyccaaaggcagc

SEQ ID NO: 22986 - DNA, 183 bp, Homo sapiens
  misc_feature 71: h=a or c or t
aacagctttgttctggtattctggtgtaacagacaacacaccagacatatttaaggtataaaacgtgatthcctttgacaggcatttaccatcaaatcatccccacaatcgaaatcatgcacaatcccccaaggaagtcacccgggcccttccgtgttccctgcactgcccctccgcacccct

SEQ ID NO: 22987 - DNA, 130 bp, Homo sapiens
taagataacaactttgccattatccatcgattcctcttccttaccaacacaatctattacagattgtaatttttaaaaattttataggagtcatttaacatgtactttatacttttctcctcccagctgg

SEQ ID NO: 22988 - DNA, 228 bp, Homo sapiens
gtatcacctaaacaagaacatgaagataggaaacatgacaaagtcactgataaaggaagtgaaagtgggacttcctgtaatgagctctccacttccagttgtgacagccattcagaggcaagcactccccaggacaacccatccagtgcccagcaggcaacagctcaccaacctaacactttaacattggatcgcccctctaaaaaagcacctgtacaatggataccc

SEQ ID NO: 22989 - DNA, 160 bp, Homo sapiens
aggctgcgaaaggggcgtaacgatgagcggttcctgccagaggtctggggaggataaaaagcaggaggaagaggcgacggcggcctgtggacgtcttgcaggggtccccgaagccaagcagggtcccaaggccgattcagactccgacctagagacggca

SEQ ID NO: 22990 - DNA, 167 bp, Homo sapiens
taggctggaaagaccttatctgaaggtcagaaacattgactcagaaaaaaggtatgaagtctttccataaaatcttttcacaatattactcctatttcttttagattttaatgagccattacttatctcttcagaagacttaagtcttcctttatactcagtgaaca

SEQ ID NO: 22991 - DNA, 298 bp, Homo sapiens
cattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggtt

SEQ ID NO: 22992 - DNA, 182 bp, Homo sapiens
agtacactgctgtctctctcattcctcatgcctctcaaatcgtgccatggtcggggccagctccaggcctccctgcttgcagtcccctgtgccaaggcttggggcaggcatcgtaaaaccacttcctcctggctataggcagtggaacagctaaatatcaaggccaagaacttccgggacac

SEQ ID NO: 22993 - DNA, 228 bp, Homo sapiens
tgctctgtcaccttcatagcacttattactatttcattgtgtttcttatgtgtctgcttgttctcagtctctgtccacttgagaacaaaggaaaggaccttgtctctttcatttcagcgccacatcccagcactacaccagtgcctggcacccagtagatattctgaaatgtcagtggatggatgcctatttacatactgtgcttttcttgtccctcagggccagaag

SEQ ID NO: 22994 - DNA, 276 bp, Homo sapiens
  misc_feature 123: k=g or t
atttctgtaggcatgcagtagtgtaattgcttggtcatagggaatgtttaatttcaactttaataatatcaaattgatttccaaaatggttgtatcaatttataatcagtaacttttccagtkactgaaaagtatcagaaagtttttcaacttcccattgatgaaagttcttcctctttcgcatccctgccaacattttgtgtggtcagcattttttatttttgccagtctttttgcatctcattgtggttttaatttacattctctgattacacg

SEQ ID NO: 22995 - DNA, 152 bp, Homo sapiens
  misc_feature 22: k=g or t
  misc_feature 128: w=a or t
accagccaagacaatgacaggkttccccaggggaagagtgggccaaactctggactttcttctctgaatttccatcttctctcagtttttggcctcatgattcttttatttccttgctaggtctcttwttacttttaatatttaccccacct

SEQ ID NO: 22996 - DNA, 345 bp, Homo sapiens
  misc_feature 313: s=g or c
attttttctgattcctgccgaccctcccatcaaacatgtccttctattctttctcatcttaggaaatgaaaatactatttctcactgttgctcacattaaaaatttgaataactttaaactttgttaaaacccagtaaatctgaaatttagcatcctaaatttaccatctagcatcgtctgatatccttgcccagtcatcattgttttttgtttctaatttaactttagcccttgcaatagttctctaattggtcttcctgtttacattattacacattgtattccatcatctgcaaactaaccacagtagtsattttcatgttcaaaacttttattggcttctc

SEQ ID NO: 22997 - DNA, 208 bp, Homo sapiens
cccataaactgtctactctttgtctttaaactaggccatcctgctactctatgaacttattgtctgtaattttggtattattctgaagtgttgccttatttgttaattgattcttggatctcttttatttcatcaagtgaaatataaactgaaggcaggtccagagtctgattcgttttttcactcccttcttctgcacacccaacaa

SEQ ID NO: 22998 - DNA, 198 bp, Homo sapiens
  misc_feature 121: w=a or t
agatattacccacagtgcacagcatgcactcagactatcagcctttggtcagatttacaaagtgctggagatggacccccttccatctagtaagccttttcagaagtattcctggtcagtwactgataaagaaggtgctgggtcttcagctctaaagaggccatttgaagatggattaggggatgataaagacccctg

SEQ ID NO: 22999 - DNA, 211 bp, Homo sapiens
  misc_feature 97: y=c or t
  misc_feature 98: y=c or t
  misc_feature 102: n=a, g, c or t
  misc_feature 111: r=a or g
ctcagcagttccgggtctgggcggtccgcggagtcggcatcccgcagccccggcggcgttagaggaacaggaaccagagccgcgcgagggctctcgyycggngagccagtrccctgaaactctaatctcattgcctggccagaaaaggaagtaatccctagtgtcagcagattcagcggtactggtgtataataggatcaccaatataccg

SEQ ID NO: 23000 - DNA, 279 bp, Homo sapiens
  misc_feature 10: k=g or t
  misc_feature 19: r=a or g
  misc_feature 226: k=g or t
catatttgckgctacagtrgctcaatattttacagggctaacataaagctggctccatttaaaaactggagtacttcctagtgcagccagcctaggcggaaactgtacaccatggtcttccagatgggtgactgatggctttgggtagctgatgcatgctttaatatttgcctatagcccggcagcaaggaagtcggggcggggggacttttttaccctgccagtkatagcattgtgattctttctgggcactggcattttgtgaaactctcaaggacg

SEQ ID NO: 23001 - DNA, 331 bp, Homo sapiens
  misc_feature 272: k=g or t
caaataatgcgagctgaggacagtgatctgcaactcccagcatgtcatgtggtctcttagaaatccatgtgactgtttccaccatcttgggcatttgtggggacccccagactggagggagaaagccctacaaagtggatgggagtgtggggctgaacttttccctacccttaactttgtgtctctgggacctccagggacctggcccctcaccaatgcatatgaagagtatgcttggggaagagcttaggaatggggtgagcatgggagtkctgggtagcagcctttgagcaaatctgcatcttctcttatttctgacctttttccatgt

SEQ ID NO: 23002 - DNA, 126 bp, Homo sapiens
ggggcctctagccggcccgatggagcgcgcgggcgctactagccgcgggggccaagctcctggcttcttactgcggcttcatactgagggccgagccgaggcggcgcgggtgcaggagcaggaccg

SEQ ID NO: 23003 - DNA, 232 bp, Homo sapiens
agaaggatggtgctgtggccgagatctgtagatgcacacggctggtaacagagcaaccgggaccaagggacaacaagagctcaggagaaggggagaaacaggtcgcccagagagtagacaatccagggcttgaggaggctggctgtgcggtttattttttctctccacaaagacacacactgtctaaactgtgtggctggttgttactaagaagctgctgcgagagggaaag

SEQ ID NO: 23004 - DNA, 327 bp, Homo sapiens
catgcaggttccttcccaaagaggcttggactggtatatccaacgagaaacaaataagctaaagaaagtttaaactcaagaagaaagatgttgacagtctatgtaacagctggaaaagtttataggcacccacctttgggacaacccagtgattatgaacatgtgatatctactatttaaaagaaatgttctcaccttgggttgattgtggtataccatgtgttatgaaaattgttgagctgaagctttgaatcgatttagttgagtctgactcacttgctttggttcctgtgtattttactacccctcttgtcagtgaccttcctt

SEQ ID NO: 23005 - DNA, 100 bp, Homo sapiens
ataaccgctgggcagcgggcagcggacagcgggcggcatgaaccgccccactttgccggatacctggagctgcaggaacgacccacacccaggcctcttg

SEQ ID NO: 23006 - DNA, 357 bp, Homo sapiens
  misc_feature 93: r=a or g
gcagttggccccagggctctggtgggtttgacattatttcatggatttgatgtttttgtttttgtttttgttttgatgggggttcagtgcctratggcgaaaccccagaagatgaaaatccaacagaggaaggagcagacaactcttcagcaaagatggaagaggaggaggaggaagaggaagaagaagaagagagcctcccaggatgtactctgtttattaagaatctcaattttgacacaacagaagagaagctgaaggaagtgttttcaaaagtggggacagtgaagagctgctccatctccaagaagaagaacaaagcaggagtgctcctttcctactaagattatgcccaga

SEQ ID NO: 23007 - DNA, 158 bp, Homo sapiens
attctgttattttattcatgtctaagcttccttaattaaaaaatgattatattctccatggagtaaatatttgatcttaaacttagcaggtgcactggcatcagtacttctcaggaagctttccccaaactcaaatctgctgtgaatgacccaacccg

SEQ ID NO: 23008 - DNA, 255 bp, Homo sapiens
  misc_feature 42: w=a or t
  misc_feature 108: w=a or t
  misc_feature 220: n=a, g, c or t
gaaccagtgttgggctaaaggcggactggcagggggcagggwagctcaaagatctggggtgctgccaggaaaaagcaaattctggaagttaatggttttgagtgattwttaaatccttgctggcggagaggcccgcctctccccggtatcagcgcttcctcattctttgaatccgcggctccgcggtcttcggcgtcagaccagccggaggaagcctgtntgcaatttaagcgggctgtgaacgcccagggggaa

SEQ ID NO: 23009 - DNA, 297 bp, Homo sapiens
aataagtaagccagcctaacaggcaacacaaaggtgtaagcaaatgcattgccctgtggtaataatatcagtgaaagcatgtgtggggtacagaggtagcaaagaatgcaagagattttaatgctgtccagttgagggcaagaaaacctctctggaaaaggtgacaattaggttttaaggataaatagtagttttcctatttaggggagccactccaggtagagaaaacctggagtagttttccatgcctgaaagagcctggtgtgttaagacagtttcgaacagtactgccagatg

SEQ ID NO: 23010 - DNA, 96 bp, Homo sapiens
  misc_feature 31: s=g or c
atttttgccggggtttgaatgtgaggcggasggcggcaggagcgggtagtgccagctacggtccgcggctggcactaccctctctaatggcccttg

SEQ ID NO: 23011 - DNA, 103 bp, Homo sapiens
  misc_feature 10: k=g or t
ttctgactgkggatgaaatggtatctcattgtggttttgatttgcatttctctaatgattagtgacgttgagctttgtttatatatgtttgttggctgctctg

SEQ ID NO: 23012 - DNA, 401 bp, Homo sapiens
  misc_feature 22: k=g or t
  misc_feature 89: w=a or t
  misc_feature 168: m=a or c
  misc_feature 235: k=g or t
agccagctagctttttggagtkttaaaaagactttcagaagtcttatttctcccccattgaaaggagggaaaagggtttttatacagtwacttctcttgagagaaatgtggaaacagtgggaccagtgaagttccttccgataatgaaagagcgatatctgtgtctgmcaggaggcttgagatgatttttatggacacaccaagaaataactgcattcagaaacaggtctctgtkctaggatgtcccgacccagtggtgcatgagatcgcctatcagtacggaaaaaatgtaggaatagcttttcagctaatagatgatgtattggacttcacctcgtgttctgaccagatgggcaaccaacatcagctgatctgaagctcgggttagccactggtcctgt

SEQ ID NO: 23013 - DNA, 149 bp, Homo sapiens
cctaatgtttctgatttcttactcttgttgctgatatacagaagcagctacaagagctgaaagatgactgtgcacttaatgtctttagttgaaagaattatttagctaaagaaacacagtcattagctatggaatttgagagcctctag

SEQ ID NO: 23014 - DNA, 253 bp, Homo sapiens
  misc_feature 215: r=a or g
aaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgrgatctattgggagaaattatatatgtatatatatttat

SEQ ID NO: 23015 - DNA, 93 bp, Homo sapiens
gggggagctgcggttccgagaagcggcagacggcagccagaaggcttgggctgttgagtaagcagccccctctcagtcccggccctccccgga

SEQ ID NO: 23016 - DNA, 240 bp, Homo sapiens
aaatcagtttttagttaacttttaaggctattcaccatgatttaaagtgattccttgattcctctgttacattaagtgtgattgaaactgtacctttattttctcatgccttgataagcagtgtagtcaaatcataacatattatgactgcaatcaagtgattatagcacgtgattatactttttgtctctgtggcgtgaggagtggaaaggtgtctttttttgcaccacttggcacgtt

SEQ ID NO: 23017 - DNA, 147 bp, Homo sapiens
  misc_feature 126: k=g or t
acaagatccatccatacaagtagtgaactctccatttcaggagcaatggactaatgaatcaggaatcgctccacttggcacccacgacggtggaataattcatcacagccaactacagagactatkacatcaggaataaagaaaagc

SEQ ID NO: 23018 - DNA, 214 bp, Homo sapiens
tgaagaacccacattttccaatttcaaaacttcaaagctacagtaatcaagatagtgtagtataaggagagacatataaattaatggaatagaactgagagtataaaataaacgcttttacttatagtcaattaatttttggcaagtgtgccaagacaattcagtggagaaagaatagtttttcaacaaatgcttctgagacaaccggacctag

SEQ ID NO: 23019 - DNA, 176 bp, Homo sapiens
ttaatcttaaagaatgatctggtgaggtgggtcgtattattatcccgattttgcagaggaggaaaccaaagaaggacttggcccaaagacccttgctaacaggtgttgggacattatccaaacgcatgcttctgactttgtcaatctcttaatttcttatttgccacgcggacttg

SEQ ID NO: 23020 - DNA, 144 bp, Homo sapiens
  misc_feature 19: b=c or g or t
tctcatggttcttcatcabccttttatcaggcttcagtcaccatctattcatccacccacctataccaaacacccaccatctcccgccattcatccatccactcaaccaccctcttacaaccatccctccatccacccaccacg

SEQ ID NO: 23021 - DNA, 130 bp, Homo sapiens
catgagcaattccttcagctccagcaggctactgacaatttgcttttaacccaaatccagctctaccctccctaaagcatgcacctagggccccagtcagaaaaacaaaacaaaaactaaaccagacatg

SEQ ID NO: 23022 - DNA, 218 bp, Homo sapiens
atcagtgagcgcccggagccgtggccgctgggggctgcggcggcgctgagccagcggggccgagacagagttttgctatgttgctcaggctggtcttgatctcctggcctcaagcaatccacctgccttggcctcccaaagtgctgagattacagatgtgagccaccacacccagtccaagtgtttctatttagttgataatggacagacccacgaga

SEQ ID NO: 23023 - DNA, 220 bp, Homo sapiens
  misc_feature 18: n=a, g, c or t
  misc_feature 19: m=a or c
aggctccccctgcaaggnmcagatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccacgc

SEQ ID NO: 23024 - DNA, 196 bp, Homo sapiens
  misc_feature 26: r=a or g
  misc_feature 122: b=c or g or t
catttatttaactgagggcatgagtraagtataataggttattccactattctataaggacagctgcttctgggttgttgggtatcacatgataagaccagtgattctcgtctgctataacbcattatttaacttggggtccttggttagaagcaatgttgtccaagaaactacaatcatttataagacctaccga

SEQ ID NO: 23025 - DNA, 306 bp, Homo sapiens
ctggataacatctgcacatgttataaattaacaagttttcctatttttatccctatattagccacttttgttggtttcttatgtatccctttagggttattctatgcactgataaacatacatgagcaaatagaattatattttgcacattattctgaacatggttttataattaaacttataccatatgaactttcacatatttatctgccttaccattcttaaatgctaagtattttattgtacatatttataagttaaagatatagatttaagagccttctgctggtacacattagggcccgc

SEQ ID NO: 23026 - DNA, 129 bp, Homo sapiens
aaaaaatagtggttgaatggtgtttaatttgtacagtttgtgtcaaagtagaatgggcagatattttggtggataggcttttgtcttagttataaaaattaggacatttggtatgataaaggcagaggg

SEQ ID NO: 23027 - DNA, 133 bp, Homo sapiens
aaaagtatatcaatggcaagcattgtagagtgtttttattaatgtctattctgatatctgccttttaattgaaatgtctttcatttgcatttaatataaataataattataatgtttcatttaagtccaccaa

SEQ ID NO: 23028 - DNA, 369 bp, Homo sapiens
  misc_feature 22: s=g or c
  misc_feature 25: w=a or t
  misc_feature 97: s=g or c
  misc_feature 222: s=g or c
  misc_feature 297: s=g or c
  misc_feature 301: m=a or c
  misc_feature 341: w=a or t
agagctgcagctccggcgccastgwagcttctccgaggactcagacctctccagcgacgatgtccttgagaagtcctcacagaagtcccggcgagascaagaacctacacggaggaggaactgaatgccaagctgacccggcgtgtgcaaaaggcagctcggagacaggccaagcaggaggagcttaagcggctgcatcgagcccagatcatccagcggcastgcagcaggtggaggagaggcagcggcggctggaggaaaggggcgtggctgtggagaaggcgctccggggcgaasagtmggatcacagcaaatctaacagcttcgccccggagcgcctwctcctcatcggccagcccctcctccagc

SEQ ID NO: 23029 - DNA, 95 bp, Homo sapiens
  misc_feature 12: m=a or c
  misc_feature 13: m=a or c
  misc_feature 14: m=a or c
  misc_feature 15: m=a or c
cctttctcgttmmmmggccatcttagcggctgctgttggttgggggccgtcccgctcctaaggcaggaagatggtggccgcaaagaagacgataa

SEQ ID NO: 23030 - DNA, 159 bp, Homo sapiens
tcctccttttctaagttgttatttgttttcctgaaagaataatggaagcagctgtagaaatgtggaggcatttgaagctgaccttctgaacaccaaaaaaactccactgtaaaggctatgttgattgggtttgtcagaataaattgagcactggcattt

SEQ ID NO: 23031 - DNA, 251 bp, Homo sapiens
atgttgaccagggtgatcttgaactcctggcctcaagtgatccacctgcctcagccttccagggtgctgggattacgggtgtgagctgccgtgcctgacctaaggaaaatattctttaaaaattcagacatcaggctgggcgcagtggctcacgcctgaatcccggcactttgggaggctgagacaggtggatcgtggatcacgaggtcaggggttcaagaccagcctggccaagatgctgaaacccccaa

SEQ ID NO: 23032 - DNA, 225 bp, Homo sapiens
taaagtgatcattatgtagtttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcac

SEQ ID NO: 23033 - DNA, 222 bp, Homo sapiens
  misc_feature 20: s=g or c
  misc_feature 101: w=a or t
cttttcctttctcatggtgscctccatggaagtcacagtcaacactgaataaatgactagaatgacacgtgtgcgtgcgcacgcgtgtgcgtgtgtgtgtwcatctgtctgcatgtggatcaatttcttttagaaaataatttattgtatgatttattttggagttatattctgattacagtgctccctctcccaaatagcattgattttttcccccctcta

SEQ ID NO: 23034 - DNA, 121 bp, Homo sapiens
tggatggaagacagtgagcgctactctcgtagatccagaagaaacacatcggcttctgatgaagacgagcgcatgtcagtgggtagtcgtggaagcctgaggccctcggagtacagccggc

SEQ ID NO: 23035 - DNA, 366 bp, Homo sapiens
tttagtgatttaacaatctcttgagggctgcacctttaaattcccagattgtcaatagacatgtacagtatatgggataaggtggacacaagtgcacatataaataaaatcttcttaagacttttaactattcatttacagtaggagagtatgtagaaatcatcatccacaagtcataattaggttgtgtgcctactgtagttttttccatttctgtattatataaacatttgcatattaaaatttgatttttcccagagacaagtattatatactgtatctatatttaaatcaaactgtggtaatatatttctcagaaaataatgttggggactatagcctgaacatgtggacttgaagcgacct

SEQ ID NO: 23036 - DNA, 291 bp, Homo sapiens
ctccaatcagatcacatctattcccaatgaaatttttaaggacctccatcaactgagagttctcaacctgtccaaaaatggcattgagtttatcgatgagcatgccttcaaaggagtagctgaaaccttgcagactctggacttgtccgacaatcggattcaaagtgtgcacaaaaatgccttcaataacctgaaggccagggccagaattgccaacaacccctggcactgcgactgtactctacagcaagttctgaggagcatggcgtccaatcatgagacagcccacat

SEQ ID NO: 23037 - DNA, 104 bp, Homo sapiens
ctgatttaactgggcagtcatgcttcccagtctcaaaatgaaagaggcatatacatatttaaacaagtttttgtgtgcaaaatggcatagatgtaagggagaaa

SEQ ID NO: 23038 - DNA, 434 bp, Homo sapiens
  misc_feature 38: w=a or t
  misc_feature 88: s=g or c
  misc_feature 89: r=a or g
  misc_feature 307: y=c or t
  misc_feature 311: k=g or t
  misc_feature 351: m=a or c
  misc_feature 383: k=g or t
caatgatgctgaactcaacttctttcagaggatttgtwtcaacactccattagctcctcaagctctggaggatgtcaagaatgtagtsrgaaaacatataagtgatggtgtggctgacagtgggttgaccctgaaagttttctctttttacacacactttttatccagagagggagacacgaaactacttggactgtgcttcgacgatttggttatgatgatgacctggatttgacacctgaatatttgttccccctgctgaaaatacctcctgattgcactactgaattaaatcatcatgcatatytatktctccaaagcacctttgacaagcatgatttggatagagamtgtgctttgtcacctgatgagcttaaagattkatttaaagttttcccttacataccttgggggccagatgtgaataacacagt

SEQ ID NO: 23039 - DNA, 276 bp, Homo sapiens
ttgatgtatggagggaatcaggtgatgagaccactgatgtgcaggccctgactttgctggaagagggattaacccatagcccttccaatgctcagttcaaattgctgcttgttcgaatctactgtatgctgggtgcatttgaaccagtggtggatctttactccagcctcgatgctaagcatatccagcatgataccattggttatcttttgacccgatatgctgaatctctaggtcagtatgctgctgcgtcccaatcctgtaacttcgcactca

SEQ ID NO: 23040 - DNA, 165 bp, Homo sapiens
  misc_feature 40: y=c or t
tatacaccatggaatactatgcagccataaaaaatgagtycatgtcctttgcagggacatggatgaagctggaaaccaccattctcagcaaactatcacaaggacagaaaaccaaacactgcatgttctcactcataggtgggagttgaacaataagaacacatg

SEQ ID NO: 23041 - DNA, 255 bp, Homo sapiens
  misc_feature 189: n=a, g, c or t
ctcaaactcctgacctcaagtgatctgcccatctgggcttcccaaagtgctgggattacaggtgtgagtcgtcgtgcccagccatttttacttcatttaaatgtccgctttttgtagtcaagtcccagaataaaatgctatttttaggaatatgtttaactgaaaaactgcatttaagtgttggcagtnaagcaaactaactttgcatgataaagcccctatcaagtatctcatacttaagcaaatacccccaaa

SEQ ID NO: 23042 - DNA, 87 bp, Homo sapiens
ttcaagaactatactatacttgttattaaattctagtctcattagttgtttctaagcttatttctgcaatttcagcaaaccctgcat

SEQ ID NO: 23043 - DNA, 106 bp, Homo sapiens
agtaaactggcaagatgtatatgataaaaagcttgtacctccttttaaacctcaagtaacatctgagacagatactagatattttgatgaagaatttacagctcgc

SEQ ID NO: 23044 - DNA, 93 bp, Homo sapiens
  misc_feature 50: r=a or g
  misc_feature 62: r=a or g
aggccaaccctgaccttcctggaagttgtttccttaacttgaatgttgarcttcctctaaarctttctcgtgtatgtcttctccatgccacta

SEQ ID NO: 23045 - DNA, 165 bp, Homo sapiens
  misc_feature 40: h=a or c or t
tatacaccatggaatactatgcagccataaaaaatgagthcatgtcctttgcagggacatggatgaagctggaaaccaccattctcagcaaactatcacaaggacagaaaaccaaacactgcatgttctcactcataggtgggagttgaacaataagaacacatg

SEQ ID NO: 23046 - DNA, 398 bp, Homo sapiens
  misc_feature 364: s=g or c
  misc_feature 383: w=a or t
acattgcagagcttgtgaggtggatgcctccagagccaaactttgcaaaataccaagcaagtgaatgaagccctggctatggtcttgggaaggacaaagttcattgctggaagaaagtgaaaattttacctctactgaagacgctgcataaatatggaaagctttccccgaaagtaattgaaccatggggtcgaagttagaagggtccttaaaaatccacttgacccttctaaattgttggctagtttatttttgaacatttctagtaatggaagttgattctgccctatggccggccaacctcactttgcactgttctaaccattacaatgttcatccatagagtagatcaaatttgtgtctsacaatcatctattttttcwaagcataaacatact

SEQ ID NO: 23047 - DNA, 179 bp, Homo sapiens
ctttccctgttagacatgtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggggcga

SEQ ID NO: 23048 - DNA, 234 bp, Homo sapiens
  misc_feature 59: k=g or t
  misc_feature 60: y=c or t
  misc_feature 71: k=g or t
aggctcagctccgcgctgcgagcgctacgggcgcaggggcggggagccggcccggagckyagtttccagtkgggccggggtttcacccgggccctctctgtttgaaccgaacccgacaaatgggcgcatgacgatggagagcagggaaatggactgctatctccgtcgcctcaaacaggagctgatgtccatgaaggaggtgggtgatggcttacaggatcagatgaactgcat

SEQ ID NO: 23049 - DNA, 96 bp, Homo sapiens
  misc_feature 40: n=a, g, c or t
tatacaccatggaatactatgcagccataaaaaatgagtncatgtcctttgcagggacatggatgaagctggaaaccaccattctcagcaaactat

SEQ ID NO: 23050 - DNA, 165 bp, Homo sapiens
tatacaccatggaatactatgcagccataaaaaatgagttcatgtcctttgcagggacatggatgaagctggaaaccaccattctcagcaaactatcacaaggacagaaaaccaaacactgcatgttctcactcataggtgggagttgaacaataagaacacatg

SEQ ID NO: 23051 - DNA, 416 bp, Homo sapiens
  misc_feature 19: m=a or c
  misc_feature 20: k=g or t
  misc_feature 372: w=a or t
  misc_feature 391: w=a or t
attttttactcatttaggmkaacattcaactgccttaagaatgtatacattttaataatatgtcttaattgcatttaggtttgtctttaccataatatagagtgtattcaatttttttccaggcagtatttactaagtggaaattttctacttatcacaatttttggacacattaaaagctattattctggaagcaatgagaattttatgagattgttttttataattgtcttgtgattgttttcatattaggttactccaccaactgtagattaagtagtttaaacacttcagtacttaccagtctttatgggaaaaatctgcattggactaaatgacagattttagttctagcatttggttgatgcagtwtcttggagtaaacattgcwtcttgggaaaatgtaatgtcataaa

SEQ ID NO: 23052 - DNA, 388 bp, Homo sapiens
  misc_feature 337: y=c or t
gccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtatyccagtatcatgtacgcactaaaaaaaatgtgtgcttgctgctgctgtgagt

SEQ ID NO: 23053 - DNA, 212 bp, Homo sapiens
taaacaattaggaaaatttattctgtcacataacaagcagtgttaagttaggatggctcagaaatgactaattcaatatctgaacaacaggtcaaagatccaggtgtctcttctctgtccactctgctacagtatgtgtctgttctaccctgggctgactcccctcgtgattgcacaacgattgccctttttctaaacttcacatccaaacc

SEQ ID NO: 23054 - DNA, 350 bp, Homo sapiens
  misc_feature 24: r=a or g
  misc_feature 90: h=a or c or t
  misc_feature 91: d=a or g or t
  misc_feature 92: d=a or g or t
  misc_feature 93: r=a or g
  misc_feature 120: k=g or t
  misc_feature 132: d=a or g or t
  misc_feature 291: r=a or g
ctgcttggtatgttaaggtgagaratggggagtggtttgagtagagaattaaagttgctgtgtgtgctctttggaccactcccaagagghddrtacactgccatttggatggggtgagtktgtgcctgagtdcctgtcctttctgcctgtgactagagataggcatgatgtaaaaacaccaggatctgctgcttagcaaccagtaaaataccgtatatctggataggcagtaacacagtacttcattcatttctctttcagtgtgatgaagagaaaaggcttttttgcttragaaacagaaaagccccccttctctagaaaagccatatgtgatcattatggaaaataca

SEQ ID NO: 23055 - DNA, 406 bp, Homo sapiens
  misc_feature 20: r=a or g
  misc_feature 81: v=a or c or g
  misc_feature 85: y=c or t
  misc_feature 109: d=a or g or t
  misc_feature 391: s=g or c
aaatcattaaccaaacacaraagaaggtactgaggagcaaaacactttatgtagaaactaaacagcatgatgacgtaagtvagtyctttggtgtataggtttttctgtdtttcttttttggggtttgtctgagacggagtcttgctctgtcactcaggctggagtgcagtgtttcattctcggctcactgcagcctttgcctcccgggttcaggtgatactcagcctcctgagtggctgggattgcaggcgcccaccaccacagccaggtaattttttgtatttttagtagagacggggtttcactacattggccaggctactctcgagctcctggcctcaagtggcccacctgcctcggcctcccaaagtgccaggcacaggcatgagcsactgcacccggcagt

SEQ ID NO: 23056 - DNA, 280 bp, Homo sapiens
  misc_feature 250: y=c or t
cagggttagtaaataagcttagtggagttcatgaacccactggaattccatgtatatttttgcatatctgttttatggaggtggtccttcatacggccaatcaattcattgattctgagtgatttgattatgatttgcttgcctaaaagaataatgtttagatgattttgagcatctaagaaaacctgatagttataattttgaactggtttgccttaaagttcttgaatataatttaggaaggtatgtyaagacacacatatgtgtgggtgtgtacaag

SEQ ID NO: 23057 - DNA, 186 bp, Homo sapiens
  misc_feature 43: n=a, g, c or t
  misc_feature 44: y=c or t
  misc_feature 132: n=a, g, c or t
taccagttaggtagagtaggtcgggatgggcaagcccagaganycaaggactctgccttttatgcacatgcacccctcgcccccatcacccaccatgcacacacacagacatacacatatgtgcccagagtngattagagtctactggctttctgccacctaaaggaaatattatagaccgccaga

SEQ ID NO: 23058 - DNA, 278 bp, Homo sapiens
  misc_feature 175: n=a, g, c or t
tctttctcccagtaagctctctgatgggagtctatgatctagatcttgttttattttttcttaagaaatcattaaagcgcagaagctattcctacaaggatctgtaatcctaacgtgtagaaccagtaaagcaccacagagctggatagtgggataaacatgctgcatgtggctncctgggcacgtgcactagctgcttttgccactggttcagggaacaggagctaaatttggtctgtattattgtgttttaagctgaaaactgattcttggctggc

SEQ ID NO: 23059 - DNA, 336 bp, Homo sapiens
  misc_feature 4: k=g or t
  misc_feature 23: y=c or t
  misc_feature 24: k=g or t
  misc_feature 27: k=g or t
  misc_feature 35: w=a or t
  misc_feature 44: w=a or t
  misc_feature 93: n=a, g, c or t
  misc_feature 258: k=g or t
  misc_feature 283: k=g or t
  misc_feature 309: s=g or c
  misc_feature 310: y=c or t
  misc_feature 332: k=g or t
tttktttattgtgtctatttgaykctkctctcttwatcttcttwgttagtctggctagcagtctatttttttaatcttttcaaaaaaccagcncctggatacattttttttgaaccgtttttcccgtctctatctccttcagttctgccctgatcttagttatttcttgtcttctgctagcttttgaatttgtttgcccttgcttctctaggtctttttattgtgacgttagggtgttgattttagatcttttctgtkttctcctgtgggcatttagttgtakaaatttccctctaaacactgctttasytgtatcccagagattctggtakgtac

SEQ ID NO: 23060 - DNA, 407 bp, Homo sapiens
  misc_feature 194: r=a or g
  misc_feature 195: r=a or g
  misc_feature 321: w=a or t
  misc_feature 325: w=a or t
tttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaarraattaaatttagaataagaatgatttctttaatttgtcctttttttctttggtctaaaacattattaaatttttgtaaatattttgatttaatgtgtcttagatcctcattattttaatacaggawaagwaaagatttagtaatttcttaccatgctaatatgtaaagttcatgccatccaggcatttaagagcgatcctcatcccttcagc

SEQ ID NO: 23061 - DNA, 367 bp, Homo sapiens
actagtgtaaccctttaattttacaaatcaagaaactgaggtctgggaggtgaagggaggatgtttggactggagtgtagtactgcagtgatttatcgtggggctcttttcatgcagcaaaggtactcagattttctaacaaaaacagttatcagtggatgaaagatctgtatttttgccttgcattctgatgtagtttattaaagttatgaaaaattaaagttttgtcaatacatagtttgttaatcttaattatacctataataaggaagaaggcaaaattttcatagaaatgaggctcatggtatgtttcttaccatagtaagatttcttagacattttgaatgatttttttttccttcccatc

SEQ ID NO: 23062 - DNA, 181 bp, Homo sapiens
  misc_feature 130: r=a or g
  misc_feature 131: k=g or t
agagattatttttcatgtctccccgttccaactccctccataaagctcccctttataaaagaagaagagaaactgtttgaacttgctgtttccagcaatgcatttctcttcatgagggagctttaacgarkcgaatgcctccctctgtccaccctcctccattcctcaatttttttttttt

SEQ ID NO: 23063 - DNA, 383 bp, Homo sapiens
catttaaagtaattatataaacttgatgtaacctcatgttcacataatctagttcacatttgtgtttctgaaaatgatagtcagacttaaaataggacaaataagtttgttgaatgactatatgacccaagtttaggaacaggctttatttggaatatgtggaggtaacttggctttcccataaagaacgtcacggtaattgcatagtttgaggcctgaacttaatgtcagcacaggtatacctgatttttatacaagttctagcaaaattaactgggcatttgtaataatatctatcacagtgtttagcagtattgctatttaatctttcttcccctttttagggacagtctccctcaattcgccaacttatcatgcatgca

SEQ ID NO: 23064 - DNA, 118 bp, Homo sapiens
  misc_feature 20: r=a or g
  misc_feature 92: r=a or g
  misc_feature 93: r=a or g
  misc_feature 94: r=a or g
  misc_feature 115: b=c or g or t
  misc_feature 116: n=a, g, c or t
  misc_feature 117: s=g or c
taggcattcagaatttcaaraaactgtaaaagtgatataactcaattgtttatttttctgattatttgggacattatacatatagattatcrrrgacaaagatttgaaccaaggbnst

SEQ ID NO: 23065 - DNA, 264 bp, Homo sapiens
ttttacattcttattttattaaaagagaaaggaaatagacatttactgagggccgattgtgtgtcagatgctgcgctgtgactctttgtgggattgaaagacacaaggcaagcagtggttcgattcccattgtacctggcaggaaatgaggctctgagaggttcagtcacttacctgagttcactcagctcattaaaggagagctagggttccaacgctggttgatctgactctgaaatgcacgcttttccctatgcaccggcg

SEQ ID NO: 23066 - DNA, 219 bp, Homo sapiens
  misc_feature 12: b=c or g or t
  misc_feature 165: b=c or g or t
ccttccaaggcbtcctttctcccaccctgctccacttttctcagcctcctgaatgaggatggaggcttaatagacatgagaggattttgttttcagttcaatgacatagagttaagtgagctgtcagggaagacgagaggcatagctgctgtgagctcctgagabcctgaaaatgctggtttgcttcacaggtgccatctagaacttaacaggcactaa

SEQ ID NO: 23067 - DNA, 128 bp, Homo sapiens
aaagttttgcctagaatgtcattgtttgggttggattgcccaaaggacgcaaacgtgaaagacagtctcctctattgagacagcacatctgctttcttcatcaagaatccaagttggaggggccaaac

SEQ ID NO: 23068 - DNA, 394 bp, Homo sapiens
  misc_feature 172: n=a, g, c or t
  misc_feature 272: k=g or t
  misc_feature 326: s=g or c
  misc_feature 340: k=g or t
actgtccagtagaaatcagtgatgtagcaatgttgcagtaaatagaaatgattatatatttcaatagcttagcaagaagacatttataatatttttttctttcatctgattaagttttgctgtctattttcttccagagagatgtggataatttgccctgcctccaacatcnctttctcagctttaacaatatatctagttttgacagtgtttcctgccttgctgactcttcttccctctcggacatcacctttgatggcaatcccatagckcaagagtcatggtacaaacacactgtccttcagaatatgatgcagctgcgccastagatatgaagagktcacggaagaagaaaggggtatggcatctgttttagccaaaaaagaggaagaga

SEQ ID NO: 23069 - DNA, 144 bp, Homo sapiens
  misc_feature 68: n=a, g, c or t
tcatctattcaaagccttaagtatcttctgccctggcatcttaacccctctacctgcaggccagtccnccctaggagcattggaagcatgctcactgtggcctcctgcatgtctgtgtctgcacagcatctcagacctccaacg

SEQ ID NO: 23070 - DNA, 109 bp, Homo sapiens
  misc_feature 43: k=g or t
  misc_feature 44: k=g or t
  misc_feature 45: s=g or c
  misc_feature 96: n=a, g, c or t
attgtgctgtgcggtgaggtttgcgcaaacccagtcgatttckkscttggctggttctcctttaatgaagttgactttggctctcatatcattggncttgggacgaaaa

SEQ ID NO: 23071 - DNA, 281 bp, Homo sapiens
  misc_feature 201: n=a, g, c or t
  misc_feature 278: s=g or c
  misc_feature 279: n=a, g, c or t
  misc_feature 280: n=a, g, c or t
tacttcacgatggaagtgatgttttaagtgtaatttcatcaaggagaagtttttccagaaagtcttttgacttcagtaagaagcttatttactctggtaaatagtttctagtaagatgagaaagacttgattttttaaaaaacaattaaaactttacattgtttaatctaatgttgtgatttcgaaagtactacctttgcncttatagttacgcatgtgtatttatatgtattttcttggttcattcaaacgccaataaaatactttactatccaggsnnc

SEQ ID NO: 23072 - DNA, 219 bp, Homo sapiens
  misc_feature 8: n=a, g, c or t
  misc_feature 9: n=a, g, c or t
  misc_feature 10: d=a or g or t
agagtgcnndgacatggagggcagcacgagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcaag

SEQ ID NO: 23073 - DNA, 354 bp, Homo sapiens
  misc_feature 12: y=c or t
  misc_feature 93: w=a or t
  misc_feature 251: n=a, g, c or t
  misc_feature 252: n=a, g, c or t
  misc_feature 354: m=a or c
aaatgaatgatyttcattgttattagactattaaaataaaataacatgtaaagttctacaggtaaacaaacaagagcagtcctatccctagcwcctctccaacaaaaagaatgaatttctacccatttagcaatttcttatggtgattatttttgtatttccaagtaatatgctttaatatcctactttatgaaatttagagactattgactttttgggatggtatataaggactttgcttctttataacnnccttcttctctgcactacccccaatatacttacactataattttcagtgaaatctatattgttttcattgttcccatgtaaatattattcactaccagagcm

SEQ ID NO: 23074 - DNA, 266 bp, Homo sapiens
  misc_feature 11: y=c or t
  misc_feature 261: s=g or c
cctttgatttyatttaactattcctcaattacccaatcttcaaacatataaaatgcttagaaatatgtctttagattcaaagtgaattttaaaactcagtaaaaatgaatatcttctttgtttacatacttaaagtatagcaaagaaatttttattcaagctggagtgcagtggcacgatctcagctcactgcaatctccgtcctcccaaggttcaagcgatctgcccatttcagccccctgaatagctggaactacagasacgat

SEQ ID NO: 23075 - DNA, 72 bp, Homo sapiens
agtgggctgagatcacgccattgcactccagcctgggcgacagagtgagactctgtctcaaaaaaaaaaaaa

SEQ ID NO: 23076 - DNA, 98 bp, Homo sapiens
tggtttcagtctgttcttggtgtggtcctcatacacagagctccctgtctagtttcttttctttttcttttttctttttctcgtcacacaggtaaccg

SEQ ID NO: 23077 - DNA, 398 bp, Homo sapiens
  misc_feature 144: n=a, g, c or t
  misc_feature 145: m=a or c
tgatgctaatattcggagtgatgttgatgtctcatcacgaatgccattccctagagcaagcttgggcaaatgactgcctgtgagctaaattctttcaaccttttatttttgtaaataaagttttattggaacccagccataccnmattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaggggcactttatctatagatatcattttttttgacttttattttaaattca

SEQ ID NO: 23078 - DNA, 113 bp, Homo sapiens
cattttagaaatattaaaatgtaaaaagtaaagtgtttcttaacattcaggaaatacagcataattgggttgaggcaggaaaatggaaagagatgggcaaattgagacacaaa

SEQ ID NO: 23079 - DNA, 220 bp, Homo sapiens
  misc_feature 24: n=a, g, c or t
  misc_feature 49: s=g or c
  misc_feature 99: d=a or g or t
tctcctgcctcagcttcccgagtngctgggattacaggcatccatcacsatgcccagctggtttttgtattttcagtagagacggggtttcaccatgtdggccgggctgctcttgagctcctgaccttaagtgatctgcctgccttggcctcccaaagtgctgggctttacaggtgtgaaccaccgtgcctggcccagttatagatttaaaacatgcaag

SEQ ID NO: 23080 - DNA, 220 bp, Homo sapiens
  misc_feature 2: b=c or g or t
cbagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaat

SEQ ID NO: 23081 - DNA, 75 bp, Homo sapiens
gggacttttgggggggcctcttcgtggcggccattttagcttctctgaggtgtgttcaccggatcagagatagca

SEQ ID NO: 23082 - DNA, 229 bp, Homo sapiens
  misc_feature 10: y=c or t
  misc_feature 11: n=a, g, c or t
  misc_feature 65: s=g or c
  misc_feature 86: h=a or c or t
  misc_feature 93: h=a or c or t
  misc_feature 100: b=c or g or t
  misc_feature 135: y=c or t
tagcgcaggyncaggcggtgcagcttgggcggcccagcggatcgtgccgcggcggccgagcgcastacaggagggtgtccagaaghcacaaghcatggcbgtggggaacatcaacgagctgcccgagaacatccygctggagctgttcacgcacgtgcccgcccgccagctgctgctgaactgccgcctggtctgcagcctctggcgggacctcatcgacctcgtgagc

SEQ ID NO: 23083 - DNA, 153 bp, Homo sapiens
cttgaactctggcactgtacagtgaatgtgtctagttgtgttagtttgcattaagcatgtataacattcaagtatgtcatccaaataagaggcatatacattgaattgtttttaatcctctgacaagttgactcttcgacccccaccccacct

SEQ ID NO: 23084 - DNA, 371 bp, Homo sapiens
  misc_feature 42: r=a or g
  misc_feature 44: s=g or c
  misc_feature 45: s=g or c
  misc_feature 360: k=g or t
  misc_feature 369: y=c or t
  misc_feature 371: r=a or g
ctccctagaagcggcaactgagaaggcacagcaccgggaccrcsscatccctgagtggagagctcccctcgctccccaaaggctgcaaagaaggcgcgccccagagacaggatctccctatgttgcccaagctggtctcaaactcctggactcaagcaagcctcctacctcggcctcctgaagtgttgggattacaggcatgagccacggtgcacagcaagagctttaaccttaatgaccattcattctctaccccacattacctacaactgatacagcatgcgaagagggtctttgcttacccttcgccttccaccatgattgtaagtttcctgaggcctccaagccatgattcctgtkaagcctgcygr

SEQ ID NO: 23085 - DNA, 195 bp, Homo sapiens
  misc_feature 133: s=g or c
  misc_feature 134: r=a or g
cttttgaggaccaaatctgtacccccgatttggtggtattcctggcttgtgctaatcagagactcaaagaaagattactgaagcgtgcagaacagcagggccgaccagacgacaatgtaaaagctacccaaasragactaatgaacttcaagcagaatgctgctccattggttaaatacttccaggaaaagaggc

SEQ ID NO: 23086 - DNA, 204 bp, Homo sapiens
  misc_feature 56: n=a, g, c or t
  misc_feature 204: s=g or c
ggtaggttgtgtttccaggaatttaatttgtccgttttgtctaggttatccaactnggtggcatacagttgttcatagtagtgttttataatcctttttgtttctgtaaaatgggtcataatgtcctcgcatttgagtcttctctttttcttcacctagctaaaagtttgtcaattttgttgatatttctgaggaaccagcgts

SEQ ID NO: 23087 - DNA, 184 bp, Homo sapiens
ctcccatatataatatggctaaaatttgagtgctggttatatctcatttacaagtgaaatgtttggcatgcattctcaaaatctattcatcacactgagtcattattatccattttactttggaggagagtagtcccaggcctcacaaataggaagtggggcaacagagatctgaactcaggct

SEQ ID NO: 23088 - DNA, 178 bp, Homo sapiens
  misc_feature 38: n=a, g, c or t
  misc_feature 56: k=g or t
  misc_feature 60: w=a or t
  misc_feature 86: s=g or c
  misc_feature 87: y=c or t
gcactataacaatttagattcttaggaggcagcattcngctggcccagtgtgggckatgwgtctaccacttggcttagaaaattgsygaggcttggtctgttgggacaggggagaccagggcatatgtaattccttagaaggaaattggggtgttacttagtaaagggatactagagt

SEQ ID NO: 23089 - DNA, 203 bp, Homo sapiens
  misc_feature 121: w=a or t
  misc_feature 122: w=a or t
tcttattctcactttgctatagaataatgaaaagttatccaacattcattttggaatattgttttggaataattcatgtatctcggctgtctgattttaccaacatggaaagcataactcwwagacaattctttaatcagtttttaaaatgaaactacttttctcagctgttaaaaaaatagatttataataatagtcatcaa

SEQ ID NO: 23090 - DNA, 336 bp, Homo sapiens
  misc_feature 2: n=a, g, c or t
  misc_feature 10: s=g or c
  misc_feature 81: m=a or c
  misc_feature 82: m=a or c
  misc_feature 84: m=a or c
  misc_feature 161: h=a or c or t
  misc_feature 333: b=c or g or t
tnggtggggsattgttcggcttcatgggcaatcagagtagaagtcgaaatggcagaagaagaggagaaaaaatgatgcatmmamtcaagtgaatatcttgttttgttgttttaaaaaattaagtactttttgtcaagtgggataatgactcagtagatgahaaatctcatagagtgttctgtccttcattagaaaaacttccatttgccttgtcttcttttggtgactaaattgaatttgattatctgaatgtttctatttcgctgtagctcttaaaaggacagtcgatatttttttaatgagaggaaggtggttttatatggttctgaggcbcct

SEQ ID NO: 23091 - DNA, 411 bp, Homo sapiens
taaattttgtaccttcttgcacattgtggtatgtcgtggataatagagcattttaaagtgatctggttgcaaaaatgtgtatatcaggaattaataagctaatggggaaattttaagaatttcatgcttattagttttttcggtatgtttgtcttcagaacatattttaagtcagaatgagcaaagatagtagtcaaagttgggagaaggtgtaattttactgatttttttctttttgacttatttgaaccttgacatgtgctatgggtgagtttagataggtgtgtacaaatatttcagcctgggatgccttgctctaactatatcttgatttcttagcatgacttagtgaaagcttatttttaagaatcttcagattataaagtagtgaaaatttaacacttaggtggg

SEQ ID NO: 23092 - DNA, 411 bp, Homo sapiens
  misc_feature 12: y=c or t
  misc_feature 330: d=a or g or t
  misc_feature 331: b=c or g or t
cggttgataacytttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttadbatttatacaatagtgatgttactagtaaaaatgtttatagataacacgtagagctattaactgttcaaaagcctacatga

SEQ ID NO: 23093 - DNA, 366 bp, Homo sapiens
  misc_feature 34: n=a, g, c or t
  misc_feature 45: k=g or t
  misc_feature 69: n=a, g, c or t
  misc_feature 321: w=a or t
caaggacatggcactgtactcgctgttgagggcnaagggagagakggcctatgtagtggagccgaaccncgtgaaacacatcgggctcttctccagtctccggtacaactttcatcccagtctcctctagggtgccaagagatgcctttctgaagttggccacttcttgaagattcaaatatttatctctttatttagacatggttgcctgcaggtatttcactgtttactgttgttagagatataggcactggggcagctgaggaacctcaatatgttaagagccttggctttggtagcctcctggcaggagcagcagtwtgccacaggtccggacctctccctccacacagccacactgcccac

SEQ ID NO: 23094 - DNA, 121 bp, Homo sapiens
  misc_feature 54: h=a or c or t
  misc_feature 81: r=a or g
  misc_feature 82: r=a or g
ggatgtgagggcgatctggctgcgacatctgtcaccccattgatcgccagggthgattcggctgatctggctggctaggcrrgtgtccccttcctccctcaccgctccatgtgcgtcccca

SEQ ID NO: 23095 - DNA, 135 bp, Homo sapiens
  misc_feature 118: m=a or c
  misc_feature 119: s=g or c
gatgctgagtgcttttcagtgaggagtcagggaggtgtgtgtgagagagagagagaaaagagagagacagagacggggagagagagagggagagagaagagaggcgaggagggaagamsaaaagacggaggggga

SEQ ID NO: 23096 - DNA, 250 bp, Homo sapiens
  misc_feature 172: r=a or g
  misc_feature 218: r=a or g
caaaatgtgtacttcttcattgttgggttgattccccaaaaccttgacagatgtatcgatggaataaaagtatgttttaaaggttacttgaatgtcacaaaattatgccttcatcaaaactttaaaggaaaaatcaatttataaaatcatgtaggccatttttatatttgaratttgtccttttaaagatagttttgctgttgctcctagtgaaagaraaatctctgtacaaaggagaaaaagaacccca

SEQ ID NO: 23097 - DNA, 322 bp, Homo sapiens
ataaatcatttagtgtgactatattttactcaaatatatccatctaccaattgtgtttgttccaaaccctggtgactgtatcttcatcactcactctattcctaaattccagattaaagaattattttaccaacccgtctcatgcaactcaagtcaaccaaatgttacttccacatcctttctctatacgccttcctagacccctgaaatctattcaggataagtgaagtttgctataagggactgtccacaattttcttgtataatttttgggattcctaaatactccttgaaaaaaaacattggaatatgaagctgagcc

SEQ ID NO: 23098 - DNA, 322 bp, Homo sapiens
gttcgcttgcaagatggcggcggcggggcagtggctgctgcgttttcgtgtctgagtccttcctgggttctaatgagggcgcggttctgctgtgcccggcccgcgaggtctaaggcatgggcttccagcctccggccgctcttcttttgaggcttttccttctgcagggcatcctgaggcttctgtggggggacctgggtgtgtacggcgcggcagtgacctcggtgggccggggctgaggggactgggcgttaaaagggccagacttggactcccccgggagcttcgggagtcgacaacgccaaagcaagccgccacacaa

SEQ ID NO: 23099 - DNA, 394 bp, Homo sapiens
ttataagcttcttgaggatgtggagcttgtcttttgattactgtatagtgctcagcagaatactgttcacattgcagtaattcatgtaatgaagatgatgggttgtcattgtaatcattttggcaggttcacagtaggcactcaggtttcaggcatagggtgtaccagttatttttgaataatcatgccatggcattcaagttttttaccagtttgcagcttttgcacaattaaggtatgacaaatgtaattttattgagggaaatgcttaatcagtgagctgaactttaatgtaaatttgaaatgaaaaggtctgtgttctgatttcagattttcagaaactggatgttagatggaaatcatgttagccttaataccatgccttaaaatgcta

SEQ ID NO: 23100 - DNA, 147 bp, Homo sapiens
gagaggcggcggcacgacgacggtccctcagcccagccaccatgagcaccaagcagatcacttgcaggtattttatgcatggtgtgtgtcgggaaggaagtcagtgcctattctcacatgacttggcaaacagcaaaccgtccacca

SEQ ID NO: 23101 - DNA, 134 bp, Homo sapiens
gatgctgagtgcttttcagtgaggagtcagggaggtgtgtgtgagagagagagagaaaagagagagacagagacggggagagagagagggagagagaagagagggaggagggaagaagaaaagacggaggggga

SEQ ID NO: 23102 - DNA, 160 bp, Homo sapiens
ctagaaatattagagtaggccaaacacacctccaaactgtaaggctgtgcacaaacataaaaaatggcagccttccatctcctgcactggctgagtccatttacttgtgtacttgttctagtgagtggtgggactgtacatttttgaatagacctcaaaa

SEQ ID NO: 23103 - DNA, 389 bp, Homo sapiens
  misc_feature 186: m=a or c
  misc_feature 197: r=a or g
  misc_feature 241: n=a, g, c or t
  misc_feature 242: n=a, g, c or t
  misc_feature 343: n=a, g, c or t
  misc_feature 345: s=g or c
  misc_feature 346: n=a, g, c or t
  misc_feature 361: v=a or c or g
ttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcmcacctcctgtrtttggacctctagggaggagggttttggtcatactctccttatnntcgtgcacagaaatgctcagggtccccatgtgcctgttgttcagccctctctcttgttccctttctgagcatgtggtccttccccaggctgtgggacacangsnttcccacgaaagtgvaaagcagtattaagatcatactgcatgt

SEQ ID NO: 23104 - DNA, 99 bp, Homo sapiens
ccaatgcgagtcacatgactcagcttgctgtcaattcactggccaaagcaagtcacatgactcaccttgctgtctattcattagctaaaacaagtcaca

SEQ ID NO: 23105 - DNA, 160 bp, Homo sapiens
catcggggggggaggtgggaaaatagcaggattcttggggactctgagggcatgaatggagaattatttgattgaaaccacagagctcttgtacttagtattaaatattaaaatagaaatgaaaagttcagcttttctgagctgtaccatagcggccgct

SEQ ID NO: 23106 - DNA, 146 bp, Homo sapiens
  misc_feature 130: m=a or c
tccatcaacagatgactggataaacaaaatgtggtacatatatacaatggcataccattcacccataaaaaagaatgagatcctgtcatttgcaacaaggatggaagtggagatcatcatattaagtgamataaaccaggcacaga

SEQ ID NO: 23107 - DNA, 327 bp, Homo sapiens
  misc_feature 106: s=g or c
  misc_feature 247: r=a or g
  misc_feature 300: y=c or t
  misc_feature 301: y=c or t
tagtagagacggggtttcatcgtgttagccaggatggtctcgatctcctgaccttgtgatctgcccgcctcagcctcccaaagtgctgggattataggcgtgagcsaccgcgcccagcctgattttttttttttaagggtttttttgtgtggctgtctccttcagttctgctctgatcttggttatgtcttgtcttctgctagatttggggtttgtttactcttggttctctagtcttttagttgtratattaggatgtcgatttgagttttttctggctttttgatgtgggcatttagyyctataaatttccctcttaacactgca

SEQ ID NO: 23108 - DNA, 173 bp, Homo sapiens
gctttggtcacagtgaccgccaccgttgcccggggatgggtccctgagacttggcgaagtaggagccctgtgtgatcgtgcgtcagagtcggggctgagaccagcccttgccagggcagttaccaggacggtctccggaggccgggattcgcggagggtccaccagcagggat

SEQ ID NO: 23109 - DNA, 162 bp, Homo sapiens
attagtattttggaaatagcatatctgagactgaagagaaattgacaattcacttatttgtggtttttttctcagctattctgagcttatttatttatttgtatgttctaatggctaaacatttacattaaatgttttttttcccaagattgtgttggagac

SEQ ID NO: 23110 - DNA, 271 bp, Homo sapiens
gattgaccgaagttttatattaacttgctgcttattcgatcaggtggatttattttccttcttattgtctcttttcaaaggaatcaattcttacgataatttaacagtgtaatctgggataattatattaatcaagtttctgtttcccttaacatcaataaagttaaaaaattccatcaaaggggttatctttatacttccagaaacaccccagactgccactataaaaacagtattatataaatcaacgaaccatttcatcaacccacac

SEQ ID NO: 23111 - DNA, 203 bp, Homo sapiens
  misc_feature 101: m=a or c
  misc_feature 104: r=a or g
  misc_feature 117: r=a or g
  misc_feature 125: m=a or c
  misc_feature 127: r=a or g
  misc_feature 155: r=a or g
aaataaagcaaacacaaaaataaaattttaaaatttaaaaaatcagactaaattttcaaattatataataatattatatttaaatatgtctttcagaatamcartgttgtagaacarttatatcmartgtgtgtgtgtgtgtttgtgtgtgtgtrtgtgtgtgtgtgtagtagaatccaatatttcagtgatattaggcctaa

SEQ ID NO: 23112 - DNA, 215 bp, Homo sapiens
  misc_feature 17: s=g or c
  misc_feature 63: s=g or c
tatcaaatcgtgcattsaggcccatgagaaggacatggagctctcatttgccgtgcagcgcasaaggacatggtgtgtgggatctgcattgaggtggtctatgagaaagccaaccccagtgagcgccgcttcgggatcctctccaactgcaaccacacctactgtctcaagtgcattcgcaagtggaggagtgctaagcaatttgagagcaagat

SEQ ID NO: 23113 - DNA, 420 bp, Homo sapiens
  misc_feature 36: k=g or t
  misc_feature 37: n=a, g, c or t
  misc_feature 38: m=a or c
  misc_feature 374: r=a or g
acattcttaacaatactgactggctgggcgtggcgknmtcgagctggcattcccagcactttgggaggctgaggcgggtggattgcttgagtttagggattaggagattagcctgagcaacatggcgaacccgtctttgcagaagatgcaaagattaatcgtgtgttgtggtgcatgcctgtagtcccagctacttggggggctgaggtgggaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccargttaaatcccatggattactctatgggggtgatgacatagtatcta

SEQ ID NO: 23114 - DNA, 58 bp, Homo sapiens
  misc_feature 50: r=a or g
tgattgtaataaatgtaccacttagatgcagggtgttgatagtggggtargttgggga

SEQ ID NO: 23115 - DNA, 225 bp, Homo sapiens
  misc_feature 1: k=g or t
  misc_feature 32: w=a or t
  misc_feature 75: d=a or g or t
kgacgatacttttggcgcgcgccggttgctgwttcttctctggctccgggaccggcggcggcggcggcggcagcdgcggcggcgtagggtgttttaactcaaatgggtgatgaaaaggactcttggaaagtgaaaactttagatgaaattcttcaggaaaagaaacgaaggaaggaacaagaggagaaagcagagataaaacgcttaaaaaattctgatgaccag

SEQ ID NO: 23116 - DNA, 385 bp, Homo sapiens
  misc_feature 20: w=a or t
  misc_feature 67: r=a or g
atcttcctccgtagtaagcwcctttggatgagggccatgcttgttgattaaccgttacgctcctgtrcgtagtcaagtgcttggtatatgaatacgtgttgaacaaataaagaatactttgtgttttagtgattaataggattgaaagacattgggataaaagttaccccttagttaacttttccccccgcaggtgcactcacctttcaagcttaggaagatgtgaaagatttgcagtcaaactcaagttcaaatcccagtcccactgaccttgggaaagttctttaaacctccctgtgctcatttcttaaacattgtgtggtaaaacatctgccttttctacttctcagggatttaatgagaacatgtatctcctacaccacaa

SEQ ID NO: 23117 - DNA, 208 bp, Homo sapiens
  misc_feature 126: b=c or g or t
tgctgaaagtcctgctttcctatctagcatttattcctctggcaaacttttctttcttttcttttttaaagtaaacttgtgtattgagtcttaactgtatttcagtattttccagccttatgtgtbacattattccaatgatacccaacagtttatttttattatttttttaaacaaaatttcacagttctgtaatgtaggcacaagg

SEQ ID NO: 23118 - DNA, 119 bp, Homo sapiens
  misc_feature 43: s=g or c
  misc_feature 44: n=a, g, c or t
aaaaagccaaaatggctgccccgaggaggcccgcaccgcgtasncagtgaaggttggggagcaagcttatgcgggaaagagggagggggactccaggaaaagccgttgagaggaccgct

SEQ ID NO: 23119 - DNA, 437 bp, Homo sapiens
  misc_feature 108: m=a or c
  misc_feature 363: y=c or t
  misc_feature 409: m=a or c
gatctgaacctcggtttgtccaaagcaagactgctactttttctctcacacacaatggcgaggcagagggagctggaatggcaacctccccagcgccccatcaggggmtacagcaataacagcatccaggacttgcgtggccagaaggtacaccagctggtcaccacctgctggcaccctgcatccctatctgggctctggggttagcaggtgggagtaggactgggggtggaggccaagcatcctaaaagctttatttttctattatgagacttgttgggcactgacttcatcttcttctttttttttgaaacagggtctcactctgttgcccaggctggagttcagtggtgtgatcacggytcactatggccttaaccttccaaggctcaggtgatcctcctgcctmagcttcccaagtagctgggacaacaggt

SEQ ID NO: 23120 - DNA, 312 bp, Homo sapiens
  misc_feature 9: d=a or g or t
  misc_feature 118: k=g or t
atgtgactdcggcaagatggctgccctgacagcggagattttgcagcactccagagcctgctcaaggcctcctcgaaagatgttgtcagacagctgtgtcaagaaagcttttccagtkcagcccttggcttgaaaaaactcttggatgttacatgttccagcttgtctgtgacccaggaggaggcagaggaactgctccaggctctgcaccgcctcactaggctggtggcattccgtgacctgtcctctgccgaggcaattctggctctctttccagaaaatttccaccaaaacctcaaaaacctgctgaca

SEQ ID NO: 23121 - DNA, 280 bp, Homo sapiens
  misc_feature 262: b=c or g or t
aaacagtaattcccatgtgctgagtttgctgtgaggattaaagacaaggactgttctaagcccggcatataacgggagcccattataagtgaactgaggtgttattttaatatataccttttaaagtttgagtgttaggcatgctgttgagtgaaagaagacagactgttaccagaggacatattctgttctatgataccacttgtgtaaacgtgaaaagcaggcaggaattttccatgtgagagaagtcagaatagcagtbagcttaccagggggtgca

SEQ ID NO: 23122 - DNA, 329 bp, Homo sapiens
aaagagaaaactagtagtttacagtggagaaaacttccagatgcaccacttcacctgtaataagacatattaacatcatatgcactcatatattggaatatatgcatcacatatgatgcacttgagaagactacatcagctctgtggtgatgtggctttcagaatgcataacttcagtctaatgagaaaacatctgacaaacccaaactgtgggacattctgcagtgtgtatgatataacatcaatattatgaaagaagaaagactaggataagtctcggattggagaagactaaggaaatgtaaaactaaatgtaaggggggggggac

SEQ ID NO: 23123 - DNA, 146 bp, Homo sapiens
aataaaatcacataactctccagctcaaaaccctctaatggcttcatattacatgtaaatcagtcccaagtatcttaccactgactctaagactgaatgacttggctgtgaaccacctgtctgaccttaccttctaacctccacat

SEQ ID NO: 23124 - DNA, 80 bp, Homo sapiens
attcagagctcaaacttagagctgctatcggaggaggattttagatttaggaaattctcagcagagcatccgaggggcac

SEQ ID NO: 23125 - DNA, 216 bp, Homo sapiens
  misc_feature 119: r=a or g
aactcaattcaggggaagctgaagaggaatacatgtgatgtcaggatatcaggaagagaagactctcaaatgttgaaatttcaaatgtgggcgaggaagtgacatttattacccgcacrcagaagagaatgagccaagaggtgctgcaggagttcagaggcaagagagaggaatgtggcctgatatgcacagaagacttcatgaaggaactgggcc

SEQ ID NO: 23126 - DNA, 430 bp, Homo sapiens
  misc_feature 313: k=g or t
  misc_feature 395: r=a or g
  misc_feature 402: k=g or t
ccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatktcttttgaccatatacccagaagtaggattgttagaccatatgggagttttatttttcatttttaagaaacttccataatgrctttackaatttccattcccaccagcaggacacca

SEQ ID NO: 23127 - DNA, 277 bp, Homo sapiens
agcatccggaatctggcccctgcaggcgtggggttccacgtgggaggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagca

SEQ ID NO: 23128 - DNA, 304 bp, Homo sapiens
  misc_feature 163: n=a, g, c or t
ataacagtttctggtgaagcttcccttgatccctgactcaatcagctaggtagagataaaagagaaattttgtattctgaagatgtacagacaattataaggaactctggttgactgcagggggaagagacacaatagctattaaaataaaagtatgacagtngggctaaacaggcagcctcaaacatcctaggagtccctgagggcaacactgtatgtagtgactcaggttcttagaggaaagtgggtcatcaacaagaagcatacaggcttgtttttggtatctttataagaatagagggac

SEQ ID NO: 23129 - DNA, 98 bp, Homo sapiens
atatcttttttagggttagtagaaattgttttatgttgatgggaggtttgtttgattgtcaaaatgtacagccacagccttttaatttgggagcccta

SEQ ID NO: 23130 - DNA, 128 bp, Homo sapiens
  misc_feature 35: k=g or t
taagttggtaaaccatgtgctctgtgctatgagtkaattatgttttcccaaatactaatgtggcacaagtaccatattttatcagagttcttatgtacagtatggtgaagataagtgacaagcacacg

SEQ ID NO: 23131 - DNA, 208 bp, Homo sapiens
  misc_feature 126: n=a, g, c or t
tgctgaaagtcctgctttcctatctagcatttattcctctggcaaacttttctttcttttcttttttaaagtaaacttgtgtattgagtcttaactgtatttcagtattttccagccttatgtgtnacattattccaatgatacccaacagtttatttttattatttttttaaacaaaatttcacagttctgtaatgtaggcacaagg

SEQ ID NO: 23132 - DNA, 164 bp, Homo sapiens
  misc_feature 50: w=a or t
tcagcttgagtttaaactctttgaaattggcccatgaatttgatgctgtwctcttggtctttttcacaactgaaacattgggccgttggtgggacgttctgtgccttgaaacttttaatacgtgcagctccatctcctctatcactttttagattcctagtcct

SEQ ID NO: 23133 - DNA, 115 bp, Homo sapiens
tgtgaatttaatgtgaatgcatctgactttttacagctgagtataatgcttgccgaagtttctggtagatatactacttctcataggaagtttatttctattttactatgctgca

SEQ ID NO: 23134 - DNA, 351 bp, Homo sapiens
tattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccataccccctgc

SEQ ID NO: 23135 - DNA, 352 bp, Homo sapiens
  misc_feature 6: n=a, g, c or t
  misc_feature 33: y=c or t
  misc_feature 34: s=g or c
  misc_feature 330: k=g or t
tctgtnattccagtgtcactaatttatattgtystttcctctgatttttttcaggttagtgatttttttgtatacaatttaatccaaatgttatgacattcagaaatcatgaaacacagtagatatctgttataatgtggtgtatcacatggattataaagcaaagttatggtcgatttctattcttgaaagaatcaactacagtgaatcctttgcatttgaagccttaacatgcattgctttaattttgcccagggacaaattttaataatcagcaagactggtttgtgcaaagcgttgagtcatcaggtatttagagcctagccagckacccagtatccatgctgcccga

SEQ ID NO: 23136 - DNA, 368 bp, Homo sapiens
  misc_feature 4: n=a, g, c or t
  misc_feature 144: m=a or c
  misc_feature 280: s=g or c
  misc_feature 304: n=a, g, c or t
tatnttttaagagactgggtctcactttttcaccaaagctggagtgcagtggtgtgttcatacttcactgtagcctccatctcctgggctgaagtgatcctcctgttttagcctcctgagtagctgggtctgcagacgtgcacmaccacacccggctaatttttaaaattttttatagaaatggggtcttgctgtgttgcccaggctggtctcagactcctgggctcaagtgatcctcctgacttgggctaccagagtgttgggactacaggtgtgagcsacggtgcctggccttgtgtctgtnttaatctagagtaggagtcagcagactttttctgtaaagagctagatactattttcaggtttgt

SEQ ID NO: 23137 - DNA, 162 bp, Homo sapiens
  misc_feature 147: w=a or t
aaaacctctcttccttctcctacattcttgccagaattgaaatctctgtcagttactacatctttcctaagacttaaaactctacacagtgaatttttgtaaagtgaactggacactatactgttgattgaataggacacctgagtwcccctgtggcacagt

SEQ ID NO: 23138 - DNA, 299 bp, Homo sapiens
  misc_feature 23: d=a or g or t
aaaattcttggtgtaagccagtdcagcatattttagcctgtgtttgccacgaggttgagctttctcccattaagtttaactcaattttttttagcctatttgcactataaggaaagtttatttcttttttttaaatctattttaacttggaaaaaactcagatatgtaataaagcacatcaggttacaaatagcaaaaaaattaagtcgaaattcttttaatttgaagaattacttatcacaacatagtctcataactctttctgcttcttactttttttctttctctaaaggcccaat

SEQ ID NO: 23139 - DNA, 181 bp, Homo sapiens
tatgtagcattaaatataaaatacataaaagaatgtacagaaaatagcttttattgagtaatattacatttcatttatactgtagcaatatatttgtaggtatactctgtaagagctttaaataaaagaggtccattaatacttccttataaaaattctagtctgtttcattactgcccac

SEQ ID NO: 23140 - DNA, 154 bp, Homo sapiens
catggaaatgaaaatcaaattaatatgtaaatgaaccttaaaagcgtaagacataaacttactaaattttgcaaaagttcaagttgagttctgtaaatggaatttaaattaaaacatacaatataaatcagggataggtaaacaactggccagc

SEQ ID NO: 23141 - DNA, 199 bp, Homo sapiens
ccatctcacaaacaaacaaacaaacagtagtgttaacttagtaattttagctcaaggctaataatcaggagcgtctacaactaaattaatgagtattcttctccattttcttatttatgaaaagaatatagcattacttcatgattatttgagggtaatgaatttatgaagtactcgaattaacatttatacccgccaa

SEQ ID NO: 23142 - DNA, 127 bp, Homo sapiens
  misc_feature 15: m=a or c
  misc_feature 17: w=a or t
  misc_feature 51: r=a or g
  misc_feature 74: m=a or c
tatgcttttattgcmgwatattctacctgaatctttgaaaaggaaagagtrgcttatagttttcgatctgctamttgtttcatagaaatgcctatataatggtggtgagattgagcagatcgtagaa

SEQ ID NO: 23143 - DNA, 216 bp, Homo sapiens
cgtaccttcatgaaatattcttcctttttatctctatccttgttgacgtttcagcatgcctaatttttaaaaaaatgttgtccggtaaaatatacatcatatcaacttactggtggctttggcccacttcttctattttcctttcattacaaatttttattagctgtgaaagaacagacttcccaatttcaagaaaagtttggtaatatattttgt

SEQ ID NO: 23144 - DNA, 278 bp, Homo sapiens
  misc_feature 4: s=g or c
  misc_feature 259: k=g or t
  misc_feature 277: w=a or t
  misc_feature 278: k=g or t
aatsggagagggtgcggaaacgctggaggagaactcaggtaatggcgccagcgaaagaagcctgcggatacggagaaactgcatcttcgcgtgactttgggcgctattcctcgcggtagtggcaaggccttctgggagttgtagttctacgggaggcttgttttccccatcttccagtttgattccgagagcgttctttccacttaattaattattcatatatgcaaatttgctctttcactggcaaggagactgagtktctactccccgaggagcwk

SEQ ID NO: 23145 - DNA, 177 bp, Homo sapiens
  misc_feature 8: n=a, g, c or t
  misc_feature 15: n=a, g, c or t
  misc_feature 109: k=g or t
gcataccngctagtngtctgtacaggcggcacggtttgatggcagagatattttctttccaaactgttcaaaatgatgaacgaagatgcagctcagaaaagcgacagtkgagagaagttcaacggcagtagtcagaggagaaaaagacccaagaagtctgacagcaatgcaagcaaa

SEQ ID NO: 23146 - DNA, 307 bp, Homo sapiens
  misc_feature 13: n=a, g, c or t
  misc_feature 20: k=g or t
  misc_feature 247: y=c or t
agtactctcagtnctgatgkcacaggcgcggcaaggacatcgcaaggaggagtcggattacagtaaggatgggcagtgcagcaggcagcccgagcgcactctccagccgccggggatcttagccctggaaaggcagcctgcaaggctcatcccgcggaggaggcacgctctcggcgctcactgctctccacgccggggacatttccaccgaatgtagcatgaaagggctctgctctacgtgccagcyttgggtgagagctgatgctgaagacaccgcggtgggattccagctgtctgattaatgaga

SEQ ID NO: 23147 - DNA, 200 bp, Homo sapiens
  misc_feature 12: k=g or t
  misc_feature 151: b=c or g or t
tttatttttttkcaaaaaaaatgtttattttgtttacaagattgggcatctgtatgtggtgagaacctgagctgttttcactcatggtgaaaggtgaagcggggctgagctggtgtgtgcagagattacatgatgaaagaagaaacaagtbagaaggagaaggctccaggctctttttaacaaccagctctcacagaaac

SEQ ID NO: 23148 - DNA, 158 bp, Homo sapiens
tgtttttactttttggcattcacaagacatgttttggtacatcaaaaggttcattccaaatatttgggactgaagatgtaaacaaaaaatcaatcttgtgacttgtagatttctatcttttttggcttcagaagatggatgaactggctgcccccacg

SEQ ID NO: 23149 - DNA, 61 bp, Homo sapiens
atatataccttactttagtatccattgacaagttctcctttttcttcttcttcattttttt

SEQ ID NO: 23150 - DNA, 336 bp, Homo sapiens
cagatggattgagctacttttgttttattctcatgtggctcaaggtacaaatgacaaagttcaaactttgtcgaagatagagtgtctagggggaacccataaatgtaagaccccaacggtctgtgaccttgaaatatattggaaatgtgtattggaaatgtaagtaggtaatttattttttaaaaatccgtagaatcatgtcgcgccaacatggaatagcttggaggagatcatgttaagcaggttgtcaggcacagaaaggtaaatactacatgctttcactcacatgtgggacgaaaagaaaaaaggaattcctgaaagtagagaggtaaaagc

SEQ ID NO: 23151 - DNA, 420 bp, Homo sapiens
gagatctgttgaaacattgatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtg

SEQ ID NO: 23152 - DNA, 337 bp, Homo sapiens
catgaaatatttcacatatcttcctttcttggtacagtggacatataactgctttgaaaattctgcagtacgttgtgtttgatatgatgtcactaaacaatgatatttcatcactgtggaaggtacaggaatttaaattttatctccttgattatgggattaagaaggaagctgcatgcttccgtaaatatcttaatgtttaattcttaattgtagatgtagaaataaaagcatttaattatcatatgtatgtaatgtacttgctgagttgtgcttgctcttctttcttttatattctttgtttttccctcttagagttgttttttttcccctgcaa

SEQ ID NO: 23153 - DNA, 256 bp, Homo sapiens
  misc_feature 222: d=a or g or t
agccaattaaaaagcatgctgtgatgcccagcttccctttccacagggtgcatgcgtctcctgctggtgaatcacatgcggcaagaggcaactggctccacagcctgggatgctgccgtaccaagaggaaagaagcagcaaaatgcctttacgttgttctaaacccccgacgcataaagtgtagaggagggatggccaagggtgggtggtagaaagtgtgtdcaggctgacactggcaatgagtacagataatttc

SEQ ID NO: 23154 - DNA, 99 bp, Homo sapiens
caccatgtgtctatctgaaggttgcactggccagcatgggcctgtcccaagcgagaggggagacacagtggactgaaaggactggttgaaagtggccgc

SEQ ID NO: 23155 - DNA, 195 bp, Homo sapiens
  misc_feature 153: k=g or t
tcctggatctgttttatatgtttttccaaggttttggggaagctgaaatgtatttttcaatcttaaaatgttgttttaattatatggttgctcttttgtaggctgtcagatacaactgcattagaatagataaacaaccagtgtacaacgtakaggtaaggggcttggagcagcattggtgatgggggcaaagaa

SEQ ID NO: 23156 - DNA, 200 bp, Homo sapiens
  misc_feature 11: s=g or c
aaaagattgasaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagcccca

SEQ ID NO: 23157 - DNA, 199 bp, Homo sapiens
ctcatgctggtatgattaatactgttgatgcaattaaaactaccttctgctcttgattaagaccagaatacaaggaatggacctgtgattagctgataacattgtggttttatcctttttatcaagtaagaatattagctacagaaagatgtgctataagatattcctggtaaagactttcaaatattagtgggaactc

SEQ ID NO: 23158 - DNA, 198 bp, Homo sapiens
  misc_feature 4: k=g or t
  misc_feature 118: r=a or g
cccktgaatatatgttatatattctttttcggcagattatcagattagtaagtgtttaaaaggcatcagtttttaaaactgcatataccacacacacacaaaacagtacacaaataarggttttcacaaattaaacaaactcacatactagtcttcagatcaaaacacagagcattatgtgtaccccagaagccctta

SEQ ID NO: 23159 - DNA, 108 bp, Homo sapiens
cttatacatgtcttgtggtaagcatatatatgcctttctgttggggaaatatctaggaaaggaattgctgggtcgtatagatacacatttgtccagccttagtagccc

SEQ ID NO: 23160 - DNA, 153 bp, Homo sapiens
aatatggcttcctgcacctggtgacgcttggcgaaactgaggtctcatggagaagccccggagtattgaggagaccccatcttcagaaccaatggaggaagaggaagatgacgacttggagctgtttggtggctatgatagtttccggagtag

SEQ ID NO: 23161 - DNA, 428 bp, Homo sapiens
  misc_feature 9: b=c or g or t
  misc_feature 10: d=a or g or t
  misc_feature 11: b=c or g or t
  misc_feature 12: y=c or t
  misc_feature 19: s=g or c
  misc_feature 44: y=c or t
  misc_feature 45: y=c or t
  misc_feature 65: r=a or g
  misc_feature 66: r=a or g
  misc_feature 316: m=a or c
  misc_feature 317: w=a or t
ctgataacbdbyttcaaascttcatttgaaatgctttttatcayyccaagtggaatgtatatgarrccaaaccccttgtttttattcccctttccgacataccttttaagagtactaaatacataatagcgttttaagagtactaatatttctgccaaccagaaaacctcaccaccatctttgattccccccatcccgcctacctttttttaaaggtctagtgatttttctttccattgtgtgcagaattttttccttctcttatgttgtcttaacacgggtttcatgcagctgacctcctgattgatccagtggmwgatactccccactctgccctgataattggtcacagtgccttgatggtgtttatgtgttacacaaaaatatgtaatgacttccctcttgcctctgagcttgtccacaaacat

SEQ ID NO: 23162 - DNA, 166 bp, Homo sapiens
ccttctgtctcaggtgatgcattgcacatttgggatatttggaaaggaaatgaggaaagaaattagggcctcctctgatctctcgctatctgcgggtcctgtccttttctcaagaccttcaccattactggtgttttcctgtcttctctttagtatgatccccctt

SEQ ID NO: 23163 - DNA, 118 bp, Homo sapiens
aaataaatagatagatagatagatagatagatagatagatagatagatagataggatagatagatacatagatagatacatagatagattcagatgctaaaacaaagacacccccgct

SEQ ID NO: 23164 - DNA, 239 bp, Homo sapiens
attacttttcttttattggcatttacttgagagttctagagccatgcccagagttccagaactccagagctaaaattagacaaagaaacttctccatctcagagagcagagaactcgcccacattagctgatctactggcacctcccacagactcacaaaggccatttgcataactcccatgcctcctagtaacatccaaaggctcaagccgatgtatctttttcaaccacagagcaaa

SEQ ID NO: 23165 - DNA, 440 bp, Homo sapiens
  misc_feature 9: s=g or c
  misc_feature 10: k=g or t
  misc_feature 201: y=c or t
  misc_feature 373: s=g or c
  misc_feature 434: k=g or t
actgagggskggcagcctgctaggcacaaccttacattccatctgtgatttatttgagctgtccacgtctccatctattccccaccgcgaccgcgcaagggcaaactggcacagtggaaggagtcgggcagatccagggcggactcctggcgccgccgcccactctcagtgaccatggacccttcacgttctgagccagtytcttcgactgcaaactggggcccgtaatagcgcccgcctcccggttctgagtattctagaggtccaccgggagagcggggccccccgggtcccccgggaccgccgggagtgcctggatccgacggcatcgacggtgacaatgggccccctggaaaagctggccctccgggasccaagggcgagcctggcaaagctgggccagatgggcagacgggaagcccgggattgatggkttaact

SEQ ID NO: 23166 - DNA, 213 bp, Homo sapiens
ttctttggaaaaaattgcaggatccaagtaatcctgccatcatcaggcaggctgctggaaattatattggaagctttttggcaagagctaaatttattcctcttattactgtaaaaccatgcctagatcttttggttaactggctgcacatataccttaataaccaggattcgggaacaaaggcattctgcaatgttgctctccatggaccta

SEQ ID NO: 23167 - DNA, 143 bp, Homo sapiens
taagttttagggtacatgtgcacaatgtgcaggttagttacatatgtatacatgtgccatgctggtgcgctgcacccactaactcgtcatctagcattaggtatatctcccaatgctatccctcccccatctccccccactca

SEQ ID NO: 23168 - DNA, 200 bp, Homo sapiens
ttatatcccttagtagatgatggcagagaggtagcagagcaaagatggctaaactaaaacgtggatcagatttgcaaaactccattttctagccaatatcataggaaaattaaagaaaagagcatttgctatctattactgtctccagaaaaaacctccagctttgttaaaggtataactttaaaaagcaacaacccgct

SEQ ID NO: 23169 - DNA, 126 bp, Homo sapiens
  misc_feature 111: y=c or t
acttgggcggcgccggatcggacgcttggcactctgggcggccccccggcggagtggtggtcccaggagaacctccgaggtgggagggtcccgcccgcatagagggatgtyctggagaagccggga

SEQ ID NO: 23170 - DNA, 154 bp, Homo sapiens
gatagcctcatgtaacaagtcactcacatattagtgcagaaagatagaagaaagattggccgggcacagtggcttatgcctgtaatcctagcgctttgggaggccaaggagggcggatcacttgagatctggagttcgagaccagcctggccca

SEQ ID NO: 23171 - DNA, 327 bp, Homo sapiens
  misc_feature 12: m=a or c
tttagacgatgmgaaaatttaaactataaataggccaggtctgggtggcttatgcctgggatcccagcattttgggaggctgaggtgggaggctcactggaggccaggagttcaagaccagcctgagcagcatagggagacctcagctctacaactgaaaaaaaaatggccgggtgtgttcatggtggcacctgtctgtattccagccacttgggaggctgaggcgggaggtttgcttgagtccgggagtttgaggttgcggtgagctacacaatgagctatggtggcactactacactccagcctgggccatagagtaaggcccct

SEQ ID NO: 23172 - DNA, 196 bp, Homo sapiens
  misc_feature 179: k=g or t
cattagccccttttaatttgtttttccttttgactcctgctcccattaggagcaggaatggcagtaataaaagtctgcactttggtcatttcttttcctcagaggaagcctgagtgctcacttaaacactatcccctcagactccctgtgtgaggcctgcagaggccctgaatgcacakatgggaaaccagggcac

SEQ ID NO: 23173 - DNA, 154 bp, Homo sapiens
atatgatacttataatagtatccttaattaacataagtgatatcatattattcttgtgcccaccacataaaacggtctaagacagagcctttgaccttaaagtgtctacaacttaattagcaaaataatgcttgcagagagagacaagccggga

SEQ ID NO: 23174 - DNA, 222 bp, Homo sapiens
  misc_feature 208: k=g or t
  misc_feature 209: r=a or g
ttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccatttkrgtacaggtgcctc

SEQ ID NO: 23175 - DNA, 201 bp, Homo sapiens
taatatggattgtgttcagaaatttaaggtgtgtacttcatagtatgtatgattgtaggagaaaaatgtgctatcatcgtttggagtgttacaacataaatattttggtcaacacttcctatcctgctctgacttttcatctcatctccattttcttcctctcttgattgtttttatgtcatttacatatgtaaaagccac

SEQ ID NO: 23176 - DNA, 310 bp, Homo sapiens
  misc_feature 43: y=c or t
gtatctgttttaaagaaggcacttgaaattacaaaagcaagtyatgtgacccctcagccagaagatagttggatccctttacttattaatgccattgatcattgcatgaatagaatcaaggagctcactcagagtgaacttgaattatgacttttcaggctcatttgtactctcttcccctctcatcgtcatggtcaggctctgatacctgcttttaaaatggagctagaatgcttgctggattgaaagggagtgcctatctatatttagcaagagacactattaccaaagattgttggttaggcccaag

SEQ ID NO: 23177 - DNA, 429 bp, Homo sapiens
  misc_feature 20: k=g or t
  misc_feature 21: k=g or t
cctagctagaaattttaaakkgtacttttctccctattgtttaaccttttagagtgtacaaatcagtggcttttaatatattcacagtgttgtgtaactgtcaccactgtctaatctcagaacattttcatcactcgaagaagaaaccctgtacctgttaaacagtcactccccattctgtactctcctccagtaactactaatctactctctgtctctatggatttgctttttttattttttttgtggcacgatcttggctcactgcagcctccacctcctgggttcaagcaatgctcctgcctcagcctgctgagtagctggtagctgggattacaggcgcccaccacacccagctaatttttgtagtcgagacagggtttcaccttgtttgccaggctggtctcgaactcctgaccttaagtgatc

SEQ ID NO: 23178 - DNA, 417 bp, Homo sapiens
  misc_feature 350: s=g or c
cctagctagaaattttaaattgtacttttctccctattgtttaaccttttagagtgtacaaatcagtggcttttaatatattcacagtgttgtgtaactgtcaccactgtctaatctcagaacattttcatcactcgaagaagaaaccctgtacctgttaaacagtcactccccattctgtactctcctccagtaactactaatctactctctgtctctatggatttgctttttttattttttttgtggcacgatcttggctcactgcagcctccacctcctgggttcaagcaatgctcctgcctcagcctgctgagtagctggtagctgggattacaggcgcccaccasacccagctaatttttgtagtcgagacagggtttcaccttgtttgccaggctggtctcgaactcctga

SEQ ID NO: 23179 - DNA, 191 bp, Homo sapiens
  misc_feature 19: s=g or c
tttagtattttagtaccasttccatgatttttgccacaactgcacatcattaaaaaatattgacttgtttattatttatgtatgtattgatgtgtatacatgtataaattcatacatatttttaaagaaaactttcattagctctttatatgggaaatcattatgtttaaatatacatctaagcaacgcaa

SEQ ID NO: 23180 - DNA, 259 bp, Homo sapiens
  misc_feature 19: s=g or c
  misc_feature 110: w=a or t
caaatacaatattataacsttatgctaccactatcatattatgtggcctgttattgacagatacattgttattctgttcatgactgtattagtaccaggttgtggctgtwtctaatatatcctctcccactcctctcattccttactgaagtcaccagggtagtagcaatcactggaaccagacctataatatatctgacttggtatctgtaactgttctgagaaacatgtgttgaaaggcagccaggctgcctgatgt

SEQ ID NO: 23181 - DNA, 413 bp, Homo sapiens
  misc_feature 306: k=g or t
ttggaattagttatctgaagctttaggattcctcagcaatatgattatgagacaagaaaggaagattcagaaatgagtctagttgaaggcagcaattcagagaagaagattcagttgttatcattgccgtcctgcttggtttatggcctggttcaggaccaaggagagaagtgtgaatacatgcctcttgagctatagaatgagacgctggagtcactaagatgattttttaaaagtattgttttataaacaaaaataagattgtgacaagggattccaccattaatgttttcatgcctgtgcctkaatctgactgggtatggtgagaattgtgcttgcagctttaaggtaagaattttaccatcttaatatgttaagaagtgccatttcagtctctcatctctactccaact

SEQ ID NO: 23182 - DNA, 440 bp, Homo sapiens
  misc_feature 53: n=a, g, c or t
  misc_feature 133: y=c or t
  misc_feature 227: s=g or c
  misc_feature 287: k=g or t
acatccagtgagaaccgaggaagtgatggttcagacattcttgggtcccccanacagaacacaccgggagttactgcctctttctcatcccgagtcctcctgactttccccagcacccatcgtggctgcagcyaggacacaggagctgggagatgggaacatcactagaccacgagccggaattgctgcaggaggattcccacactctgggcctccgtgggcaccasaggactggacgtgcgaccccagctctctgggtctcagtttcgtctcctgcagagcatctkagctagaccgtctctaaaatttcatcaagctcctgtattccattctattctgagatgcccaattcttatgcctgctaaaaaccacagtgagaaataataacctatgtccacatttttgtttcctaggagaaatatcaacatgcgtctgccagc

SEQ ID NO: 23183 - DNA, 164 bp, Homo sapiens
tatttttcccttagatgttttcaaagtgatggtttttattttagtaactggtaacaagtcttattttgctcttagttccttcagtgaagaacgtaattgaagcttcaaagtgtttataaaatagggaagtaattaactgcttttcattcctaaccctggaacac

SEQ ID NO: 23184 - DNA, 410 bp, Homo sapiens
atatattcctcattctcgaagaagcagagaatgccaaggctgcatatctgctgtaatctacctagccctcttctgcttaatatgatccattattgaatcttctcagattaaaatccattcctatatcatctacctttcccaaagtgtgtgcctgtaaacctaccttggaagtggcaagttaactgatttttttgtgtcatttttataccaatccttaaggtcaaagccttttgctatcaatgtatttaaactgagttgctatatgttcacttaatttgttttcaaaatgttttgctccaacttaaattatcttttaacatcttttgagtgccaagaattgctaagtaactgtaatatgttgaagagagtaattgccaagcaagcagtcataaagccaaaatgtaatgagc

SEQ ID NO: 23185 - DNA, 71 bp, Homo sapiens
atttttggctccgcagtccggggctgctcgctgcttgtcgcgcgctcacacacacacagacacacacgcac

SEQ ID NO: 23186 - DNA, 408 bp, Homo sapiens
  misc_feature 373: r=a or g
agatctacagcagtgcctcccattgcctgcatccaattaaaagccagagggcaagagagtccagtgatgcagtcgtagaggtcagccttccaggcacaaagcaaagtggaggacagaaaccagcaccagatgagatgttctcctggaagctttgggaaaggccatctcagtcccatagagactggagactttaggaagagagagcccccagtcttggaaaaacaattcctaataggagagacaccagttcctgttcataagaggtaccaagttgggcgtccttggacccagacataagctggggagccagagaaacctggatggaacagggaccctaagaagtggctgaataaccaccaggagagagggagtrgcttcctgaacaggagctgacctgcaagaccggat

SEQ ID NO: 23187 - DNA, 282 bp, Homo sapiens
  misc_feature 43: y=c or t
  misc_feature 44: y=c or t
aacaaaaatctgacaaggactcctaaggaccaacagctctcayyttgtgtggcatgctctgtctataccctcagcaccactgactgggcaaagcaacgtgttccagaaggctccccgcatgcagacagtggggtccatggggtggctcctccaaactgcatcagggaatcaggaagggactggcctggagccaaggggaaagggatgattgctcctgctgtcaccacttaaagagaaggaagagaacacgttataggacattttctcagcactgacccaacc

SEQ ID NO: 23188 - DNA, 425 bp, Homo sapiens
gtgaaaaataccacgacaaaaccaccctagttctccaaaatacttatcattcaggttgaataaaccagttctacagactgcttcttccatgcatttcccaatgatgctaactgcccttaaaattctttcagatttggaactgtatctgtatggaaacaacagagttttcttgaagtacaactaaggacaggtcaccactaggcactaacatcgctgacttgcatgattatggagatggtctatctgatgctgaaaatgtctctagttttttgacaacggctaaataaccatgggatcaagtggccttgggaaagcagcaacattagatgaactgctgtgcacttgcattgagatgtttgatgacaatggagagctggataatagttatttgccaagaatagttctactgatgcaccgatggtatt

SEQ ID NO: 23189 - DNA, 199 bp, Homo sapiens
  misc_feature 29: b=c or g or t
tagtaattagaatgaataagatctaaacbcagcgcgatggctcacacctgtaatcccagcactgtgggagggccagggtgggccagtcacttgaggctaggaggtcaagaccagcctggccaacatggcaaaactccatctctactaaaaatacaaaaattagcagctcatggtcccgcatgcctgtaattccagcaat

SEQ ID NO: 23190 - DNA, 417 bp, Homo sapiens
  misc_feature 394: r=a or g
acacactgtagggccaggcctcctgcaggtgggttggagccaaggggggagagaacctgtgctgacttgatttatccctcagcacccctcccctcagaaacccagacatgtgtacctggcttactcatgggaaggcctgcggtgcaccaactgctaactggcatgtgcgcaggcccaagtgcatgcacaccctcacacgtgtgcacacatgaacacatatatgtgtacaggtgcagcctttaacagcatacacccatgtgcatggcacatgtgcacatctgtaaatgcacacacatgcacacagtacatacacccacatacacgtgcacatcacctatgtgcacacagtgcatgcctatagacgtgcacacgcatatatgcttgtgtacatgtrtatatgttatacacatggacaca

SEQ ID NO: 23191 - DNA, 356 bp, Homo sapiens
  misc_feature 10: r=a or g
  misc_feature 142: r=a or g
tcaaaagacrtaggaatgggctaggtacagtagctcatgcctgtaatcccagcactttgagaggccaaggtgggtggattgcttgagcccgggagttcgggaccagcctgggtagcacagtgagactttgtctctacaaatrattaagaaaccagctgggcgtggtggcatgcacctgtggtcccagctgctctggatgctgaggcgggaggatcgcctgagcccgggaggtagaggctacagtgagccatgatcacgtcactgtgttccaccctgggtaaaggagtgagaccttgtctcaaataaataaataaataaataaataaataagaagaagaagtataaataggaatgat

SEQ ID NO: 23192 - DNA, 230 bp, Homo sapiens
  misc_feature 20: k=g or t
cacttatgctcatttgggckaccacatttgtaagatctagcattgcttgctctctgtctgctcttttttccccaaggaatacctttctgtaactctcatctctccaaagtcctggaaatctacctcgatgaaggatgaagagaaagaagacgggaatcacatcaggcatttagaacatagcccataattaaccactcattttgcccttctggcatgctgcacacacccaa

SEQ ID NO: 23193 - DNA, 310 bp, Homo sapiens
atctttcctacctctgcaaatgtgttgaaacctcagcctgtcagcttctcggctgcttgttgtagacacttcttgtggttccaactgctgtgttcatctctctgggtttctgtcttctccttgaaattggccttgtaattaattcttctctgctgtggtagctctctgatgctttcaaaaatatgtttttaacctttcatcaaggttttctagttgatctctccagaaagctcaatctaaacaacctagtcagtcattaacaggaataaaaacctgatttatactttaataaaatctctaactgcaagct

SEQ ID NO: 23194 - DNA, 430 bp, Homo sapiens
cctcataaacgtatcctgaagatactgattttgttaaatccatttcccacttcctttttagtgactcctaataatcctcaatattaagttaaatcaatagtaacacaggtatggaaaatcagcatttaaaaactcatgtaatcattcatcctatcaatcaataaatattaattacatttcaggcagtgtgcttagatgctggggttttagccataagcaaggcagacatggttattgccctacagcttataaaatctagctacagcaacatttaaaaaccaccatcattatcatcatcatcatcatccttatcatcatcatcccagctaacacgtattgagaacttcctccgtaccagccactattctagcattttacacacattaattcattccatcatcatagcaagttgtaaataggtaataatatt

SEQ ID NO: 23195 - DNA, 488 bp, Homo sapiens
  misc_feature 7: y=c or t
  misc_feature 9: y=c or t
  misc_feature 195: s=g or c
  misc_feature 197: r=a or g
  misc_feature 198: r=a or g
  misc_feature 268: k=g or t
  misc_feature 303: k=g or t
  misc_feature 355: r=a or g
  misc_feature 413: w=a or t
  misc_feature 414: r=a or g
  misc_feature 423: k=g or t
  misc_feature 440: r=a or g
  misc_feature 456: k=g or t
atcctcytycttggcctccaaaagtgctgcaattacaggtgtgagtcactgtgcccgaccagcctataaaattttagtggatgccaagagagatacttctacttcttttctgacttgggtgtcatttctttctttttgttacttgattgctgtggcaaggatttgtaatactgtgttgaaaagaagtggcgaaasarrcatccttgcttttgtaactgatactagaggaaatccttttagtgtttaacctttgagaataatgtttgtkttgagtttttcatttatagcttttactatggtgaktgtgatttcatctattcctaatttgatgaatgttgaattttttattccttartctttgtcttgctttggtaaagagggtaatgctggccccataaaatgtgttggggagwrtttcctccktgaatttcttagaaaartttgaaaacacttgtkatttgttatataagtattatttgatggaaatt

SEQ ID NO: 23196 - DNA, 98 bp, Homo sapiens
tcaagagtacgagattggggctgggcgtgatgactcgcacctgtaatcccagcactttgggaggccagggttgggggatttcttgagcccaggagttt

SEQ ID NO: 23197 - DNA, 98 bp, Homo sapiens
aatacaatgcagatgctacataaatggtcgtgatactggattctttagggaataatgacaagaacaaactctgcacatgttcaatagaaacataaccg

SEQ ID NO: 23198 - DNA, 267 bp, Homo sapiens
cgttcataattatagtaagcaaaggcaaggcgtatgttatctcattaatacttcacagtaactcagtagccactcttattatcccttgatttgtagaggagaaaaccaaaaaaggcatggaaaaggtactagcttaaggtcataaagtttcaaatgcaggactgagtgagtaataattgaatccttgaagtcatccacagtaataccctccttttcagtatacctatctccagatggggctaaaagcagtttaaactatctgaggga

SEQ ID NO: 23199 - DNA, 463 bp, Homo sapiens
agtccgcccgagctgtggttgtgggcgccggacaagtccaaggcgcctcctcccaatatggacagccgctacaacagcactgcgggcatcggggacttgaaccagctgagcgctgccatcccggccacgcgggtggaggtgtccgtgtcctgcagctcctggtggttgctgctagcatgctttggcttgtgactgcatcactctaatcttcaaggccaaaatctacaactctctctgtgctgtcactgtcttgtctcttctaaatcttcttgacagagacacattttctaaatctgatccaatttgtgtcttatatgtacaaggagttggaaataaagaatggagagagtttggaagaactgaagtaattgataatactttaaatcctgattttgtaagaaagtttattctggactacttttttgaagaaagagagaatcttcgttttgacttgtatgatgtt

SEQ ID NO: 23200 - DNA, 162 bp, Homo sapiens
gacaaaacaatagacaaactcaaaatgggagacattggacaagataactggccaaactcttccgaagtgtcaaagtcatgatgtcaaagagagaggggagacctgattcctgctccaggacacctcagagacaggacaactaaatgaaaataacaggccgac

SEQ ID NO: 23201 - DNA, 414 bp, Homo sapiens
  misc_feature 380: r=a or g
  misc_feature 381: r=a or g
ttattgttaatttcaattaatacttcggataatgccacacattcttgtgagcaagggtaaccttgctaggttcttccagttttctttattttggaaaagataagttgttgacttttaaatgctatatatatatttttttaatttccaaagtgctttatttgcatatgtgaatttattacattttcactagatattaacgatctctgaaagtgcatacagacagccctcactttgcacagtagtggattgttaaagtggcagtgcaaattaaaactgtgtaaacaaatcatttgaaaacttacaattgttctgtgacatttaaaattcgtatcaaagcattaaaacatttattcctcttagaaatgtgtagaaagataaarracaaatatgtatttaatactctaaaacattaga

SEQ ID NO: 23202 - DNA, 185 bp, Homo sapiens
atcagatgcaagcttccaggtattgaatggagtcatacagggatgtacttaattcttttacagtgatgcgtgataacatgtgcaaaggattcccaaccaaggaagctctttcaatctttggtgtctagcacggcatgcagtgcccatatgactgaactcagctactcagaccccagacccccaga

SEQ ID NO: 23203 - DNA, 462 bp, Homo sapiens
  misc_feature 96: k=g or t
  misc_feature 327: r=a or g
  misc_feature 328: w=a or t
  misc_feature 375: r=a or g
  misc_feature 453: v=a or c or g
actttttctattaggattcagatagctttttaattgctgctaatatatttgtcattcatattgcttttttgttttcaaaattcagttaatattttktcttctcattcattttgactttgtaggttcatgccatttgtaaaaccctctttgttgtctttttattggaattttgagagggagttaaatgtctgtttttaatctaccatctttaaaccaaaattccagctatttaatttcagcatgaagaattgcattaaaaacagagcagtgaatcattttatgaataataatgctggattttatttttaaaaattatcctagcctaarwtgtttaggatcatcatagcattaagagagatttatatttggtaagaratcaaaaacatcgtcagttttcatgcttaaagtatttaggatcataatagcattaagaaagatttatatttggtaaavatcaaaaac

SEQ ID NO: 23204 - DNA, 138 bp, Homo sapiens
ttttccctcctccctcttgttttagctgttacacacacagtaatacctgaatatccaacggtatagatcacaagggggggatgttaaatgttaatctaaaatatagctaaaaaaagattttgacataaaagagccgca

SEQ ID NO: 23205 - DNA, 256 bp, Homo sapiens
ctttccctgagagaagggcagattattgggaagcttagaccccttgttcatctttttgccccatgactgtctatgtaaatggcccttggatgctttcagtgttttggagtggtttatgattaactggtcctatctcccctgtcgaacctttaggtaatttaggcgcatttggagtacctggtctctagctgcctggactgcccattgtctgttggcaagcctcttggagtgttgttttcactgctagacacgcccc

SEQ ID NO: 23206 - DNA, 191 bp, Homo sapiens
catatttttattgtggcaaaatatacttaaaattgatcattttagccgtttaaaagtgtacaattcagtggtatcaaatacattcacagtgttatgcagccatcaccactattcattttcagaacttcttcatcatcccaaacagaaagtctatacccattaaataactccttattttctgtcccccaaga

SEQ ID NO: 23207 - DNA, 137 bp, Homo sapiens
ttagaaggcatgctttaatgttcttgggcaaacatgctgtgtatgtgctcaggacattacttacaagaaaatcactttttaaaaagaaccttttctttttacggaatattgaagaaaaattgaattggcagcaaggt

SEQ ID NO: 23208 - DNA, 242 bp, Homo sapiens
ccaagaactctttagtcagcaggtgatgagtcctgccaggactggatccttctcttcaaggcagccggttcccttttggcccagagtgtgtctagaaatatcattggggagctagggcctggaatgggggcctcatggctctgcctggtgctctattctagtgtggctgagctagtatccaagatgcaagacaatgtcggggctgggcatggtggcttacgcctgtaatctcagcaccgtca

SEQ ID NO: 23209 - DNA, 361 bp, Homo sapiens
  misc_feature 7: h=a or c or t
  misc_feature 260: v=a or c or g
  misc_feature 264: v=a or c or g
  misc_feature 309: r=a or g
aatttahagtgcatcagatttgttgcaaattttgtctgtagatagtctagcttcagctgtttatggtgatgctacattttcgtttataaatatgtttgtggtataaaaaaatggagtataaccataggttttgaacaaatttccttacatttttcatacaaaaatcataaatatctgtatgctattgaaatttaactttgtatgatgcttaaaaaccactatttggggaaataataaaataagtctttaccatgtatgavagavattttaaaaaatacaaaatattttctgattagcatctagcttatrataaattttcaaaaaagctgaaggcaaaaatgccttcatcaggatgcactga

SEQ ID NO: 23210 - DNA, 203 bp, Homo sapiens
tatttgatgtgtgttgtctattatacatacctaacaattttacatagcagatattactcttattttaaataggggaatcctgaggctcagtgagcttataaaatgtgccctacgtcacctacctagagagcaatgaaattggaatttgtgcccaattctgtctctgacactgaagtttcctcacgttgcttctgttaacccac

SEQ ID NO: 23211 - DNA, 206 bp, Homo sapiens
tgttcttgtcactctcaagccgtattaaagaattgagctgcctgaatgcatatgttgtcatctctaaccctttatacaaactggatcttctgacttagacacatttaaagtggttctttatcctcattttaactggctcccacttgttctgcaagatctagcttcaatatctcctctataagaacttgcctatagtcactagccca

SEQ ID NO: 23212 - DNA, 491 bp, Homo sapiens
  misc_feature 176: n=a, g, c or t
tgtaaaattagaacagttattgtcagagcacaagtcagggcttcctagtggcaaataatcatgtaactgcactgcttagccagacaaatagtttaatgaagaatttatgcttaccatttcaaatattatctagaatattgcttgctaatcattagatgaaggcacaccctggaggnatatgaagtgtctgatgtctccactgtgtcgtattgctgttaataggatagcatatgcacatcgtgaagaaagaacagacatggcttcgaaaaaacaaattgatccatataatatagtacttttacaacctacatgtatatatggctatatgcatttctctttagaaatgctgggttctacattttaagctacagagatgctgtgcaaagaaaatgagagtgatttgtgtgaagcctaaacaaaggaaatttcagaaacatttctagtcctaattattatatcatgcatatttgtgaacttacctggagttcaga

SEQ ID NO: 23213 - DNA, 339 bp, Homo sapiens
attttctcctggtgccgccatgtaagaagtgccttttgcctcccgccatgattcggaggcctccccagccatgtggaactatattttctaaaagtaaagactttaaagaaaggcacaggaggctgggagcagtggcttacatttgtaatcccagcactttgcggggctgaggccggaggactgcttgagtccaggagtttgagaccagcctgggcaacacagtgagaccccatctctacaaaaaattaaaaattagttacacggtggcttgactgtgcatgactggagacagtgcgaggtcgccgagtccataagcagcaagaagggcacacagaagaa

SEQ ID NO: 23214 - DNA, 107 bp, Homo sapiens
aaaatgcagcttgactgtgattcatggcacaaagctggaataaccctgccagttcttagaagctttaagattcatcgtcttgaacttgatacacatagtatagcacc

SEQ ID NO: 23215 - DNA, 254 bp, Homo sapiens
gtcgtttgactcctgtctctcctgtgcagcatcaaggtgccactgtaaataacaccaacaaacaggagggttttgcagtccctgcccctcttgataataaaggaactaattcatctgccagcagcaacttcagatgccggagtgtgagccctgctgttcatcgccaacgtaatcttagtggaagcaccctctatccagtatctaatatcccacgatctaatgtgaccccctttggaagtccagttaccccagtg

SEQ ID NO: 23216 - DNA, 242 bp, Homo sapiens
gttactagcggacgcctgtaggtttgctacatgggatcattactgatcacggtgactctgaagtctggaactgaaggcggaatgagaagttgggaaaacttttttctctaaactctctgttttttaaaaaactattattctcgatgcttgttaagaggaaaaaaaaacctttggtgcttctgttgtgaatgtgaaacattattttccagctgtacagtgacacattttttttaaggagaaaa

SEQ ID NO: 23217 - DNA, 191 bp, Homo sapiens
cctttcggtaggtacccggtagtgggattgctgagtcaactgttttatgttttccatagaagttgtgcaaatttacattccaacaagcaatgtataattgttcccttttctgtgcatcctcatcaatatctgttgttgattgacttttgaatgatagccattctgactggtgtaagatggtgtctcgctgc

SEQ ID NO: 23218 - DNA, 329 bp, Homo sapiens
tttgtcctttttaccaattctccaatgctgccattttaattcaggccatcaacctacctaaattatagcaacagcctccttattagtctccctgttttttatttttattcctttctacactacaaccaaattgctccaaaagacttactgatcatgtcactgcattgctttcaccattgctcttagggtacaatacaaatttatcttcatctttaaggtctcagtatgccacttcatctaggaaaccttcattgatgccctctagattaggtgcccttactatccattccctatacaccctgttctttcccagacatacacttggcact

SEQ ID NO: 23219 - DNA, 124 bp, Homo sapiens
taatgaagaggaagttgtatattccaataaacagtcactactaggaaaactcaaatctttggcaaccaaggtgagagtagaattttaacctggtgttactgggtgtttataaagtagagggcac

SEQ ID NO: 23220 - DNA, 371 bp, Homo sapiens
tatatataaatccttatttgccgttgatattattgtggctcatttttgtatcttaacatttttagtggcaaaacacccttctttttttcattttgatgtgttccctattgatttaatccatactgttcatgaacatttagttcagttttgggcaaaaggaagcatgcctgacacactggctattgcaggatctggccagcagcccgcaatgcaacggggctctctgttcccaggcggattggcaggttgagaaataatagacacacacaagatagtgaaagctgggtccaggggtgtcaccgccttctggtcccacggtgccaacaatgcactggatataccagcatttattattaagtttagcggggcgg

SEQ ID NO: 23221 - DNA, 90 bp, Homo sapiens
gggccgcggctgcaaacctcagctcacccttctgacctggtctcccagttccacgcagactcgagatcccccacccctcaccccagtcaa

SEQ ID NO: 23222 - DNA, 262 bp, Homo sapiens
  misc_feature 2: h=a or c or t
  misc_feature 47: s=g or c
ahatgtgtgtgtgcggtgttatgccggacaagagggaggtgaccgtsgcggcggcggcggcggctctgtttattgtccctctcggtgtgtgtgtgtgaggaaatcggggctgcagcgaggctaaggctgcctttgaagcagcggcggcgaccgggacgactactctggcgactcgagtggctggccttcgcggagtgtgagaaggacaaggcacctctgcgtcctcgccacgtccgagcgcctcgggctccccgaccgcccc

SEQ ID NO: 23223 - DNA, 136 bp, Homo sapiens
ggtttccgcgcggaaatgcggccatgccggctagtgcctaaccctcctcactgtgctgagaccgagccccggaatgatctaccgagaccaccaggccaaagaacgccactcccaagagagaagagacaaaggacaa

SEQ ID NO: 23224 - DNA, 184 bp, Homo sapiens
tttaaaaggctaaaacagaaatctctcaaccatctaattcaaatataaataagagcaaaactgtggttaaatattatgaaatagaatagaatgacagcctaacaaatcaattcatgtcaacatatgaatatacacattttgtgtttcaaagttcaaacacccaaggaatatgtctcagacctgg

SEQ ID NO: 23225 - DNA, 449 bp, Homo sapiens
  misc_feature 214: r=a or g
  misc_feature 215: s=g or c
cagcaaaggcaggctatgctgtagcacaagccactagcccgcctcttaaaacctctcatttcctttccattgtagaaaactgtcctcaaggaaataacttctcagtgttccatctgctattctactactcctcaaggattattcaggccccctcccttccctacacatcaagcttaaggatttgcccccacccaggactggcaaattagctttrstcaacatgccctgagtcacaaaaactaaaatacctcttagtctaagtagacactttcactagataggtagaggcctttcctacagggtctgagaaggccaccacagacatttcttcccttctgtcagacataattcctcagtttagccttcccacctctatacagtctgataacagaccagcctttattagtcaaatcagccaagcagtttttcagactcttagtattcagtga

SEQ ID NO: 23226 - DNA, 288 bp, Homo sapiens
aatctttaattcattctggacaatgagaaaacttttatttttacttttagttaacaatactcaggaaaataaaaagtgtgctttttaatcttagtaacccaatttgagtttgaaacaaatttacataattttagctgcttaatatgctgctgaagataaatgcagtaaatatcccaaggtcaagatttgaaatccaaatgtccatagtaatgattaacaggaaaagagagtcctctgttaactttatttctcaattttttacaggtttggataattaagggagcaaca

SEQ ID NO: 23227 - DNA, 250 bp, Homo sapiens
  misc_feature 118: m=a or c
  misc_feature 134: s=g or c
  misc_feature 154: r=a or g
  misc_feature 174: m=a or c
  misc_feature 203: m=a or c
  misc_feature 231: m=a or c
  misc_feature 238: m=a or c
  misc_feature 241: m=a or c
  misc_feature 243: y=c or t
  misc_feature 246: y=c or t
  misc_feature 250: s=g or c
attaccattcggacttttggcccccttctccgtgtacaaattggtaaaaagcctcaggatttttgagctgtccttatccctccccttgtttcttttcttttctttttttttttgagamagggtctcactctgtsgcccaggctggagtgcagtratgtggtcttggctcactgmaacctccgttcaaacgattctcctgcctmaacctcctaagtagctgggagtacaggmaggcacmacmaytgytggs

SEQ ID NO: 23228 - DNA, 168 bp, Homo sapiens
  misc_feature 12: m=a or c
agaggaaggaamagtttgagcggtgaggagagcaggtcaaagtagtgagcacatccctatggagaagagatgactgagcccgatgaagcaataggccctgggtggttgagagaaatatgggccacagacaggcaggtaccttcccttggccaaggaagcaaggagaag

SEQ ID NO: 23229 - DNA, 111 bp, Homo sapiens
atgtgcaaagccaaggggactgggaggaggagtcgcttcagagccctgctactgatgatttgtggctttcctgcctccaagcttgcttgccttttgttttagcagctgcca

SEQ ID NO: 23230 - DNA, 417 bp, Homo sapiens
caagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatatagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatga

SEQ ID NO: 23231 - DNA, 372 bp, Homo sapiens
  misc_feature 152: k=g or t
  misc_feature 239: s=g or c
  misc_feature 261: y=c or t
  misc_feature 267: y=c or t
  misc_feature 275: m=a or c
  misc_feature 298: m=a or c
  misc_feature 301: m=a or c
  misc_feature 320: w=a or t
  misc_feature 325: w=a or t
atttctgtggccccgccatcttcaacaagcggtttccagggtctttgcagaaggagaaagaacaagaaggaccaccgtgggagatctgtgtgtgatcccaggaaaacaaacttcatcaagaaaacaagtttctgcttttcttttcttttctkttcttttcctttttttttgacagagtctctgtagcccaggctggagtgcagtggtgcgatatcggctcactacaacctccatctccsgggctcaagcaattcttgtgcytcagcytcccgagmagctgggattacaggcatgcacmacmaaacccagctaatttttgwatttwaactaaagatgggttttcgccatgttagccaggctggtctcgaactc

SEQ ID NO: 23232 - DNA, 279 bp, Homo sapiens
  misc_feature 12: s=g or c
gggaggcctttsgcccgaggcgggctgcgggctgctggggtctggtgcggagggccaacttctgggaataacctggctgtgggcttaaaaatcgtagtcattcattatcacgggctttctctctctcgaatacctttaacatttatcgccttgttagtctccacatccacctccgtgaaagagatggagtctcgctatatttcccagtctggcctcaaactcctgatcttaagggatccccagctcaacctctcccagcagctgggactaccgggctcg

SEQ ID NO: 23233 - DNA, 228 bp, Homo sapiens
aagaagtccgggagatgaatggctgtctaggaaggaggatgtcagtgcacggttagtgtttgagcagagggcagacttgtaaagtacctgtagtgaaaagaatgtggggacccgatttagcagaaaggtgtttgcacatactttatacaaaatacagaatactttatattggaagtgaaagaaatgaacgtggacttttacacatgtgcatatttttctggaggcttc

SEQ ID NO: 23234 - DNA, 268 bp, Homo sapiens
  misc_feature 221: v=a or c or g
cattgctgacagatgccaacatttctccacactattttataataaaaaaaaaatacctctctgctaagaacagcagaggcttgattatatttattggtgttagatgactagggactaaaatagatgattcctcagtgtaaaagtaggcagataattctattacctaattttctctttcaacagtcaggaaactttcagtgaatttggtccctgtagggtavctcccaatttccttctccccctacgataaaacaaacagaatatgagt

SEQ ID NO: 23235 - DNA, 153 bp, Homo sapiens
aaaagaaagaaaaagaaagagagagagggagagagggagggaaggaaggaagaaaggaaggaaggaaagaaagaggaaagaaaagcagttatcagcttatggcttgtttataaaaagactgtaattttaaaatcattctatctttggaagacg

SEQ ID NO: 23236 - DNA, 171 bp, Homo sapiens
atatcgtaaagataaagagttcatggtggggtcagagcaaaggttattacacaaaattataggtgttttatttcttcctttcgttagaaccaaaaaaaattcatgtttaactctgtgatacatccatttattcattgtgtccacaagaaaaaataaatgtaatagcagcgt

SEQ ID NO: 23237 - DNA, 92 bp, Homo sapiens
aatctctgggacgccacagaaatcgtaactgaacacccgcacacaaaagtaatctgtgaggtgtgttttaaagaaagaaacagctgagaaac

SEQ ID NO: 23238 - DNA, 302 bp, Homo sapiens
ttggccagcccagaaaggggctcccacagtgcagcggtgggctgaagggctcctcaagtgccgccgaagtaggagcccaggcagaggaggcgcggagagcaagcgagggctgtgaggactgccagcacgctgtcacctctcggttttactttattttaggataaaatatctattgtgaattttaaaaacatgtaaaataaaattttaattaaaaagcctaaatgttcttttcctacttatcctgaaggaaattcctgttgatggcgcatttaggaacttatttatcccctgaagacctgtta

SEQ ID NO: 23239 - DNA, 169 bp, Homo sapiens
ttctaaaatatttcaatcataagcaagagaaagtagtcagcctcgtcatatgtagaatatgtcgctgtcttaagaataacaactgttaacaacctaaaggttcctggatatggggtgatcactttataatttatgaggagttctctttttaataaaatatggtcccatc

SEQ ID NO: 23240 - DNA, 85 bp, Homo sapiens
tatacactggctttgaactttattcctcctcttgttacctcctcaatgctggtgggagctatttgttgaatattctacactagca

SEQ ID NO: 23241 - DNA, 299 bp, Homo sapiens
ataagtaatctcctgtcctttggcagaagctcctttagattgggatagattccaaataaagaatctagaaataggagaagatttaattatgaggccttgaacacggattatccccaaacccttgtcatttcccccagtgagctctgatttctagactgctttgaaaatgctgtattcattttgctaacttagtatttgggtaccctgctctttggctgttctttttttggagcccttctcagtcaagtctgccggatgtctttctttacctacccctcagttttccttaaaacgcgctc

SEQ ID NO: 23242 - DNA, 220 bp, Homo sapiens
  misc_feature 192: h=a or c or t
  misc_feature 220: s=g or c
ttctttgaagaattgtgtttcctgagtaggttgagtattttatagacaacacattaatagtcaaatacttatgaactgtcaacaccgtattgtatatttccctacataccaatttggataattggagttaatgagaccaaacgatcaaaactagtgtgatgtgttcagatagtacatgatgtaggaagatchgctataaaactatcacttcaaagtggts

SEQ ID NO: 23243 - DNA, 307 bp, Homo sapiens
tacatgatgagttatttggtgcactgatgccataatgtcttctatatgtaatatcttacatgtttgcatgagtgtcagggctttgtccagttatcttcatatgactgttctctgagaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagca

SEQ ID NO: 23244 - DNA, 116 bp, Homo sapiens
aaacaagaggaacgagggagcctgagctaagctctgaggacttgcccaagccactgctgttggagcttcccaggaaaaaaaaaaaaaaaaaaaaaaaaaaaaaaaaaaaaaaaaaa

SEQ ID NO: 23245 - DNA, 158 bp, Homo sapiens
  misc_feature 61: s=g or c
tgtgtgtccccctgtaaatagccagctgttatttatacatatataatattatatatatttsgtctgtttgtagttttattactagatgatttttccggttgtccttaacaccccttcctgaggttcccttcacccctctctcttgccttccttcccca

SEQ ID NO: 23246 - DNA, 201 bp, Homo sapiens
taaaaggagagaatttcagccaatttccaaggtgtattccaactttaacattttataatccctctaactccacccagaggcatattttatgaggtccctgaagctcaataaaaattactgaaaatctgtgaggagaatgtgtttggggaggaagtttatcctaacaaagaaatgcattgcttatgtactagaaggcccgtc

SEQ ID NO: 23247 - DNA, 191 bp, Homo sapiens
gtctttgcagcagccttgggacggacgtaacggcaaccccgttttccaggttttccagatataattctgtattacttgaatcatggaaacatttagtagattaaaaaacattttaaaggaagaatgagaataatcagccttttaccagcaaagacaatggtgggagacctgctagcctatcttctgggaag

SEQ ID NO: 23248 - DNA, 99 bp, Homo sapiens
cagaaacagtagaggggtggcataaagaaagaaagctcacctcttcttccctgtaaagttcaaaataaattattattttgtgatttgtccacccgtgac

SEQ ID NO: 23249 - DNA, 203 bp, Homo sapiens
tatcttggtgtaggatgtgatgtagctatccacatttttgtttccttccttccttccttctttctttttctttctttccttctttctttcttttgagatggagtctcgctctgttgcccaggctggagtacagtggcgtgatctcagctcaccacaacctccacctcccaggttcaagcaattctcctgcctcagcctcccaa

SEQ ID NO: 23250 - DNA, 133 bp, Homo sapiens
ttttttgcatttttagtagagatggggtttcaccgtgttagccaggatggtctcgatctcctgacctcgtgatctgcctgcctctgcctcccaaagtgctaggattacaggtgtgagccaccgagcccggcca

SEQ ID NO: 23251 - DNA, 410 bp, Homo sapiens
  misc_feature 7: b=c or g or t
  misc_feature 8: y=c or t
  misc_feature 216: w=a or t
  misc_feature 217: w=a or t
cactgcbyatttcatagagtactgtgtaatgagcctgggggcaagtagacgactttgacgcccttggtgttaactcgtggggctctgagtgcctgcagcattgaagaactttaaaaaggtgtaccttactagcaaggtacatcctgacttcaaggacaaggcatcaatggaattaatccagaaaaagcgttcttgtccagacgttgtacaaccaawwgatcagcagctgtgtttatcttttcccgttaagtctcaggtgttagcagttttataggtaagagctcgcctgatcataaacacagctgcacctgcacaaaacaggacagttagcttagccctgcgtgccttcaatcctggggctcacttcccttctttacttaatagatgtcctttgtggttccctcccatgc

SEQ ID NO: 23252 - DNA, 440 bp, Homo sapiens
  misc_feature 7: n=a, g, c or t
  misc_feature 8: n=a, g, c or t
  misc_feature 315: k=g or t
  misc_feature 413: r=a or g
  misc_feature 421: m=a or c
tgtcatnnttgcaattaatgcccaaacaggttaaatgtggaagaaagtatggaggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatgtatatgcttgagaaagtggtttttcaagatgtatgtgtacagtacacacatggacacgcttcagtcctctgacttcccatgtgctacgctcatgtgtktctcttctcatgaggatttgcaatggatagttgtacaacctggggactgtcagtgactcattggtatcagcatatgctaaagaagctcttgaactccratcttgamacctgatctcccttcgtca

SEQ ID NO: 23253 - DNA, 174 bp, Homo sapiens
gctagactcatgtatcatttagcaacaacaaaaacttatttcatgtgatagactgactgtttacttctagctattgttggctatgtcagagataccagataccttagccaagaatggttatcaagactggagaaactgaatatgtgtgtgagtaatcttttgagaacaggctag

SEQ ID NO: 23254 - DNA, 56 bp, Homo sapiens
atgggttaaattcctcattttacttttaaactggtggtaaagtggaaattgcaaaa

SEQ ID NO: 23255 - DNA, 405 bp, Homo sapiens
  misc_feature 280: w=a or t
  misc_feature 354: v=a or c or g
catactttattcacatttctttagtttcttacctaatgccctttttctgttcgaggatcctatccaagatatcgcattacattaaatcattatgtctccttagcctcctcttggctgtgacagtttcctagattttacttgcttttgatgaccttggcagttttgggagtactaatcaggtgttttgtagaatgccttactcagttgagatttgttttcccataattagactgaggttatgggctttggggaggaatatcacagagataaagtgccatawtttttcacatcatatcaaagatacacaccattaatctgtcttaccactgttggtagtgaccttgatcacttggvaaatagttgcatttttgaactcaattaagttgtagatttcatgctcttaac

SEQ ID NO: 23256 - DNA, 213 bp, Homo sapiens
tattgtgtggaagtctgagtctctttgtaggtctcttagaacttgctttatgaatcttggtgctcctgtgttgagtgcatatatatatttaggatagttagctctccttgttgtgttgatccctttaccattacgtaatggccttctttctcttttttgatctttgttggtttaaagtctgttttatcagagactagcattgccaccccggat

SEQ ID NO: 23257 - DNA, 438 bp, Homo sapiens
ttgtcaatgataagatgatgtaacagagtaagtcttaacgaggagggtaagatcagcgatcaggttggtgggctccaccttgcagggaggtcaggaggaggtatgggatgagtgctgggtgacacaggcaagggtcaaattctaagggaagaaattgcgttaggcacagaaggcctaactgacgtgctcaggagcgtctgtggctgttccctctggattcattgtttccaggtctaaaaaaggaaggagcagcagaagcaactcaatgtttttttatatttgtttgtaccaacactatattttacaaatatttacgtttgtctttcataatagccttctattgctgactggaccaaagccaaactcagcctccctccctgacctttctgcatgatgtcaccctttctagcatctacccacggcactctcgtgttggct

SEQ ID NO: 23258 - DNA, 478 bp, Homo sapiens
  misc_feature 8: n=a, g, c or t
  misc_feature 9: s=g or c
  misc_feature 245: k=g or t
tcttttcnsatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaatttkagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatatcagcccaggaggctgttt

SEQ ID NO: 23259 - DNA, 349 bp, Homo sapiens
  misc_feature 169: n=a, g, c or t
  misc_feature 170: w=a or t
  misc_feature 171: y=c or t
  misc_feature 226: n=a, g, c or t
  misc_feature 309: w=a or t
  misc_feature 317: h=a or c or t
atggcctctgccccttcccaagcagaggcaacatggcggccttagcaagctatagctgcgagatttgaattactccactcgtagctattgcattcctgacgatggcctctgtggcttcgtgcgattcgcgtccgagctcagacgagctccctggagacaccaactgtgnwycatgtcaggttcagtgaaaatgagattatcattgaagatgactacaaagaaaganaaaagtatgaacccaaactcaagcagtttaccaaaattttaagaaggaaaagacttttacccaagcgctgcaataaaaaaaawagcaatghcaatggaccagtatcattctaaagcatcagtc

SEQ ID NO: 23260 - DNA, 274 bp, Homo sapiens
cctctgactccctggttcaaacgattctcctgcctcagcctcccgagtggctggcatcaccacgcccagctgatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtaccgctc

SEQ ID NO: 23261 - DNA, 147 bp, Homo sapiens
  misc_feature 98: s=g or c
agctgaggtgggaggatcgcttgagcccaggatatggaggctcgatgagctatgatctcaccactgcactccagcttgggggacaggggaagtctgtstccgcagctgggtgcagtggccttataatcctagcactttgggaggcca

SEQ ID NO: 23262 - DNA, 207 bp, Homo sapiens
ttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgc

SEQ ID NO: 23263 - DNA, 454 bp, Homo sapiens
  misc_feature 324: k=g or t
  misc_feature 401: n=a, g, c or t
  misc_feature 403: n=a, g, c or t
  misc_feature 404: b=c or g or t
cacattctcctgagtcccaccctcatttatgcaaacttcaccaagaaagggatgaatcaacattggcgacctctttggaaaaggatgtgaggcaaaactgctattcagtttgtgatatcatgagacttggaagatattccttctcatctcctctaaccagactttcgacagatattttctgagcaccttctctgcatgtctgcagtgctgtgtaaaatgccctacctttgcatggactattctttctaatcaagaggcgtgtgtggcgaacttggggcagcccctggaagtcttgttctttgaccattacgtctgcggctgcakcaccagataatgagcttcaccactcgtctgcctcctgtgtccttccgcggggagtaaatgtcacttcagcttgccgnanbtctaaataggcaaattttcagtgctcagaaaaggacctgatctttgcaca

SEQ ID NO: 23264 - DNA, 212 bp, Homo sapiens
tttaaagatagtttcctgcccccccccagagtttttatatttgaaaattaaatatacccaaattaaaatttcttttggggaactgctgtccaaataaagcaaggtctttcaatttggattttcctgttaatcctgtcattaaagttattagttcagatgacagggataatatacatatggaagaaatttgcttccccccacacacaccagct

SEQ ID NO: 23265 - DNA, 243 bp, Homo sapiens
tgggggcaattctgtttgcataatacatttttagtacactgcttttaaagcaagatcagagtatgctattttagatgattttaattttcatacttttgttctaaaataagttgtaaactaattctatttaattataaaatgaattattaaatctgagagtaatgtgacataagcacttctctctgacacacccctgtagaaaggaattagttaatttccacattcatatcagcttgggcagca

SEQ ID NO: 23266 - DNA, 418 bp, Homo sapiens
tctgttggtaattgatacatgggctaaagcatcagaggtttaatttgaagtttatgttcacacactgaaaacttagtttttttgttggtagatccatgtgcatgctagaatttgggacaggcactatttgcataaagtattaaagtcaatttttaaactaagcaaaggtacacgttgtaacggtggggcatctgtgaaaaagatgtccctttcataatatatgcaatatattccagatgttttgagagattacagaagaggaggcctgcttcacttgcagataagtttattataattctccagaaatgtgcaggatgtgcattagcaaattgcactgtacttttcactccagcctgggtgacagagcaagactcccgtctcgggggcttaaaaaaaaaaaaatgctgtatctaaatga

SEQ ID NO: 23267 - DNA, 112 bp, Homo sapiens
taaatagacactttgcaatatttaagaacctaatgctgtttaattttggtacagcttccacattgcatgttcactttagtatttgcaatttgatatatttcatggtggctag

SEQ ID NO: 23268 - DNA, 309 bp, Homo sapiens
  misc_feature 7: d=a or g or t
cccaatdttgtttttcacagaaaataaggtaaacattcaacttaaatcccccatgaagttttttcatgctcatactcataatcattatcacataatgtgcttattcaacaaactttgtatctggatatatttttaacaataagtttgttagcattatttatttatctttagagagaaaatatttgcatctgtttaataccctttgaagcattaatacttagtcactcacattgaaattgcatatggatgtatcaacataggctaaaattaaattatggatgtcgcagaaatgaaatacttcatcttaga

SEQ ID NO: 23269 - DNA, 286 bp, Homo sapiens
agacgggataggggtgtgtgtgtgaggggagggggcctgtatggcaactgctcttgccccagcgtccccaaaagtgcagaggcagcggctgcagcatccagccagcttggatgtctggcctgtgagcctggggaaactattattaataatatttactgttgataatattggggaaaacagcccttaactctgaggtttctgctgtgctcctgtccaaaacagacttccaggactctgaagaaacagttacaagcaggatgcttttcccaacctctgcgcaagatta

SEQ ID NO: 23270 - DNA, 323 bp, Homo sapiens
ttttgaaatattattccagatttgagcacactgcaacagatgtggtctgctagcaaagagtatcatgggaagattatatttcatgtggcctacgattattaaattttctaacaagtaaatctagcaacatgttagcttattttagctatgtgacaattgtaatcccataggttggtcaatttgcttgtaagatttaaaaataagctgctttcaaaataatatcaggccgttcatggtggcccacaactgcaatttcagtgctttggaggccaagataagaggatgacttgaggccaggtgttccatccagaccaggctcggcc

SEQ ID NO: 23271 - DNA, 136 bp, Homo sapiens
cggttctttattgaaatggtccttttaatgtcatctttaatttaatcaaatagtgtcatcaaaataacatttactctattactgaaaattcactgcattattaactagtgtaactagacaaaaaagatggtacaag

SEQ ID NO: 23272 - DNA, 410 bp, Homo sapiens
tgcaagtggtatgtgtgtaattatggctaaagacaaaccattattcagtgaattactaatgacagattttatgctttataatgcatgaaaacaattttaaaataactagcaattaatcacagcatatcaggaaaaagtacacagtgagttctgtttattttttgtaggctcattatgtttatgttctttaagatgtatataagaacctacttatcatgctgtatgtatcactcattccattttcatgttccatgcatactcgggcatcatgctaatatgtatccttttaagcactctcaaggaaacaaaagggccttttatttttataaaggtaaaaaaaattccccaaatattttgcactgaatgtaccaaaggtgaagggacattacaatatgactaacagcaactcc

SEQ ID NO: 23273 - DNA, 360 bp, Homo sapiens
  misc_feature 44: k=g or t
  misc_feature 295: r=a or g
attagggacatactcatctttgattgctctgtaataggtttgtkcttacacatagtaacaaggggatgacctaaatcaggagtctgagcttttaggtgttttaagggcttgatgaaaaaaatctggcgaagtctgtaaggcacacaaacctaaaacacttcatctctggtccgttagaggaaaaaattgccaactccccatctaaatctcattaactttattcccttcagaaagtcctagagtgagttgttttttcactcccaatattatgcagtctgatttagtcatgattgaratattgagaaatgcctgtgtgaaaaatgattttgcattatctggaaaaatttctgagtacatccc

SEQ ID NO: 23274 - DNA, 310 bp, Homo sapiens
gatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccaac

SEQ ID NO: 23275 - DNA, 235 bp, Homo sapiens
  misc_feature 164: k=g or t
  misc_feature 165: s=g or c
aaaaggcctgaagattgcccgtctccctgcagccgcgcagtgggtgcagccttttcacaaatgcaagacctggaccggcggcgaggccaaggggaccccgtgtggagggatgcgggactgagtccgtgaacatctttctcaccgggagactcagcagtgcggtksctgccttagcggcctgcagtgggaagctggagcagcacacggagcggcgtggggtcatctacagcccgga

SEQ ID NO: 23276 - DNA, 455 bp, Homo sapiens
tcaggctggtctcgaactcctgaactcaggtgatccgcccacctcggcttcccaaagtgctggcattacaagcatgagccactgcgcctggccgaagattgcctcttaaatagagaaaaaacatcaaatatcaatgagcttgaaaatgaaacaagacatgaatagagtttagaaatcaggtttaaatttattttcttcctatatcactacctattctatcaagattgtcacacacttggctatttgggctatgttggttttagcttggttctctgaagagacagtggcttacaaatgcagcctatgacctaaattggaaaggccgtctctaatagcaccctcctccttaacatcaaaaagcatttattaagcaagtaattaatcacttacagcctgggccacccgttgtgtaagaaaacaaagaccaggtctctacccttctccctttcataact

SEQ ID NO: 23277 - DNA, 288 bp, Homo sapiens
cttccccatcccctaccatggcaactagactcttatttttatgattgctttatgatattttctacagaacctgtcatttacttttaccaaatggaaaacagagatgatgtggtttttttctctcttacttggcagtccagcaataacttaactaagtgagcagtagcctttttaagagcaacctgcaagcaatcaaggccagtctaccctgcagcccttgccgccttcccataagcagcactctgcacagcatcatccatccatcacttctctcaacagaaactccca

SEQ ID NO: 23278 - DNA, 159 bp, Homo sapiens
  misc_feature 145: n=a, g, c or t
  misc_feature 146: w=a or t
  misc_feature 150: r=a or g
tcatgccactgctctgcttggctctactcatagaaccaaggcaatcttagcttcagagactgcaaaacagattaagtgatttgcttgcagattctcaatcaattttcaagggatagagttcaccttccagagccattcttttatnwcctrttacccgca

SEQ ID NO: 23279 - DNA, 210 bp, Homo sapiens
  misc_feature 146: w=a or t
  misc_feature 192: b=c or g or t
cggtgatggaaatgttctggaattggatagtagtggtggtttcacaacctcacaaatatacgtgaaaccactagattgtacattttaaaatggtgactttatggcatggaattttatctcaatttttaaaaacctaagaaattatwactaatataaagaagaaaatgacaattgcctgtcatcccacctccbagaggtaaacaaacattc

SEQ ID NO: 23280 - DNA, 432 bp, Homo sapiens
  misc_feature 148: w=a or t
  misc_feature 149: w=a or t
atctgatgacctctgggatcttttcatttagccctaaacaaagaaacaaatatgacaaaaaccacaactaaaaaatgttaattcagtcacagagtaatcttctgaggccaaaagtccatctaaatgcaatgaagatttgctttcattwwgacagaggtgaggacaaaatccgcagtggaagttatgatatgctagaaagcaacaaatgtggatcactgaccaaaacgattatgtacttgatgcaaatgcagattgcatattgttatatatatagtactttgtgtttttgttttccctcattcagtcagttattttcagtggtgaatacatgttgttagaagatgtcttgtatggtcttaatctttgttgtgtactatttttttatagtcttaagttataatgaaaaaacaaaaagtaggaaccaaacataaa

SEQ ID NO: 23281 - DNA, 139 bp, Homo sapiens
atcaaagaaatcaccccgccacctcaccgggattctccataacttccctctgcagaactaattatgttgattttgttcaagttcaagatgttagctaaaagaactatggtggtgttttttttcccacttcccacaaaca

SEQ ID NO: 23282 - DNA, 290 bp, Homo sapiens
  misc_feature 36: n=a, g, c or t
cagctgttggatgaaattttctgtaactatctgatngatccatttggtctatagtgcagattaagtcccatgtttctttgttgattttcttcgaagaaagatctgttcatagctgaaagtgcagtgttgaaatctccagctattactttattggggcctatctctctctttacctctaataataatatttgctttatatatctagatgcttcattgttgggtgtatacatatgtttaaaactgttatatcttcttgctgaattgaccgctttatcattatagagtgagct

SEQ ID NO: 23283 - DNA, 91 bp, Homo sapiens
  misc_feature 2: w=a or t
  misc_feature 6: w=a or t
  misc_feature 20: w=a or t
  misc_feature 74: y=c or t
gwagawaaagggtgaccgcwctgcgcaggcgccctcggcgtctctctcgctctctcggtctttttttttttttyctttttttttttttttt

SEQ ID NO: 23284 - DNA, 186 bp, Homo sapiens
tttaaccctatggctgctctctttgttaaagcttctaaatgtgagacgactctttccgcaaaaagacatttacttggttgagtactccctaagtacctcgccttttgtaagaaacagatacactcatgttaaggatgaagtcaggtatgaagttaactgttcgggtatctatgaacaggagccgaa

SEQ ID NO: 23285 - DNA, 235 bp, Homo sapiens
tcccactgctcccacgatgcactgcttatagcagctgtcaaagatactgaggaatccacggtggaaaaaagacttttacaactggctggaagaaaggggtgtgagggaggagacatttctgtgcagagctgaccaaaggaaagagtaggcatcagtgcagtatgaatgcatacctcaccaagcaacacagctgcagccgggggtccgatgggatggatgccgtcagagtgcgccc

SEQ ID NO: 23286 - DNA, 106 bp, Homo sapiens
gatttatcttcagaagacaagcagatgaggagacaaaacctactgatgtgggtacccaagcaggaacccccctcttgcaccggcgactcacgtgggaagaagaatt

SEQ ID NO: 23287 - DNA, 353 bp, Homo sapiens
  misc_feature 11: r=a or g
  misc_feature 26: y=c or t
  misc_feature 175: w=a or t
  misc_feature 176: k=g or t
  misc_feature 242: k=g or t
aagttctgggrttacaggcatcagcyactgcacctggccttggtatatgtgttttaatttgtattcattcatttaagcctcatgacagctctgcgaggaaagttcactatacgtcttcaggctgcaggtagatgacctgaaagggacaggaggtaacagtctggccaagaccacwkagccagggaatagcagaggaacatttcacctgggcattgcactccagagctgggcttctcactgtkctcaacccctggcaaatgctcacttgaacaaagccaggtggtgatacaaaggtatttgttatattagtctctacacttttctgtgtgcttgaaataactgcaacaaagaat

SEQ ID NO: 23288 - DNA, 259 bp, Homo sapiens
aggaataattatttgtaatctggtttttatgtgtttttaccctcaatttacacatctttgaagttgccagactactcaggcattgctactaaatgtttgtcaactttacttgctttgtgggaccaaattgagaagatgagataacttcttaattgggttttgacaagcctatttgaaaaattaactcacaattataacaagtgaaagataaagacaagtatgttgaaaataagctgtaggataaattgtatcctgaatt

SEQ ID NO: 23289 - DNA, 333 bp, Homo sapiens
  misc_feature 33: m=a or c
  misc_feature 49: r=a or g
  misc_feature 55: r=a or g
  misc_feature 59: r=a or g
  misc_feature 60: m=a or c
  misc_feature 83: r=a or g
  misc_feature 189: w=a or t
  misc_feature 190: w=a or t
ctatccaccatacatttcagaagccaagggtamaggtgtccccgtgggrcaaaargggrmactgcagtgtgaagcctcagcartcccctcagcagaattccagtggtacaaggaatgacaaaagactgattgaaggaaagaaaggggtgaaagtggaaaacagacctttcctctcaaaactcatcttcwwcaatgtctctgaacatgactatggtaactacacttgcgtggcctccaacaagctgggccacaccaatgccagcatcatgctatttggtccaggcgccgtcagcgaggtgagcaacggcacgtcgaggagggcaggctgcgtct

SEQ ID NO: 23290 - DNA, 172 bp, Homo sapiens
  misc_feature 103: r=a or g
  misc_feature 104: s=g or c
caaaaaatacatagtctcaaaaaataaataaataaataacttaggagactttgccaccaatagataatagagaaaagggctttacttcatgcttcttgcgtcrsctcaagcacacaggacagacagaagctccccacgcacccttgtgacatagtcacccatctgccgcaac

SEQ ID NO: 23291 - DNA, 154 bp, Homo sapiens
  misc_feature 105: w=a or t
atacactaggatttttatttgtaaccatatattaaagatacttttttacagaaattagtatatgtttagtaaaagtattggctaatttttcttgcaacaattttwtcaataaaagccatgtagtagttcaaggaccttgagcactgcccccacg

SEQ ID NO: 23292 - DNA, 284 bp, Homo sapiens
aaggaagacaaaggacccctgccttggggaacttattatcagtgtggagacccagcaaacatgcagaaatgttcatttccctttttaagaaaggatttattgagattatataacatataattcacccatttaaaatgtacaattcaaaggcttttagtatattcataaaattggacaaccatcagcattatccattttcaaatctttttatcaccccaaaaagaaacctcacatcccttagctgtcacttacaaacactgtatatctcccagcccctggcctaa

SEQ ID NO: 23293 - DNA, 393 bp, Homo sapiens
aaaaagctgcccgaacaggctttcctctgaaaagcagtgccgttcctttttagaaagactgaatctaaatgttgtctctggagacaagaagccttcagtatgttaaattactttcattatgtattttcagatgcttattgattccacagtaggaagagtgagagactgcagcagcctctaagcagcactacatgttccatacattagcagtactgctgaaacaatggcacactacagacacatattttcattaaggtcattttcgaagagatgtttatgaccctcttcccccagtcctctactaacaagtgaacaaaatgaatcaatccaaactggaaatgcttcaactacatcaagaatttatcaaatctttagcagagggccaatagcagc

SEQ ID NO: 23294 - DNA, 190 bp, Homo sapiens
tatattacccaaaaaacattgttttgagatctatccatgttggatgttaagagttctagtttattcatttcagatgtggtgtgtgaacagactgcagcttatttattgattcccttattggacttctaaattgtttcccgttttcctctgtttcaaataatgctgtagtcaattgctttttttttttttt

SEQ ID NO: 23295 - DNA, 469 bp, Homo sapiens
ccctactgaattgacatggagaaatgttatcaagtccaatttgcaagaatgctggatttccacttggagcttttgttttcttgggcctagaaggcatctcttgtttataaaaaaacactgggcatcattgtacatgagaaacttaaagacagtgcatatctggtagcagttgatatacagtgtattattcctaaatgtagtaataacaccttacaattggaaaaaaatgagttatagatgaccaaatgcttccataaatatgatcacatttggtcctcccatctctgtgaagaattattattcctcttttacaggtgaagaaaatgacttgtcagaagtcatttatttccaaatataggacttctgataccaaattttgtgccttttctgtagtgccatgcttcctctccaaagcaatagttgaatttctgcaattttaagaaaatcatatatgtcgtgttatattaga

SEQ ID NO: 23296 - DNA, 216 bp, Homo sapiens
  misc_feature 168: s=g or c
  misc_feature 182: w=a or t
  misc_feature 187: s=g or c
  misc_feature 192: w=a or t
  misc_feature 202: w=a or t
  misc_feature 214: r=a or g
ctaaaagttagaaagaatgcgatttcaagcgggacgtggtggttcatgcctgtaatctcagcactttgggaggctgacgcaggaggatacttgagcccaggtgttcaagaccagcctgggcaacatagtgagactccacctctacaaaaaaaaaacccaataaattasctgggcatggtggwatgascctgwagtcccagcwactctggtggcrac

SEQ ID NO: 23297 - DNA, 127 bp, Homo sapiens
tagaacatatttaagtagtagtcttgctttaggtaaaacactttcttgaaaccagaggcatttcaaacaataaaacccggctctaatggggatgctctgtgtggatagaaagctactaaaaacaccc

SEQ ID NO: 23298 - DNA, 168 bp, Homo sapiens
aaaaaggaactcagagcagattaaatcaacttctggaaatatatctgtgagtcctccaaataaaccaaaaggacctattgtaaatgggatgtggggatttcttgaatgaaatccaaatgtgttctttgttaaataaatagaaggacaaaaattatactgacaccaaaa

SEQ ID NO: 23299 - DNA, 153 bp, Homo sapiens
ttatgactaaagtatattatacttctaaattattatgattctcatctaatttcaagccacacataggcgccatttgaaagcattttgtgttacaacctatcaacaaaaatcaactaatagttttataacgtgcataggtttaccccatggggc

SEQ ID NO: 23300 - DNA, 294 bp, Homo sapiens
tcagtgtccagtgagtaattgtatattgaaacgatagaatattacacagcaataaaaattcatgtcttcagaactatttccttatgggagaatgtttatataacattaagtaaaaaagtatgatatgaaagtgtatgaacagaatgatcccctagtgtgtgtatatataagaactgggctggacagtggtaccctgtccacatcccagggtcagctcttgtatatataaaagagttgattttattttaaccccattatccccttttgtacacacgcacacacacacacacacct

SEQ ID NO: 23301 - DNA, 78 bp, Homo sapiens
cagtaatgattatctgtttagtaaagggaaatgatgatgtacacattgaaacatataaagcttttaaacaggagcaac

SEQ ID NO: 23302 - DNA, 235 bp, Homo sapiens
agttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggacgc

SEQ ID NO: 23303 - DNA, 102 bp, Homo sapiens
attaggccgggcatggtggctcatgcctgtaatcccagcactttgggaggccaaggcgggcagatcgcttgaggttagaagttcgagaccaacctgggccaa

SEQ ID NO: 23304 - DNA, 432 bp, Homo sapiens
  misc_feature 13: r=a or g
  misc_feature 270: r=a or g
agtgaggagtcarggaggtgtgtgtgagagagagagagaaaagagagagacagagacggggagagagagagggagagagaagagagggaggagggaagaagaaaagacggagggaggtgaggaggaagggagggggagagacagagacctagaggggctgaagacccagacagagctggcagagctactgagaagaggactggagcgctctgagagcctctcaagatcttttgggggagcccaataaatgtgaacatgggatctgtcacrggagctgtcctcaagacgctacttctgttatctactcaaaattggaacagagtcgaagctgggaattcctatgactgtgatgatcctcttgtgtctgccttgcctcaggcatccttcagcagttcttccgagctctccagcagtcatagtcctggatttgca

SEQ ID NO: 23305 - DNA, 148 bp, Homo sapiens
ctactttttctaggcactaaaagggggaaaaggcttaatagccaaaatagttatcaaaagaccctaaagctggggtcctgtacaccatgaaaggattactttcattctcatgtaagggcatgcttttataaaaaacaaacatgggttg

SEQ ID NO: 23306 - DNA, 154 bp, Homo sapiens
  misc_feature 61: k=g or t
  misc_feature 125: d=a or g or t
  misc_feature 149: k=g or t
tgccgcgccggcgaggacatgggcagccgcggcgcgcccaccccccgcgccgatgtgaatkattaaaaagaaaatggcccaacggagcactgtatttccttctcttgtcaccaaggaaaggtatdatatatggaaaatatgcatctaakgcgcg

SEQ ID NO: 23307 - DNA, 252 bp, Homo sapiens
  misc_feature 57: r=a or g
tagacaaaataagaatgcaagcctagaggggaaaagccatattccattttaaatcaragacataacatgtgtattgtccaaactcttggcccttcatacatgcaagcaaggaagaagggaatggctgcctactcagggtactcctgcccaagcgcagaccaatcccaacacgtcttctctggtttatgaagactctcctctggtttctaaacctctgactttcaagtcccgtaaaaactgacataaggcaaa

SEQ ID NO: 23308 - DNA, 206 bp, Homo sapiens
  misc_feature 168: m=a or c
  misc_feature 173: r=a or g
  misc_feature 176: y=c or t
  misc_feature 184: k=g or t
  misc_feature 204: k=g or t
ttgtgtggcatggatttttcagataaataaaaattgtataactatatatttaatgtgtacaatgtaatgatttgatatgtgtatacgttgtgaaataaaatatagtcaagttgatgaacacatctattaccttacatggataacctttttttttttatagtaagtatmcttarggyctactgtkgtggcaaattttaagcatakgt

SEQ ID NO: 23309 - DNA, 226 bp, Homo sapiens
ttgaatcacattcatctctagcatctaattgtgcatgtggttacctgctgctttgcacacttttctctgccatgtatctctgtatcttgttctcaaagcctcattccagtctgttcttaaatgccagcttctcagagaagccttcctgactctccggtctaaagtagcagcaccccatctatcactctataatcttatcttgttttgttttcctttactgcactaa

SEQ ID NO: 23310 - DNA, 351 bp, Homo sapiens
  misc_feature 324: v=a or c or g
agatgaccgtttgcctttgtgatgaaggttccagtggaaatttgaactcccagcacgctgcgtgacttggtacccaggatagtctatctgggggcacctggaggtcttttctctggagtcctgggaggcaagttatgggcagcactgcttctggccgcaccatgaagcctgagtctgcttgcgctctgcccagggccctgctctgtctgagcattgggcttctagctgcccccctccccacagcctgccgctgctaggaggtagaactttaggagtggtccttggcctgtttctacctgtcacctggctcacctcaccactcavtcctcctccatcacagcaccccgaccc

SEQ ID NO: 23311 - DNA, 266 bp, Homo sapiens
tcattgatattctgtgtgaaataagcatgtcttgtacttgctttctgattcataattttatgaaagaacttagtagaaagaaaagtaagtataaaaatagatattggattctgtcagaaggcctagatttgaaataatgttttgtacttcggtaagatggaaaacttagtgattcactgatttcttagacactctaatatgatatgctttctggaaggataaaacaaatacatatgggaaaaagtacttgagaccaaggccagctt

SEQ ID NO: 23312 - DNA, 269 bp, Homo sapiens
aatttttgtttaaaatttgcatccacattaacaaaacttttattagaaaaattcatttaatatctaggcaaaattatatcactttcaaaactttttaagtaaattcagtaacatatcaattcagtttattagcatcaaatttgatgaagcagtgcataaatggaaacaaaacagtttatcaatacaatatatcattcttcagattttgcttattttttgcagccatttattacatttaaaattttgtgcatattgtctcatttgaaaaa

SEQ ID NO: 23313 - DNA, 115 bp, Homo sapiens
cggctggttatagcacttccactgctactgtcagataggaagtgatcgaagcagggggcaaagagaaagcccatatttgttctaagcagaaaagcaggaaaaaaaaaaaaaaaaa

SEQ ID NO: 23314 - DNA, 188 bp, Homo sapiens
attatgtatctcaaaaagaagtctttaaaaaataatcaaaataccatttttgaaatgctatcctcaatacttctatcagaatcacccgtggtgctttttaaaatgtggtgatttccaggccccactgagtcagatactgtaggagtggggctccatcaccaacattttctttttctttcggctgccag

SEQ ID NO: 23315 - DNA, 153 bp, Homo sapiens
cagatgcaggcttttgaccttggatttgccagcctccagaattgctttctccaccaccacaacagcatgtggtctgacagaattggcttcaaagaagaaactaaaagccacctcttgcaggaaactgcactgccctcaacatccagcccctac

SEQ ID NO: 23316 - DNA, 112 bp, Homo sapiens
tttttatagaaatggggttttgccttgttgcccaggctggtcttgaactcctgggctcaagggatcccctgactcggcctcccaaagtgccgggattacaggtgtgtgtcac

SEQ ID NO: 23317 - DNA, 163 bp, Homo sapiens
gcagaggctggctccccgcgccccgcatcccacgctgggacacgcgtgtggccttgccagggtgggcgagacacggccgccttccttcacatccaacgccggtgaggctcagcactcattgtctcactggcagcacagacaaagccttgcgggctccacggga

SEQ ID NO: 23318 - DNA, 134 bp, Homo sapiens
tacaacaggcattcttatccccattttgcagatgacgaaagtagacccagctccagtaaccttcccttagattacacggggctgagatctgagactgttcacttgactccactgtccttttctttcctcgctgc

SEQ ID NO: 23319 - DNA, 173 bp, Homo sapiens
ttcctatgggaattttggcaaaggttttcttgaaagaacaagtttctcaaaggactttcttcctctagaatgttcattttatgagatcgctatctgtaagtccagttggattacaggaatacttgaaagttactttctaccactattagaaaatatgaagtcgcatgcactac

SEQ ID NO: 23320 - DNA, 218 bp, Homo sapiens
  misc_feature 4: k=g or t
  misc_feature 78: s=g or c
tgtkccgccgccatcggccctagcctgcggaattgggctcgccccgggacgataacagagctctgccgggggctggasgcactgaccgggtgaccagagacccagagaccagaccccctccacggcgcccgggatttcggggacggcttctcccatcgcaagtttcaacagaaaatgagaaatatcccccgacgattggctgaaaacatgcagcaacc

SEQ ID NO: 23321 - DNA, 158 bp, Homo sapiens
tagttctttatgtacaaggggaaagaagatttataacttaggatcagatttggctatataatataaagaagaaaccaaattaacacagtagcttaaataagatactacttgtttttctttcatgtagaaagaagtgtgaaagtaggcaggccggacaa

SEQ ID NO: 23322 - DNA, 183 bp, Homo sapiens
ttatagaattatcttattatgttggacaattttttctatttccttatcagaaattttggtccaaattgtctagatcacctttgccaaatttagaaggccaaaataattttatgctagtaaataatttatatttttataactatattttctagctatataaattattcagctgacccccccaga

SEQ ID NO: 23323 - DNA, 126 bp, Homo sapiens
  misc_feature 90: w=a or t
  misc_feature 93: y=c or t
  misc_feature 116: w=a or t
  misc_feature 118: y=c or t
acttgggtttcagtctaaaaatactaggtttcagagtgctattatttttcctggctttggagtttttggctatttatctttttttttttwaaycaatagaaaaaaatacattcatwaycccatgca

SEQ ID NO: 23324 - DNA, 243 bp, Homo sapiens
  misc_feature 15: h=a or c or t
  misc_feature 19: n=a, g, c or t
caaataactaatgahagcnaaaatgggaactagagccatgtctcttgactctatcctatcagactgggagctgttgccaggaacaaaggctaaattaagcctccttattccgtttcatatttaacactaagtgagaggaatgatctacacttcacaatgatagaaatatttggagaccctttggctcaccatgttaattacactgagaactgaactgagagtctattactttaaaccgaacat

SEQ ID NO: 23325 - DNA, 130 bp, Homo sapiens
  misc_feature 6: n=a, g, c or t
  misc_feature 7: n=a, g, c or t
  misc_feature 8: s=g or c
  misc_feature 9: s=g or c
  misc_feature 43: n=a, g, c or t
  misc_feature 99: s=g or c
gttttnnssgtcggggggcaggagccaccatcgagcttcgcgnggttgctgggctgacggatccgcgggccggcatctgaagcgagcgggacgcagcgsggccagggcctccgggcatacgcaagctggt

SEQ ID NO: 23326 - DNA, 187 bp, Homo sapiens
taaaaattaagaaaactttatggaaataaaatgacttcatttgatgtaatgaaatagcacagcgtgtaccaaggatagttgactcagaatggtcaattccaatatatatcattgtaaagtttctgaatttcaggagctttaataactcggaggtggtgaggtgggtgtggggagtgaagagggaaaa

SEQ ID NO: 23327 - DNA, 418 bp, Homo sapiens
tttccttctaaaagggccctctgctgcaggactgctgaagtttgctgaaggttcacttcagaccctgtttgctttggtatcaccagcggaggctgcagaatagcaaagattgctgcctgctccttcctctgtaagcttcgtctcagaggggcacctgccagatgccagctggagctcccctctatgaggtatctcttgactactcctgggagttgtctttcagtcaggaggcacggttgtcagggatccacttgaggaggcagtctttcccttagcagagcttgagcactatgctgggagatccattgctcttttcagagccagcaggcaggaacgtttaagtctgctgaagctgcgcccacagccgcccgttcccccagtgctctgttccagggagatatgagttttatctatagtc

SEQ ID NO: 23328 - DNA, 142 bp, Homo sapiens
cctttatttcattgacatatctggtgtaatttttttctctggttactctggagcttacatttaaaaatgtatagttatgatagactatttaaagctgataaaaattttgatcacacacgaacctgctatactacccccactc

SEQ ID NO: 23329 - DNA, 508 bp, Homo sapiens
ttctgttaattcacgtgaatctccagaccttgaaatgatttttctcctgatgttttagtttcacatcactcactatggtgaatagtttaagttatctaatttaaaatatttatgttggccagttatggtggctcatgcctgtaatcccagtattttgggaggctgaggtgagaggattgcttgaaaccagaagttcaagaccagcctgggcaacatagtaagaccttgtctctacaaaaataaaaaaatttccaggggtggtggctcacgcctgtaatcccagcgctttgggaggctgaggcagaaggatccttgggtccaggacttcaagaccagcctgggcaacttggcgagaccctgtcttaataataaataggccaggcgcagtggctcacacctgtaatcccaagtgctgagattacaggcgtgatcctctgcgcccagccttgttgatttactttctttaaattttgcaaatttaatacgtgacatgacaactgttttatgt

SEQ ID NO: 23330 - DNA, 403 bp, Homo sapiens
  misc_feature 12: m=a or c
taaggaggaggmaaaagtccatacactcatgaggacctcctcatgtccctcttcataggaaccgagcgctcctctagggattttcttgttcccaggaggtgatcagagttaggaattacacttactgacctggacctcgcgtttttgcggagacgcggaaacaagatgtgtgcagtccgtctgtccgatgattagccagccgacctggagagggccctggaaggtgcccaaagttccgcgagagctggcccggcgaagacagacctcccggacttgaggccgacttcaccaaatccgccccgggaaaaggcgagggcaaaggcggggcggacagacccagctgcggctgagggactgcggtccctagcaaggagcagagatggggagctggatccgcgcagaa

SEQ ID NO: 23331 - DNA, 391 bp, Homo sapiens
ctgttctttttagatgtctgcacccccagcccccactgctctttcaggtcatcttatctacttgctttcatcagggaagtctgaccgtcccgctacagtagaagacctgaagaaacttcggtatctggaatgtgttattaaggagacccttcgcctttttccttctgttcctttatttgcccgtagtgttagtgaagattgtgaagtgggtaagtatgctatacctaaagtagaagggagagggaaactttctgatgtctaccttgctccggtctcataatgtattgactacttcttgacagcaggttacagagttctaaaaggcactgaagccgtcatcattccctatgcattgcacagagatccgagatacttccccaaccccgagagg

SEQ ID NO: 23332 - DNA, 141 bp, Homo sapiens
ctttgttctgcttgaccaaatctgctgttaaaagactctgatgcatttttcagtatgacaattgcatttttcagctccagtatttctgcttgattcttttagattatttcaatctctttgttaaatttatctgatagaatt

SEQ ID NO: 23333 - DNA, 462 bp, Homo sapiens
  misc_feature 276: w=a or t
  misc_feature 277: n=a, g, c or t
  misc_feature 278: w=a or t
ccctttggatgaatacaggatttccatgagccataaggttcctgagaaatcactcaagcagactttaagagttttgcattatttttctgggaataacttgctgacaaaacattataggatagatttggcacacagacatcagcagatgcaaaattggaaataggcaatgcagaaaaggaatggtatttctgaaaagtaacagacactgtggcacatattaattgaaaaagctgatgattttccttggaaagaaagaaagaagcactgagtgttttwnwataagtaaaatgaggagtttacaatctaaagaagtgagaggcacaccagcacacagtttaaaggacactagggctgaaaacatctgaagtcactgtctttgaatttagcttggttcctagcagacactgtgtagcttccagagggatctggcttacccagactcaaactctggctatcttttct

SEQ ID NO: 23334 - DNA, 137 bp, Homo sapiens
  misc_feature 8: w=a or t
  misc_feature 9: m=a or c
aaagaaawmatagacgacacaaacaaatggaaacacatcctatgttcatggatgagtagaatcaatattgtgaaaatgaccatactgccaaaagcaatctacaaattcaacacaattcccattaaaataccaatgtc

SEQ ID NO: 23335 - DNA, 387 bp, Homo sapiens
  misc_feature 369: r=a or g
ttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtrgatattcagtcgctacta

SEQ ID NO: 23336 - DNA, 419 bp, Homo sapiens
  misc_feature 133: k=g or t
  misc_feature 134: h=a or c or t
  misc_feature 135: n=a, g, c or t
cagtgtctacctccacaataactatgatataggaaattgtcctttcagtggtttctaggtataacaaacaagccgttaaaaatgagtgaccattttgtaggttacagcctcagcaatctgtgtcatttgaaakhnaatatcctgatatttttaaataaggtgagcagggcaggcaggaaaccaatatttagtacttttgtgattaaacattctagaccaggcttgttgatatgtatgccaatagcctagaatttttggcttagtgtaaaataaaaatgtcttttctattgtggtctgatatccgtttctgtaataagatcagtttgttgtcctctgtgcaccagtggttttgcccttaattttttttggctagcatcaccaagatctgtcatccagagctgctgagaaaaatacatgtt

SEQ ID NO: 23337 - DNA, 290 bp, Homo sapiens
tctagaaaaaatgtttaaaactcagtagtgtcagccactgtacagtgtagaaagcagtgggaactgtgattggatttggcaacatgtcagctttatagttgccgattagtgatatgggtctgatttcgatctcttcctgatgtaaaccatgctcacccatatcccactatacaaatgcaaatggttgcctggttccatttatgcaagggagccagtactgaattatgccttggcagaggggagactccaaaagagtcatcgcaggaagaagttaagaacactgaacatca

SEQ ID NO: 23338 - DNA, 134 bp, Homo sapiens
aactcgacctttctgtggccatgttggagtctgcatgctgagatgctgccctttccccttggaaatgctgggaaatgtgctctggtgtccatcctggccatgcctcttcctccaggccttgaaatcacggcagc

SEQ ID NO: 23339 - DNA, 411 bp, Homo sapiens
ttcccggctgctttgtttacctaatcaagcctgggcaatggcgggcgcccctcccgcagcctcgctgccgccttgcaggttgatctcagactgctgtgctagcaatcagtgagactccgtgggcgtaggactctccaagccaggtgcggaatataatctcgtggtgcgccgttttttaagcccgtcggaaaagcgcagtattcgggtgggagtgacccgattttctaggtgccgtctgtcacccctttctttgactcggaaagggaactccctgaccccttgcgcttcccaggtgaggcaatgcctcgccctgcttcggctcgcgcacggtgcatgcacccactgacctgcgcccactgtctggcactccctagtgagatgaactcggtacctcagatggaaatgcagaat

SEQ ID NO: 23340 - DNA, 223 bp, Homo sapiens
caaaagactttctcaatctattttggccacaaacaaacatattcaactgaagctttccaataatctttatatcaagaaagcatgcgtcttgtcagctacattgttttcttagatggatttctcctgttaatcctcaaatatctgaacttctgtgttacccaagtgtcttatacaagcttctggtgtctaggacaaatttatggcaaataaaattagcaaaacc

SEQ ID NO: 23341 - DNA, 461 bp, Homo sapiens
  misc_feature 304: k=g or t
  misc_feature 321: s=g or c
  misc_feature 324: n=a, g, c or t
tatctattatctctcatctctgatactatttcttgttctgaactctgttgtgtctaatatcaatgtagtctttccacagctttattttagtgtttccatgatatggcattctccatatcttgatgataacctatttatatctctatatatttggagcaagatgtaaaatttagacttgattttttaaagatttttcaagatgtaattcttatttatttttgttctatttgacattctctgagtttcctatatctgaagtttgattttctgtcacttcttttagaatatttttggcagttatttkgaaaaatatttcttttstcnggttattttttcctcttttctttttggaatttcagttgtaactagggtaggtaatttcatctcagtgttatgcaggtgctttttctcagggtcccaggaatgtagccttctcacacttctgttcttttcctggctgc

SEQ ID NO: 23342 - DNA, 57 bp, Homo sapiens
agataaccagaaccgcaaatgcaggcgggggtgtcccagagtcggctccgccttgga

SEQ ID NO: 23343 - DNA, 99 bp, Homo sapiens
agtggggcgccctgtccgcgttcgaagctgagcccagtcctggggggatgccccggtctgcgtctccagctgcggcagacacccccttcccccgaccca

SEQ ID NO: 23344 - DNA, 205 bp, Homo sapiens
cagggtaaaagacagttttcaaagccccacgtgttaccactccaaccccagtatctgctagtgtcctcgttcagcccagtgggcctctttgactctcctcaaatgtgctaacactcctgcttgaggacctctgctgtagcttttccctgaggctggagctctcccctgtatctgtggtgctccttccctctcttcccccaggctt

SEQ ID NO: 23345 - DNA, 137 bp, Homo sapiens
aaagaaatcatagacgacacaaacaaatggaaacacatcctatgttcatggatgagtagaatcaatattgtgaaaatgaccatactgccaaaagcaatctacaaattcaacacaattcccattaaaataccaatgtc

SEQ ID NO: 23346 - DNA, 211 bp, Homo sapiens
  misc_feature 158: s=g or c
tgtctccattcagatgagcactgaaggatttgtcactgctatagttgttctcttaagagtgtcacagaatactctcctgaacaaaagtagcccatcttttggccaagggcctgagggcaacctctgtgaagatttcttgcttcccctagtctgcgaastttctctcctcagtacttggccacacaaattctagctaccttaccagcccgaa

SEQ ID NO: 23347 - DNA, 136 bp, Homo sapiens
tttttcttatctttttatgttgataaggtaacttaacagtgattggcttttgaatgttgaacattgcatttctggaattaaatcaactttgttgtgataaatgattaataccatattatgtatggttgagatgggc

SEQ ID NO: 23348 - DNA, 253 bp, Homo sapiens
  misc_feature 12: r=a or g
taaaagtagtargccacattacatttatctttgtaaaaagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcatt

SEQ ID NO: 23349 - DNA, 193 bp, Homo sapiens
gcttgtgaggctattgcaaaaacagaccatcaatccagagtattttttttaatgatagttaattttatcgtatatttttattttatttttttagagacagggtctcacaataaaataaaataaaaaataaatttaaaaaagaggtaaatgtggactattatacagcctccttgatgatttgtatgcacaatta

SEQ ID NO: 23350 - DNA, 208 bp, Homo sapiens
cttgaatattttgtacttacatagcgcctttcatctcttgatttctcaaaatgctttatgaacacatttaaagaaagtggtttaagtcttgtccaacacttgacaggtctgctgtgtttagcaagtgaggaatttaactttacttcaaaactgctttctgcctattaggagtgaggatacctaagtaatgctgatagaacaggactca

SEQ ID NO: 23351 - DNA, 457 bp, Homo sapiens
  misc_feature 373: m=a or c
tagaataatatttggccaaatatttggataccatcatttaaccgtgttaacatataaaattaaccatcatgagtccatttttgtaaacctggcactcatatacatcttaaaccaaaattaatctccaattaaagacaataacaaggcaatacttttgcttaacatgattaatactactatcctgtgtacaactaaaaatgcactaacccttcccctaaaagaggatgcaaaatccttgaaagtctttttgatgattattcttctcaatgtcctctaacttaactactatgatgtaaagttaacattacttaattactataatataaagtcaatacatctcatgttatatggtaaggggaaaagagagggaagmaaaaacagatatttgagatacccacatgcacacacttgaacatattcataacaaaataacaaagaaaaatacacatgacacaga

SEQ ID NO: 23352 - DNA, 237 bp, Homo sapiens
  misc_feature 192: r=a or g
acctactcatctgacaaagggctaatatccagaatctataatgaactcaaacaaatttacaagaaaaaaacaaacaactccatcaaaaagtgggcaaaggatatgaacagacactattcaaaagaagacatttatgcaatcaaaagacgcatgaaaaaaatgctcatcatcactggccatcagagaaatgcraatcaaaaccacagtgagatatcatctcacaccagttagaacgga

SEQ ID NO: 23353 - DNA, 389 bp, Homo sapiens
  misc_feature 132: k=g or t
  misc_feature 336: s=g or c
  misc_feature 350: k=g or t
gtctttaatccatcttgaattgatttttgtgtaaggtgtaaggaagggatccagtttcagctttctacatatggctagccagttttcccagcaccatttattaaatagggaatcctttccccattgcttgtktttctcaggtttgtcaaagatcagatagttgtggatatgtggcattatttctgagggctctgttctgttccattgatctatatctctgttttggtaccagtaccatgctgttttggttactgtagctttgcagtatagtttgaagtcaggtagtgtgatgcctccagctttgttcttttggcttaggattgacttggtgatgcsggctcttttttggktccatatgaactttaaagtagattttccaattgtgtgaa

SEQ ID NO: 23354 - DNA, 139 bp, Homo sapiens
tcttatgttttttaaactcttcttgatttttttctaattgcgttctcaggataaccttctaaagtacttagctttcagctaataataaaaaaattaataacaactaatatttattgcatgtttacatgtaccagatgct

SEQ ID NO: 23355 - DNA, 166 bp, Homo sapiens
atatttagaattgttatatcttttggctgaaatgatttctttattattggatgatgatctttatccttttttgttacagctttttaatttaaagtctgttttatttgatgtaagtatagatactcctatttacttttggtttctgtttgtgttaatatattccccc

SEQ ID NO: 23356 - DNA, 76 bp, Homo sapiens
  misc_feature 7: v=a or c or g
  misc_feature 8: d=a or g or t
  misc_feature 63: n=a, g, c or t
aaaaccvdcagggacctggtatagacgcagaatctgtttcacacaacaactgctatttgaagnaaaaaaaaaaaga

SEQ ID NO: 23357 - DNA, 365 bp, Homo sapiens
  misc_feature 329: r=a or g
aaaaaattatttgaggcaatttgagagactgttaaagaatgcaattgaagaaatctgagtagaatttccccagcttgtcttgtatagttcaggcactgaccttttatctgaaaatactaacagaaaccttaaaaaagaacataaactttgatgactggagggaaatagtttagcagcttcttgcatggcagtggctaggtcttgtctaccgagggctggtcagttccgttttctcttgtaattaggagtttcttggcctgtaaataaagtaaccatatgttctagattttctggggcagcccaattaaaaatattctttcctgttgttrggccatgtgtcagaccatatgtactgatatttttat

SEQ ID NO: 23358 - DNA, 428 bp, Homo sapiens
  misc_feature 7: y=c or t
  misc_feature 426: r=a or g
ctaatgyaaagattgttaatgtcatttatcaaaaccataggtgattatttggagggatttaaaaaacttaattactctcaggcctcatcccaagcttgacacatgctctgtaggttgaacacataatcacaaatattctagcaaatgctgccttggttgcagcctgcactgtagacccaagggttttgctgtggctcttcttatctcccttggctcataaagccccagatgatgccagagcttcaattagagccatcatcatcccaggcagggatatctttgagaaatgactcagttcagccccaggcccctgtgactctgcttaaagcacacatttctgctgactcttgtacctggggcagcaggataatcaccaacacactcttaacgagaaacaacacaccaagcacagtggagctgtcctargc

SEQ ID NO: 23359 - DNA, 434 bp, Homo sapiens
  misc_feature 8: n=a, g, c or t
  misc_feature 9: v=a or c or g
  misc_feature 52: v=a or c or g
  misc_feature 53: n=a, g, c or t
  misc_feature 54: n=a, g, c or t
  misc_feature 306: r=a or g
aggtgtanvgctaggggaaggagatactggagctgctggccggctgaacctvnnttctcttcattgtgggctcctattggtaggcaggctaccgtataccctcgacgtgctatctggagcccgttaccgagcgcactctactagaaagataatggcagagtggggtgcgagggtacaagggctgggtggggagtttgcaaagccaagtaaggataaactgcagtgaccagcccgaagcgtgcgttaccggcactgcagcgttttaccaactgcctggatgggaggaggaaaaagtgatgtgtgaargagatgggggaagggagaaaccggttgggcaagcggccgattgttgagcataatctaacgaatttccaaagaaaacgtaataaaaccggacaagaaatattgttcatagacaagagcatactttgctt

SEQ ID NO: 23360 - DNA, 424 bp, Homo sapiens
tactacatcatgattttggtatgtgtttcaccaaagtgaaccagagccacagatgacaatgaccaggggtgatagtggtgtaagaaataaccaccagccacggtgtctcatgcctataatcccagcactttgggaggccaaggcgggcagatcacttgaggctgggagtttgagaccagccaggccaacatggtgaaactccatgtctactaaaaatgcaaaaaattagctggtgtgcacctgtagtcccagctgcttgaggctgaggcaccagaatctcttgaaactggaaggtgggggttgcagtgagccaaagtggcaccactgctctccagcctgggcaatagagcagactctgtctcttaaaaatacatataatttgcagttcttaattaagagatttctgcagctcatcttcttgagt

SEQ ID NO: 23361 - DNA, 218 bp, Homo sapiens
  misc_feature 13: s=g or c
  misc_feature 23: n=a, g, c or t
  misc_feature 25: r=a or g
  misc_feature 50: k=g or t
  misc_feature 55: n=a, g, c or t
  misc_feature 90: w=a or t
  misc_feature 91: k=g or t
  misc_feature 146: w=a or t
  misc_feature 147: k=g or t
  misc_feature 156: r=a or g
  misc_feature 165: s=g or c
  misc_feature 169: k=g or t
  misc_feature 175: m=a or c
  misc_feature 176: s=g or c
  misc_feature 198: k=g or t
  misc_feature 199: w=a or t
actcgcctggggsccgccggcgngragaggagcgtgactgcgctgcgcakggcgntaggaggcattgtcgccgctcaggcccttttgtgwkaagcagaccagcctgggggctgtcggcaggacacctgtgtctgcatgctgaagawkatgggtgargccgtggcsagaktagcamsgaaggtcaacgagacggtggakwgcggctctgacactctgga

SEQ ID NO: 23362 - DNA, 194 bp, Homo sapiens
cttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagcgtcac

SEQ ID NO: 23363 - DNA, 144 bp, Homo sapiens
aggcataaaaacagatttgtttgtagcagtagtctgtttgtacaatgttataatatttctgtaacttgggccagaatgtggccatgttaaatgatatagctattaagctcactttacaatctaaaaggaactaataaagccaga

SEQ ID NO: 23364 - DNA, 390 bp, Homo sapiens
  misc_feature 113: m=a or c
  misc_feature 348: r=a or g
tgtcaagtgtctggcctttgttccaagcctgatagcctttgtgtggtttggattctttatttggttctttggacgatttttgaaaaatgagccacgcatggagaatcaagacmaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgrcttctaaaagtacacctacgaactagactcggagatagactt

SEQ ID NO: 23365 - DNA, 217 bp, Homo sapiens
gtagacagcctacctccctgtacctggaccagccctgggatccccgggatgctcaggaatgctttcttgtcattgttgacagccctcctctgtgtggagtctctcgctggacctggaactcagggatcctaggcaggtcagctggaagggaagacacgcctctccacaccaagcctgaggttcaccgcgaaagagaggccgccaccctgccccaatc

SEQ ID NO: 23366 - DNA, 78 bp, Homo sapiens
agaccccgcccggcgaggaggagggagggccgccagtgtcgacatgctgctggaggaggttcgcgccggcgaccggct

SEQ ID NO: 23367 - DNA, 181 bp, Homo sapiens
ttaaggtatattataagatatgttttttaaggtataataaactacacttatataggtgtgaaatttggttagttttggcatatgtatacatgcatgaaagcactgccacagctaaaagtaacaagcatgtctgtcatccttgaaaattttctttcgccttactgtaatcctacctcccacc

SEQ ID NO: 23368 - DNA, 190 bp, Homo sapiens
tgagaattgcttttttgaaaattttcatgaaggaattttggtaatgactttgcttgcaggttttttggggtgttttgagaaagtggcatggaaacatgcagtagttaatgagtttctcttggtactgaacactattagaatatcattagtgatattttttctctttagagcatttttaatgcaacaagcc

SEQ ID NO: 23369 - DNA, 124 bp, Homo sapiens
agtccccgcctcttccccaggggccgcgtcggagcctcggcggcggcggcggtgcttacagcctgagaagagcgtctcgcccgggagcggcggcggccatcgagacccacccaaggcgcgcccc

SEQ ID NO: 23370 - DNA, 131 bp, Homo sapiens
taactcagaataatcaaatgaagggactactgcaaatgttttggcaggatgaaggaaagacaacaaatgatgctgaagcaccctaggctagaaaaagagggagctgttactaccccagaagagtcaagggg

SEQ ID NO: 23371 - DNA, 134 bp, Homo sapiens
gaatcaacctaagcaaccattaatggatgaatggataaagaaaatatggtatctatatacacaatgaagtattattcagatataaaaaataaaatcctgtcaactgcagcaacatggatggaaacagaggtcac

SEQ ID NO: 23372 - DNA, 218 bp, Homo sapiens
  misc_feature 53: n=a, g, c or t
gacagaaacttcaataaactttatttcaaacacgtctccgcctgcccggaggnaagggattggatagagggggcttagtctgggtctctgcttctagggttgcaggcctaaagtactgcagaatgacgttagatgggtcgttgttaaatgacttaatcatcatcattatcaacggcagcgctttatacttcagtccgtgtaaagcatgcaggaccggt

SEQ ID NO: 23373 - DNA, 157 bp, Homo sapiens
agttaagaacaaatgctggtgaggttgcggagaaatagaaatgcttttacactgttggtgggaatgtaaattagttaaactattgtggaagacagtgtggtgattcctcaaaggtttagaaccagaaataccatttgacccaccaatcccattacta

SEQ ID NO: 23374 - DNA, 421 bp, Homo sapiens
  misc_feature 6: m=a or c
  misc_feature 7: s=g or c
  misc_feature 121: s=g or c
  misc_feature 210: k=g or t
  misc_feature 324: n=a, g, c or t
  misc_feature 328: n=a, g, c or t
  misc_feature 340: k=g or t
  misc_feature 344: n=a, g, c or t
  misc_feature 384: s=g or c
  misc_feature 410: m=a or c
actggmsgcggcactgccccggacccggctccgcgcaggcaggggcactgtggagggccatgcagtgcctggggatccggagccggagccgctccagggagctctacctgcaggagcggasccttaaggtggcggcgctcaatggacggaggctgggtaaggggcgcagagcactccgagatctgcgggggaatgggaaggcagctggakcaggacgccgaccacttgtcccttaacgcggggccatttgccttggagcctttaattggacatgtttagtacttctgtgagtgtgtggcccactgtggggcagtgtttgcagtngtancacgtcggggtkagtnctagggtgattagttaccccttctcattatttaactcatsccttccaacgctccccatcccttgtmacccgacgcct

SEQ ID NO: 23375 - DNA, 302 bp, Homo sapiens
aaaaattagttttgaggatcgttaggaagaggacgcagggaccgtcctttcagagtctagaaagaagggtcactcctggccggtgagcgcatgagcttaggtgcggaccctgcaggcgccccctttccccgctccccaggcgcttcagcaccgcggacagcgcccatccgaatcactgaggccaaagcccagcacgtctaaggcagtcccgtaggaagaccccgtgtgcacctcccagctgagcgaactctaaccaactctttctttctctcttcccctctctcattccgccctccgcccac

SEQ ID NO: 23376 - DNA, 333 bp, Homo sapiens
ttgtagtgtctccttcaacttgtcatattttaaaaaaatttatcatctaatgtcagtctaagcaaagaaaaattagaattttaaatcattagcctgtattttactgttcatccctatatgttgtgtagtgtccatttaaaatgcaaatataagaatatttacctcatttgtggaaactgaaattatacagtcattttgtagttgcacttgcatgtgtagtttgtttttgctagaacagtagaaactctgtacaaacgaactcagtggtttgtatttcacttcttgatgaatacatattctaccaacattctaccttctgcttactgatgagta

SEQ ID NO: 23377 - DNA, 244 bp, Homo sapiens
actcccctaggctagaaagttgtttacccaaatcttgccatggctagaaatttgagtctagcatctaccttctcacagctccaggtggacctccagaaggaaaaggaagatgtcctaccaagctaacctgtgactagatatctgttagggtgtgaaacctgtgaacatatccacatcttttcctttgtgttcatttccttttctcttcctttttaaagtaaaacatccttttgaaaagttccac

SEQ ID NO: 23378 - DNA, 92 bp, Homo sapiens
actgggaagaagacacaacccacatttttagattttccagtttccacgttgaaaaagcaaaaagacatgagattgatttgtgacccagtaat

SEQ ID NO: 23379 - DNA, 200 bp, Homo sapiens
cactctccttccttagtaattttcttgcaaaagcagataatttcctgcaatgttgagctcgccttgactcacaccgagcacatttcttgcaagtcaccatttcctgacgctcagataaatgaagttcaaattagagaaagaaaagagccaggcagagtgtggccgcttccattcagatcaattttaattcagaaagaatt

SEQ ID NO: 23380 - DNA, 106 bp, Homo sapiens
acacacttttgtctgcacataactcttttttcacaagaagggtcactgccacaacagcacagtcagcgggtgaattacaggtgcctgctgcctgcctacctgggcc

SEQ ID NO: 23381 - DNA, 175 bp, Homo sapiens
  misc_feature 122: s=g or c
ttagtagagacgggttttcaccgtgttagccaggatggtcttgatctcctgccttcatgatccgcctgccttcatgatccgcctgccttggcctcccaaagtgctgggattacaggcgcgascaccatgcccggcctagattaaaaatttgaagacatattctctactatgagcc

SEQ ID NO: 23382 - DNA, 503 bp, Homo sapiens
  misc_feature 332: n=a, g, c or t
  misc_feature 348: y=c or t
  misc_feature 349: y=c or t
  misc_feature 352: m=a or c
  misc_feature 422: n=a, g, c or t
  misc_feature 424: n=a, g, c or t
  misc_feature 425: y=c or t
tgaaagttaatctttaggtcgattttgaaaaactccgcctcctctctcctttttaatatttctttcttcctttttaatcatgtttaagtgaacttactcttagttataaggaactgtcctgctttgtggggaagagggctgttgcttgtcaggcaaaaaagttttctcttcctacccaccatccctctctctgcttcccttgcatttggcaggctgtatgaagccaatgagctgcgaggtgttttgacaggggaggtctgcatgcagcctcttctttgtcctaacaattcctttgttgatcttgcctgtgatgaatcatagcgcctgcattngctctggtctaggcayyatmttgcaacacacagtatcgtaagcgagagattgttctgcctatattcagtgttttccatgcagcattcttncnytgttgacgttcacagtactgtaacgagtaacagacttgatcacagtctcctcgtgcctgtgcagggctgcacaggcat

SEQ ID NO: 23383 - DNA, 165 bp, Homo sapiens
  misc_feature 125: k=g or t
cactaggccaggtgtggtggctcactcctgtggtcttagcactttgggaggccggggctggaggatcacttgagctcaggagttcaagaccggcctgggcaacatagtgagccctcatctctatkaaaaaaaaattactagcactaataaaatgttagcagtacc

SEQ ID NO: 23384 - DNA, 165 bp, Homo sapiens
  misc_feature 11: s=g or c
  misc_feature 12: s=g or c
  misc_feature 126: r=a or g
cactaggccasstgtggtggctcactcctgtggtcttagcactttgggaggccggggctggaggatcacttgagctcaggagttcaagaccggcctgggcaacatagtgagccctcatctctattraaaaaaaattactagcactaataaaatgttagcagtacc

SEQ ID NO: 23385 - DNA, 106 bp, Homo sapiens
  misc_feature 16: s=g or c
atatcctagcgcgcasagcagcagcagcagcagcagcagcagcagcagcagcacccgcatccgctgcgggagtccgagccggaaccacacccaagtagctgcccga

SEQ ID NO: 23386 - DNA, 261 bp, Homo sapiens
cttatgtattcaaccaaggtgtcaccttgtcactgcttatttgtattattgtagcaaatattttatttattttattattttgagacggattctcactctgttactcgggctggagtgcagtggcacgatctgggctcactgcaatctttacctccctggtttaagtgattctcctgcttcggcctcccgagtagctgggactacaggcatgcgccaccacacctggctaatttttttgtgtttttgttagagacgggactg

SEQ ID NO: 23387 - DNA, 430 bp, Homo sapiens
  misc_feature 330: s=g or c
  misc_feature 412: k=g or t
gggacttgcagattgtttagatggagagatgagggaaaagacaacatttaaagctgactagggtcatgggacttttgaggcttctagatacgatggtctagtgttctgccttctggaggggctgaccctgtattatcccagcatatctaggcctgagaaaaataacctacaagcctgccagaaatgtataggcagcattaattttcacaaagtgtaaatgtgtggtcattttctgtgacttcttttgtttactttttttgagacagggtcttgctctgtcgctcaggctgtagtgcagtggtgcaatcatggcttactgcggcctcaaastcttgggcttaagtgatccttcccccttagcttcctgagtagctgggactacagatgtgtgtcagcactctcagctattttktttttttaattttttgta

SEQ ID NO: 23388 - DNA, 334 bp, Homo sapiens
  misc_feature 11: s=g or c
  misc_feature 297: s=g or c
  misc_feature 315: m=a or c
tagaagggagsgagggggcaggacagtgtggaatctctagggtgtatgggtaggtagggggcacagttagttctaagtgggcttttatgctaaaagcctctggggatatctgttttgaaaataaagataggtgtcccctccttgctgtcatctagcccagacactctgcttgctctctggctgtctgctccctgggaaggctttaggaggaccacccaggacaggatgaccatgctgccatctgctctggagctgggtctcagtgcagagggacagtgactgtggatggttgcagtstctggtgggaggtgaggmtagaagtgataaagagaca

SEQ ID NO: 23389 - DNA, 106 bp, Homo sapiens
  misc_feature 11: s=g or c
  misc_feature 12: y=c or t
caacatgtggsytttatccattttatttatacctttagatttcagaaacatcttcatgttttagatgcattctacagacatcatgttacttaaaaactcagggccc

SEQ ID NO: 23390 - DNA, 240 bp, Homo sapiens
  misc_feature 11: s=g or c
  misc_feature 12: m=a or c
  misc_feature 21: v=a or c or g
  misc_feature 22: v=a or c or g
  misc_feature 208: w=a or t
atttttggctsmgcagccggvvgctgctcgctgcttgtcgcgcgctcacacacacacagacacacacgcacacacacacatgcacacattttctcgcgctctctccggctctcctttgtttattttctaatctatatttttactggaagatttcctctttattctctcccgccctcctacaagcgctcttgctggccgtctgggtgcwcacaccgctccctcgatcaccccagccccctt

SEQ ID NO: 23391 - DNA, 160 bp, Homo sapiens
  misc_feature 117: w=a or t
  misc_feature 120: w=a or t
cataaaacatgtgcaactctgggtaaaatatttttcttctaaaagcacaaccactttacaagattaaaagtctagtaacatttctaaatattattcatatcatacaagtaagtggtwgtwaatttaaaacttcattagtaaaattacagtacaagcagat

SEQ ID NO: 23392 - DNA, 396 bp, Homo sapiens
gaaaaagattttcagtctttcaaaatgtttggtagaattaactactgaagccatcaggtcaagggcttttctttgtcagcaggtttttgatttttgatttgatttccttataaagttatggatcaattcaatttttctattcttggtaatcaagtcttgctaggttttttatacctagaaatttgtccatttcatctagattgttcattttgttgtcacacagttgttcacagtacactctttaaaacattttatttcttagaatcaggcaggcagatcatgagatcaggaaattgagaccattctggccaatatggtgaaacctgtctctgctgagaatacagaaatcagctgggcatggtggtgcatgcttctaatctcagcctcctgagtagc

SEQ ID NO: 23393 - DNA, 220 bp, Homo sapiens
  misc_feature 12: n=a, g, c or t
  misc_feature 13: m=a or c
aaaaggtcaggnmgaggccggcgcggagaatctgctgtcgcctgcagctgctcgcctgtctccgtcggaagggagcccaagctttgcagagaacatgaacgattggatgcccatcgccaaggagtatgatccactcaaagcgggcagcattgatggcaccgatgaagacccacacgaccgcgcggtctggagggcaatgctggcacgatatgtcccccaa

SEQ ID NO: 23394 - DNA, 261 bp, Homo sapiens
tattattaggctgggcatagtgtctcatgcctgtaatcccagcattttgggaggctaatgtgggaggattgcttgagcctaggagtttaagaccaggtggggcaacatagcaagatctggtctccacaaaaaattagccaggtgtggtggtgcatccctatagttccagctacttgggaggccaaggtggtaggatcacttcagcccaggaagttgaggctgtagtgcaccactgcactgtagcctcagtgacagaaacct

SEQ ID NO: 23395 - DNA, 303 bp, Homo sapiens
  misc_feature 10: m=a or c
  misc_feature 24: m=a or c
  misc_feature 25: r=a or g
  misc_feature 122: s=g or c
  misc_feature 137: s=g or c
  misc_feature 149: y=c or t
  misc_feature 258: y=c or t
  misc_feature 259: y=c or t
actgcggatmactggccttaggcmrcgggcagcgagatgttgcgttccggtgtgggtgtgggtgtgcctccgacggcgtctcggtgccagtgtcgaggttctttctgcttagctacccggasccgactacggaggasgacacctgagtytacgtctcttccatctgctgctcgcctcagctgcctgggtccccgacgagagccaggtgacacttaactccgccatctgcgttttgagcactgttctcataatggagtyycctgatttggggaagcattgttcagaaaagacttgcaagcagct

SEQ ID NO: 23396 - DNA, 129 bp, Homo sapiens
attggtccgcgctgtcgggcttcggcggcttttctctttagcgctcagggcgctgacccactgctcttcctcttaagaaagtgctccattccttccggcgcccggagctgctggcccaaagggatcagt

SEQ ID NO: 23397 - DNA, 194 bp, Homo sapiens
  misc_feature 94: r=a or g
  misc_feature 178: v=a or c or g
  misc_feature 191: y=c or t
  misc_feature 192: y=c or t
gaatttgaagaagtaattaataacctttcaaaacagaaagccccaggcccagatgggtctgcagatgatttctactaaacatgtaaggagggarattatgccatttctctacaatctcttctagaagatagaagcagagggaatactacctaactaattctatgaggccagcattacvttaataccagacyyga

SEQ ID NO: 23398 - DNA, 190 bp, Homo sapiens
caagggcctgcttggcacataatagactttcattaagtatttgttgttgactgagttccttgttactgttccctttggaggagaaaaagaaacatgagtattagcagtcttcaatgtaccttgatgatgacaaaatagtttatccattagtgaacagtaagcagttcctgatgacttatatgcagaaaca

SEQ ID NO: 23399 - DNA, 391 bp, Homo sapiens
  misc_feature 255: n=a, g, c or t
caattgtttgttatactagtgatccaacatctgttaacaatgaggttctggcataccatctgtattagtccattctcatgctgctataaagaactgcctgagactgggtaatttacaaagaaaggaggtttaattgactcacagttctgtggggctggggacacctagaaaatttacaagtatggtagaaggggaagcaaacacatccttcttcacatgctggcaagagagagaatgagaaccaagtgaagcggnggagtcccttataaaaccatcaaatcttgtgaaaacttactcattatcatgagaatagcatgagggtaatcacccccatgattcaattatctcccactgggtcccacccatgacacttggggattatggaaactac

SEQ ID NO: 23400 - DNA, 110 bp, Homo sapiens
  misc_feature 56: r=a or g
  misc_feature 84: k=g or t
gatgtggaatgacaataccagccctggactacctacctgtaggctgtgtgtgtgtrtgtgtgattgacagagagagagagagakagataccacaagtaacacaaagcatc

SEQ ID NO: 23401 - DNA, 109 bp, Homo sapiens
  misc_feature 15: k=g or t
  misc_feature 16: r=a or g
ataaactacgtaagkrtgtctggcagaaaggcatagttagagaagtgttttaaaatattgcttaattaatggtttccaattggctgcctgcagatcaaagtaagacgcg

SEQ ID NO: 23402 - DNA, 427 bp, Homo sapiens
  misc_feature 11: y=c or t
  misc_feature 12: h=a or c or t
  misc_feature 391: h=a or c or t
  misc_feature 425: r=a or g
taagtttatayhtctgaatctgaaatcagaatatatatatttaatttttcaattttaaaaatgttaccctgtgtgagacaaaacaaaacagtgactagaaccctccttgtgggctaaatttgagtttgcttcttcataatgttttaaatgcttcacaaacatttttctttggtatattgagcaaaatgaattgaagtatatttactgagtgatgattattgaggaaaaactcaaagatctgctgtaagcactagagttgaaggactagcccaacagctcctcaggcacctttgggtatattgagttgccccccctgactttgaacacatctatggtctgtgtcatcttcaaagagctcatggaatttgaattccctgggttttgtttttghctttgttttggacggagctcgctctgttgccgarac

SEQ ID NO: 23403 - DNA, 181 bp, Homo sapiens
ctggtctttgaaggttttgtggaattcccatgtgaagtttgtgggcactattgctttttttgtagcaaatctttgatacttttctctgtttcttctatggaagtcaattttggaaaactgtatttacctagattttccatttcgccaaggttttcaaatttatcaaaagttatgcctagca

SEQ ID NO: 23404 - DNA, 306 bp, Homo sapiens
tgtaagcctaaaattagttcaaataaaaagtatttaaaaagaaatagaagtttcagaccaaaggatcagcatataccagggaaaggaagaatggacagcatgtgggaggtgctgtaagaactgcaatcagtacagtgtgtcgggagcctagggaacatgtgaggaaacattgtgagatgaggctgaagacatggactggagaactttataaaccatgttaaggaatttagattttatttttgggatgatagctataaagaattttatacatagattgatagttatacagtaactttgcaaaagacc

SEQ ID NO: 23405 - DNA, 362 bp, Homo sapiens
taataaatgcctgacgctgtgctctgtgcctcacaggtattaactaaattgtatcctgagagaaacctgtgaaaggtgtactgttgtttctatgttaaagatgaggagagtgaggcttaaggagagtaagtaatctggccaggccacttacctaagaagtggtggagttggactcacacccaaatagtctgatctccaaactttgcttgaccacatcctgtagcctcttggtttcatggcatagggctggatgctgtgtgctttgctagtcaattttagtaaagactttagacattgtttggtagtggactgggatcctcaggagttaatcacttttactgtttttaagttaccccgggagc

SEQ ID NO: 23406 - DNA, 205 bp, Homo sapiens
  misc_feature 11: k=g or t
  misc_feature 13: m=a or c
  misc_feature 65: b=c or g or t
  misc_feature 75: y=c or t
  misc_feature 77: w=a or t
  misc_feature 95: v=a or c or g
  misc_feature 109: w=a or t
  misc_feature 116: w=a or t
gatctttccakcmccaccccctttctctttctctctctctctcaaagaaaaaaaaaatgggagtbcaaaaaaaayawagccaaaaaatatatgavggatagctgttctwctgtgtwctctcattatggactttgtgaagtagaaacataattttttttcctccaaaggtgaaaaaacaatgcattcttgctttaaaaaaaaaaaa

SEQ ID NO: 23407 - DNA, 114 bp, Homo sapiens
ctcatatatgtaaggaaaaggaaagctccttttggttacttatcatggtttttaaagaagaaaggttggccgggcgcggtggctcacgcctgtaatcccagcactttgagaggc

SEQ ID NO: 23408 - DNA, 425 bp, Homo sapiens
gcggtgttgccatggggacgagcggctccggctgaaggtttccgtgcttggaaaccgcgcctccgcggaggtagccgttccctgacctagccatggcacagaacactgaaaaccacgaccctgtcggatccatcttaatccagatccatgaagacctttatcagttaaaggagaaattaacaaaattctcacctgaggaaaaaggagagactctagacattcagagtcttgaaacagcaatcaaaaggactgaagtggggttaagaccactttcactatacctcgggaaccacctccatctccagcagaagtgaagttctttcccaagaaacaaagatcaaaggggaaaaagcagaaggtcaagaggacatcatgataggaaggccatgaaagtcaaaacacctttgagagcctgaaatcactgt

SEQ ID NO: 23409 - DNA, 229 bp, Homo sapiens
  misc_feature 43: k=g or t
tagctgtctccactcataaaccaaaccaaaccaatacaaacakatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaaggggtt

SEQ ID NO: 23410 - DNA, 374 bp, Homo sapiens
aatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtagaacaaggaacactttagctacttcttactcttttaacaccaatggctgtgggagaaggaaaggctcaaggccagggctcagctcgcagagtccatcttctcccacagttgccacatttgaga

SEQ ID NO: 23411 - DNA, 255 bp, Homo sapiens
tatataacttgttagagattggaaaaactactcagactgtattctgtttttactgtaataacttagtgaaaattagctttgttgatgttttaatagataatttgaaaaatttagaaacctgtgtcttgaggctcccatttttgatgatttggtaggagactgacaggactcagcacatagttgtgttcacagctaagatttattacagccaaagggtacaaagcaaaatcagcgagaggcaaaggcacaccagca

SEQ ID NO: 23412 - DNA, 242 bp, Homo sapiens
tttgaacttggacttagataattgggtagatgaatggtaatgaatggttgtgccattcatttctattcgaatgtaggaagaacagagttggacgacacaggttcagatttgtatatattgagtttgagtttcctttggaacatccaaatggaaatgacagataggcagtgggtccctggtctcaacatcgtgaaagaaatttgatagtatcatacacagttgacaactgaagccatggacaa

SEQ ID NO: 23413 - DNA, 437 bp, Homo sapiens
  misc_feature 12: s=g or c
  misc_feature 321: y=c or t
  misc_feature 374: b=c or g or t
agagagagaggsagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtytgcatatcgctcaggccacctccaaaccccacctaggttttataatgtatatbatatatttttttgtgtatttttaaaatccagctgtgaatgggttatatcataaatgcagcttg

SEQ ID NO: 23414 - DNA, 416 bp, Homo sapiens
  misc_feature 12: s=g or c
  misc_feature 140: k=g or t
  misc_feature 141: w=a or t
ttttcctctggsaagctccgggcgcccaggcttgggcttcgtcgtggagcgtttgcgcggccagcttggggaagggtcgtttcaaggttgggcttggaggagagggcagtagccgagtcccctctgccctaaagaacgakwagaatcgtgttctatgcctggaggacagaggcagcccgtgcgggtcggacagcccactctgttctgccagtacttcgggaggttctggggtgcatagtgcacttttcccaacctgccctcagcttctggaggcagagagcagggccaggctgctgtcatgccgtttcacgatctgtttaatttttgacctacagtgccaggtttgggggcccgcctcgtgggtgggcattttggtagtcattcagccatttgagcaccagctacgtgtcggacac

SEQ ID NO: 23415 - DNA, 170 bp, Homo sapiens
cagttaatgtctctagtccttcctgtaaaggtgaaaataagcattgcgcatgtgcgcaacacacacgcacacgcacacacacacacacacacacacacacacacaaatcccagtgtctttttatgcatgtggtgagatgaaattgtgatctttgtgtgacctccagctgc

SEQ ID NO: 23416 - DNA, 399 bp, Homo sapiens
  misc_feature 106: k=g or t
  misc_feature 146: s=g or c
  misc_feature 148: w=a or t
  misc_feature 284: m=a or c
ataaggctggatttgtggatggtagcaatgacataggaaaaaaaaaaggggaaaatctgtgtaaatagctcattctagaagattggatatgaagagaaggcaagakatagggcaattaccagagggggcatgtggttgagaaagasawtattttattatggagagtttctggcacattgacatcttggtggaatttgccctagtaggcagagaacctcctgtagaagcagaaaggtggacaaggactcaagattgacatcttggagcagtaggaaaagattggmctaagaaaaaagtggacaaaaattaaccttggataggaatagagacacctttctcactgcaaataaggtgaaaagggaggaataaaggcaatgcaggtaagcctacagtgtcagt

SEQ ID NO: 23417 - DNA, 445 bp, Homo sapiens
  misc_feature 402: d=a or g or t
  misc_feature 416: n=a, g, c or t
  misc_feature 419: v=a or c or g
attttaatgtttttaaaataaaaaatacatagttatatctctataagataaactaataaattaatattagaaatttataggttcttcccatcttcaaatacggtaaaattactggaaacagataccgccttggctgtactatcattttagagattttacacacacaaaaaaacatattaccatgctttgagtaaagtattaccaggctttaagttgatctgttctctagctgcagttttcttctcctggagaaagtagtaaatcttccgagctcaatattattacctctacaatgggaagatttttatttttcaagaccaccagattaggataagagacttaatgcctaccaaatcagtcacattcctgttctataacatgttagatacatagagccctgtdttatgatgggaganacvaaagaattcctaatcatcttgtaatt

SEQ ID NO: 23418 - DNA, 178 bp, Homo sapiens
agcttggccgcgcagtgccggaacccggctgcagcggtgggaaggcgggggcgtgccggcccagcggggagaggcatctgcaggggctgctgagagtaaatacttggcgcctccagctgctggccaaggagacagatggagctcaagttgggagatacgccctgagagccgatgatag

SEQ ID NO: 23419 - DNA, 296 bp, Homo sapiens
  misc_feature 64: h=a or c or t
  misc_feature 211: w=a or t
  misc_feature 213: w=a or t
  misc_feature 221: r=a or g
  misc_feature 225: y=c or t
  misc_feature 231: y=c or t
  misc_feature 238: m=a or c
  misc_feature 239: y=c or t
  misc_feature 243: y=c or t
  misc_feature 247: m=a or c
  misc_feature 249: y=c or t
  misc_feature 256: w=a or t
  misc_feature 268: k=g or t
  misc_feature 271: k=g or t
  misc_feature 285: w=a or t
  misc_feature 291: m=a or c
ctgacctctggtgatctgccctcttctgtcggcctcccaaagtgctaggattacaggcgtgachactgtgcctggcctgtactcacaatacttctgacacccaatgtgtgggttttccacaccaagtaattcttaaatattttgcagccaccaaccagatgtcctagaatttaattaaattttaccactacccagagttagcacaggcccwawaggttaaragcycagtcytgcaagmytatytacmayttcagawatcaacggcaaktgktgggtccacatatwacccamaatgc

SEQ ID NO: 23420 - DNA, 114 bp, Homo sapiens
  misc_feature 10: k=g or t
ctcatatatktaaggaaaaggaaagctccttttggttacttatcatggtttttaaagaagaaaggttggccgggcgcggtggctcacgcctgtaatcccagcactttgagaggc

SEQ ID NO: 23421 - DNA, 170 bp, Homo sapiens
cagtggtgagaaagaggccagccatggaccaatgttgagaatgtggcacaagccaaggattatggtcaatccagtatattaaaattttaatatttctttaaaaagtttaaatctagtctctttcacaccttttcacacctgctttctcttctacagagtgagtgcaccca

SEQ ID NO: 23422 - DNA, 222 bp, Homo sapiens
gctgggaataaaatgctaaccaaaaaaaaaggtgaaagtagataaaatttctcaactgtgtgatgggtaaacgtgcaggtttgctgtcatgctttgtttatgaagctgtggggtacaaggactctcatagtcactgtggaatgcagaacgttgcagcctcatggaagaggatttggcagcatctaacaaaatgacatggcatttgcccttagactcagcaac

SEQ ID NO: 23423 - DNA, 149 bp, Homo sapiens
  misc_feature 17: w=a or t
  misc_feature 18: d=a or g or t
  misc_feature 19: y=c or t
  misc_feature 20: w=a or t
  misc_feature 132: s=g or c
aggtttgtaggcatgtwdywgcagaggacgtttacttctgtgcaatcactggactcagtctgtaggatatgcccttagataaactggccaaaaagtttttggaagagtcgaacgcggtggctcacgcctgtsattacagcagctctttt

SEQ ID NO: 23424 - DNA, 364 bp, Homo sapiens
  misc_feature 265: w=a or t
  misc_feature 270: w=a or t
  misc_feature 272: w=a or t
  misc_feature 275: w=a or t
ttaaatagatattcctctaaaatttaattttagtgataggatattcactttccctttcattcaggtaaattacctttggccaaactatagggaatgcttatataaatatgaattgtgtggctataattagtagtaaagtatccagcattttttgcattgattctagcttatgaatacagagactaattgaaatttgtatcaaaaccaaattggtgattatgatcactaatgtagattttttaaagtcattaatttggttaatttwttttwgwgtwcgagaagaatctgcatatctaagtgagcaaccagtacatatgtgtgtatgtatatatacaggcatgtacatccacaaatatatacaagt

SEQ ID NO: 23425 - DNA, 176 bp, Homo sapiens
aagttagaatttaaagcctatggttgttcagtaattgccctgaacttgagtgtgaagttaagcaagaagcaaataaacagacttgttaatttaaaaagaaatgacttaaaaaattacattttaaaggtaaaataatagtgaaattaagctttctatttcttgcaatgcccagccca

SEQ ID NO: 23426 - DNA, 218 bp, Homo sapiens
  misc_feature 15: s=g or c
gaaccgccttcaggstttggactcagtggaggttgtgagtgcccagcagtgtggcctgaatctccgtggggtttagggagacgaaaggaccccagatcgacgtcccctcgttcccactttggggatcggcgctctggctgtttcgtgaaggagagagaggtgggtctcttctggccccagtgagtgtggtgtcctgctccagggtgtcccggggcgtg

SEQ ID NO: 23427 - DNA, 82 bp, Homo sapiens
  misc_feature 58: y=c or t
acacagtgcaggcgcccaagccgccgccgccagatcggtgccgattcctgccctgccycgaccgccagcgcgaccatgtccc

SEQ ID NO: 23428 - DNA, 159 bp, Homo sapiens
  misc_feature 49: s=g or c
acctgggggatggctctgtcccgggcgcacttaggcgggctgtgcggasgctttaccttccacagtgtccggcacacgcatccttttcgacatcatcacttgacctgctgcaatagacaagtcttgctgtgttgcccaggccggagtgcagtggcgcaa

SEQ ID NO: 23429 - DNA, 375 bp, Homo sapiens
  misc_feature 13: y=c or t
  misc_feature 14: m=a or c
aagaaactctagymtgtacacaaggcaaaacacttcagctatcaaaatcatgacattatgtcacttggagcaacacagttgacccgccaaggcagcctcttcctccatagatggatgaacgctgtggccgctgctcctgcctgggccatgccctgatgctgccaacaccactgctcctctatttataagtcttagtagagttgctgacccagcaataactgaacagctgatatgtacctcacactaagccaggcgcttcatatgtatctaacttgaaaaatgctgagctagttaccttaacaccattaacttttacttaaaagtttgtttttcttttttaatcccagtgagctccaaacaagttttaggaggctc

SEQ ID NO: 23430 - DNA, 249 bp, Homo sapiens
  misc_feature 152: d=a or g or t
caaagacaaggtattaatagtaggattattcctagatcagaatgtttcatacattcctaaaggtttatgtggaaattggcttaggaaaactttgagtagcagagtctgaggatgagtgctagagatgaaatcaggacagatttgttgcagtdaattcttgccaagcaaattagtggtaaatgtcacattgttatgtgaattgagcacacatttttaaagaaagtttacaaaaaatttttagaaccaact

SEQ ID NO: 23431 - DNA, 140 bp, Homo sapiens
atttatgtaacactgatgctcctgttttgatgtgtatgaaccttaatctatgtgatatgtgactttgtgaacattgaattttttaattgagacctggggcaaggcatagttgtagctatttttatcctcttccctggcac

SEQ ID NO: 23432 - DNA, 134 bp, Homo sapiens
ctaagttatagggtacatgtgcacattgtgcaggttagttacatatgtatacatgtgccatgctggtgcgctgcacccactaatgtgtcatctagcattaggtatatctcccaatgctatccctccccccatat

SEQ ID NO: 23433 - DNA, 179 bp, Homo sapiens
  misc_feature 54: m=a or c
agccgccagcggcaacatggcgccctggacgctgtggcgctgctgccagcgcgmtcgtgggctgggtgccggtgctcttcatcaccttcgtggtcgtctggtcctactacgcgtacgtggtggagctctgcgtgtttactatttttggaaatgaagaaaatgttctacttgtccaattc

SEQ ID NO: 23434 - DNA, 125 bp, Homo sapiens
  misc_feature 4: r=a or g
accrttatgtaatggcctactttgtctcttttgatctttgttggtttaaagtctgttttatcagagactaggattgcaacccctgcctttttttgttttccatttgcttggtagatcttccatct

SEQ ID NO: 23435 - DNA, 295 bp, Homo sapiens
ttcaattttgcaagatgaaaatgttctggagatgttctacaacagtgtggatacagttaccactactgaactgcacacctaaaaatagttcagatgataaactttatgttaagaatttttttaccttaatttaaaatttttaaaagaccacatattgaattattccacttatatgaaatgtccagaattgggcaaatccatgaagacagaaagtggattggtgatttcctagggctggggaaaaggggaagtttggggtgattcctaatgagcatgaaggtttttgggaggagtc

SEQ ID NO: 23436 - DNA, 117 bp, Homo sapiens
  misc_feature 65: w=a or t
  misc_feature 67: w=a or t
  misc_feature 93: w=a or t
  misc_feature 94: w=a or t
  misc_feature 103: r=a or g
  misc_feature 104: w=a or t
tttagattctataaactccaagccctttcatacttttacatttgatgagaaagttagatttaggwgwcaaagagtagataataggtacatggwwgagggaggrwgaaaagagggatc

SEQ ID NO: 23437 - DNA, 257 bp, Homo sapiens
  misc_feature 217: k=g or t
  misc_feature 218: s=g or c
acttgccatttctgtaaataaccttattaccttcctgcaaattggaacttttgttccagaagccgcctagcttctggaaattctctttttcatcattattctgcacagtttaccaaaactaattgcacaataaaacctcaaaattccttgggtatcttgggacaatttatgtggcccttccactggaatggaaactcccaaagggaacctttttatksactgctatatcctcacaaactagaatagtgccctgcgaa

SEQ ID NO: 23438 - DNA, 393 bp, Homo sapiens
cttcttgtgtttgttttcaaatttgttgacaaagcttatcacatcctcttataatccttttaacctctgaagcatttatagtcatgtttctccttttcattcccataaatgcagtatttaattgcctggtgatttttaaattttttttgtagagtggggtcttgctctgtttccaggctggtcttgaactcctggcctcaagcaatcctcctgccttgggcctcccaaagtgctgggattatagacatgagccactgtgcctggccctatcccttgtttgtttttctctctttctttttttcttttttttaatgatgattcttgccagagatttgtcagttttattagtcttttctttctgtctttttctatcttttccccccagccccctat

SEQ ID NO: 23439 - DNA, 256 bp, Homo sapiens
  misc_feature 19: r=a or g
  misc_feature 20: r=a or g
gcagtttttctatagaaarrcattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagc

SEQ ID NO: 23440 - DNA, 275 bp, Homo sapiens
  misc_feature 145: s=g or c
tttattttaaaatgctttatctaaatcagtttttgtgaatagcctacccttctccagcctctcttctactgtcatataacttgttcctttttgataagctcctttgtaggccaaaagttttatgctatgtaaacataagtaagtsaagatgcttaagtgacgaactaggtacaaatgaataagagactacactcagatcagcagccaagtgcatcagcctggcagagcaagcacaacagtggcccttattgctgagggcctctctacagcccata

SEQ ID NO: 23441 - DNA, 230 bp, Homo sapiens
caagggtcattgaatgaatatatttcatatttccaggaaatatgttatttgattgttcatatgaaattgcattattagaatctgagtttgagtccagtccaaaaattgggaagtgctttttctcctagaactgccaatgattcaccagtggcactgtttggatgtggtcattaagatgccacatgtccccatctgtctactcctcccagtttaattttttaagtggcaca

SEQ ID NO: 23442 - DNA, 329 bp, Homo sapiens
agtaaaaagattagctggacatggtggtgcattcctgtagtcccagctgcttgggaggctgaggcaggagaatcactcgaaattggaaggtggaggtggcagtgagccaagatcgtgccactgcactccagcctgggcgacagagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcaa

SEQ ID NO: 23443 - DNA, 457 bp, Homo sapiens
  misc_feature 12: s=g or c
  misc_feature 344: k=g or t
ttttttatgttscatatttgggacaaagagctctcttaaatgaaagataattgcaagatccggttcagcagctttgtcccttgcctcaagtttactgcagggcttctctcctctctggttatacagaaatgaaattataaaccaccagtaaccttggaaatttcaatcgattccaaatgactaaatatttaattgaatcattgcctatacttccagggatgactctggcgtttgctttttattgagggctccatgaaagccaggctctgcaatggctgctggggactgtgtctgttgcaaggaggctcccctgcagtgaggagccggggcactgcaagtctgtkccatagcagccctttttgcaaatggtagttgatttttgcagaaggtttgtggccagatcgctatgtataatactgatgaagcatttttgtccagctctgtctcggaagaccta

SEQ ID NO: 23444 - DNA, 124 bp, Homo sapiens
aggcttatgtatataaactattaagtggagattgagagatgactaacaagttatttaaaacatgttattactacgaatacatcaaaacatctatagaaatgcaatgttaagaacacggaacctg

SEQ ID NO: 23445 - DNA, 492 bp, Homo sapiens
atagttttatctggacactgattattttgctggaaagcaagaaatcaggtccacacgaagaataccaaggagagaaacatatgttaactttaaaaaacaaacaaaaaatgtcaatttgtatattggtattcaagtgggagcgataaaccattaatacacatataagggatttcggagaaaatgttttggtagcagatttctgtccttggcatctgtgatggagggaggatgatttgcgagtcaactgtactgcggtagaaacaacattgggtttcatgttagtacatgtagtttcaaatccggggtctgctattcactgtttccatgaatttgatagtcactttcattcggaaacttcattttcacatgcataaaaagttgtataaatatcagtactttgtacaagaggccaattcaatgactgtcctggttttgcagggaaaatgaaccggcccgcacagcgatgagagagtctgtagtaacatgggcatt

SEQ ID NO: 23446 - DNA, 262 bp, Homo sapiens
  misc_feature 255: m=a or c
aggcggcaagaggcctcggcacccgcgaactcataaataccggggcggcgctggtggcgggagaggcgcgtgcgggcagccggcgcccccgaggcacctggataaccacccatcttgaaggagacctccctgccctgcctctgttgtcccccagagcactgcctgatcatcctctgttccccatcctcccagcccttcctgctgtacctgtggggagctgatctcctcagtccccctgcttttccccggtctgcmatcaccg

SEQ ID NO: 23447 - DNA, 143 bp, Homo sapiens
  misc_feature 15: m=a or c
  misc_feature 16: y=c or t
atttttattttagamyctcctattcttatttcatgaatgcaaagttttatctttctaaagatatcaattatagattttttttttaagacagtttcactcttgttgaccaggctggagtgcaatgatgcgatctcggctcacga

SEQ ID NO: 23448 - DNA, 353 bp, Homo sapiens
tagaattgctatctcttcctggtagaattgaaagcttttaaagtaatatgggagataaattgcaaaaattgcctgaattttccactcactcctccctgtagccacaccttttgcaatgtgacttggcagctcctcccagaatctcagctggattttaactcaccttggcctaaagaaaatgacagaagtgataaagtcctcagcctgagccttaagaaaccttaaacgcttccacattctctttgggatccctgcttctgccatgagaacagggctgggctagtttgatggaagatgagaagccacatggaaaagagctgaagtcttccctgacctgtgaataggccagcaga

SEQ ID NO: 23449 - DNA, 296 bp, Homo sapiens
cctaatcaatatttggataaaaagtgcaaaacacttgcttcacatttctctgcagatctttggccctcttcgtgcagtagtgaattgttttccaatgagtgttctcgagaaacaaccctgaattgtgcctcctcacgcacagttcagaggtgcttgggtgggaagctgcttctgctccgtgtggccctagaagactgatttaggggagttttacactcaactatagatgatttttctgagaattttaactgtttattatgcttcatttaagaaaacaaaaaataaatgattatgat

SEQ ID NO: 23450 - DNA, 181 bp, Homo sapiens
  misc_feature 27: w=a or t
  misc_feature 57: w=a or t
  misc_feature 178: n=a, g, c or t
ttagctctgttttgggacattttaaawtagaactatccttgttcgatagcataggawaatgttctggtgattgtcagggtctcctaatatttatctcaattcttttataagtctatggaaattatttaattattttaaaacgtacacacttttcttgtaaatatgtcacatctgagtncaa

SEQ ID NO: 23451 - DNA, 295 bp, Homo sapiens
caacaattggagatggttgaatacccttgaacaaagtgtgtatcttctcaaatcagtggttgcactagtcaataattagaaggtgttgttatttttaaaactataagcaaaattatgaaggcctttaaaaaatctatcataataatgaaaaagaggttgtctcccaacagtgctgtccctcaaagaaaagactggttatgtggaaacagcacgtttggagagattattctagtgaataacagtgtatatttgtggtaggcaaatttctaagaatgacccctactgacacccccgt

SEQ ID NO: 23452 - DNA, 128 bp, Homo sapiens
aaataagtgctgtctgtgatgtttggcaagcctggtttatatccatctacaaggtttgcgaacccatgttgccgatttttttttctgctacagaacaactcccttggtacaataaaaaaagacgagta

SEQ ID NO: 23453 - DNA, 464 bp, Homo sapiens
ttgatacttctaaggtgctttcaagcttagtcatacatagcccattttcgcatgttttcaacttaaaacagaaaactatgtcgtgtgtggctgggcgcggtggctcacgcctacaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcctgggtgatggagcgagactctatctcaaaaaaaaaattgtgcatgtaaaacatgaaattataacctgtgctctttggatacctaatgcgacatttaagttgtatttgacagtagatagtatt

SEQ ID NO: 23454 - DNA, 162 bp, Homo sapiens
  misc_feature 121: r=a or g
tcaaagaagagactttattaattcttaacatgtttaggactcttagaatttggggatataaacacagtgtctgtgttttgggctataagtgtgtattctttaattttgggtgatttggggraatttggttaaaaatgaataagtatttgtagtagtagcgct

SEQ ID NO: 23455 - DNA, 90 bp, Homo sapiens
tccacagcctgcggagaaggctcaccacgggaccttgtccctgcgctgaagggtgccttgttgtggctggagcagtcctggcctgagccc

SEQ ID NO: 23456 - DNA, 191 bp, Homo sapiens
  misc_feature 114: k=g or t
tcttatttgcatattctacatattaattcatcaaatatttaccaagccccttctcagtgccaggcactgttctagacattggggatacaggatgaagaagctggttgggatatktgccttccaggagcttacattccgctgtggggaagcgtgtaagaaacaaacaaagtaaccaatagccagaggaacca

SEQ ID NO: 23457 - DNA, 212 bp, Homo sapiens
  misc_feature 25: b=c or g or t
  misc_feature 212: w=a or t
aaagctgtggagggttaagagagtbttgtgcaagatcccttggatacatgtgtttttgggttctatagaatattgctttgggggtcatttagtaggaataaaaactgtctccaatttagcaacacctcaagttctcgcagcattaaatgatggaatgataataattgttagttaacatttttgagtgcttactacagtcttcacagccagtw

SEQ ID NO: 23458 - DNA, 187 bp, Homo sapiens
  misc_feature 21: n=a, g, c or t
  misc_feature 169: k=g or t
ataggaaaagtaatcaaaatnagggcatttaagaatggctatacagagtagcctaaggggccttatatttgaaatgtattctaatgttttaaaacctataaaccattgcataactatttcttattacctgtgctgtaaatatgaaaacttgcaaaatcagtgtaggaakatgatttaaggaagcaaa

SEQ ID NO: 23459 - DNA, 401 bp, Homo sapiens
  misc_feature 13: m=a or c
  misc_feature 128: m=a or c
  misc_feature 279: k=g or t
  misc_feature 372: w=a or t
cagttttgctggmcttcctttgtttgacactaccagctactccagatacagagagataaagagaggaaggaaggacaaaaggaaggaatgaattattctgatctctgttgactcctttattgtgagtmttgaaaaacttagctagagggcagagttcaaaactctttgtgggttaattttataatgtttatcaagcaagggtggcttcaagaagtgactgaatttgttacttaaatattgccaaaatgaatatcagctatggcaaaactaaaaccagtktctaaatggatagaactaaataaccctatgttatttagtcattgtgtacatttttcagaagactcataatgttggacttactggactacagtwctgcattaaaatcatgttctataagggac

SEQ ID NO: 23460 - DNA, 104 bp, Homo sapiens
ttatccttcagaccacctgtctctagtgtgtgacttcagctttactgaggaatctgatggactttcataaatacttgcttttgtctttttaatcacaggaatct

SEQ ID NO: 23461 - DNA, 225 bp, Homo sapiens
catagaaaatctaatgaaaactgcaaatatggaaattagacagttatgataccgtgtatacatatatatttagaattttttaacatatgcaggacagtaaattcatgattattaattagttttcagataggaaatgtgagctttaattaatttgtatttataaatatctacatttctttggtgtctgtatatgctgtatatgtcaagtttatgtttggggcagaa

SEQ ID NO: 23462 - DNA, 152 bp, Homo sapiens
caaagaagggaaagagactgaacttactcccaacaggtgaagttaagcacgtcctgtaagtgaattgatttgttgtataaatcaaagttctgttcatagggaccatcaacaatgttctctgacctggcacccttctgttcccccaccccaca

SEQ ID NO: 23463 - DNA, 305 bp, Homo sapiens
  misc_feature 94: k=g or t
  misc_feature 277: h=a or c or t
caaaccaaagcgtctgtccttgccaggaaaggcattccaaaggcagagagcatgccaagtaaaaaggctttgcttcaggattatggagacagtkctgaaaagccagcataacttaatgatcaatcagaaaaatatagagcagtaactacacaactgaaggatgcataaaaattgtacaaaacgttaatagtggaatggggaggtaggatgggattttacgggcaagtattaagctcttggaaagcttcatttgttgccctcaatccacacagcagahagaaagagaaagagacaaacatggtcca

SEQ ID NO: 23464 - DNA, 91 bp, Homo sapiens
tatatctacacgtgagcctggaatgtggacaccgcacacccactgaatgtacttccttgacagtctggtcactggtccctccctcccccca

SEQ ID NO: 23465 - DNA, 226 bp, Homo sapiens
gggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtcccctta

SEQ ID NO: 23466 - DNA, 408 bp, Homo sapiens
tgataattaaattgtgtaattggcccttacttgtgtcacagtactaacagtgaagtctagttggacttttctggaacttggtgcacatgtctatgagggtgcccaagtgtggggtaggcctcaagtgaggacttttacaaggccctaaccagagccttgcattctctttcctacccaccgcccagtggggctcctttaccagacaagtagagttgaccaccttcagctggggacctgacactcattactcactggtcctggtagcaggtgcaggcagaaccattcaagaagaaaaatcaatgaaaagcagaagtaaatgaataagaaagaaccggatctttgaaaagcaaagtgtgagaaatatatacttggtatatttaattgggggttgggaagaaaaaacctaga

SEQ ID NO: 23467 - DNA, 124 bp, Homo sapiens
  misc_feature 49: b=c or g or t
  misc_feature 50: h=a or c or t
atctaagcgtttatagttgtagatgaaggtctatgatccattgtgagtbhatttttgtatatagggtgagataaggctgtgaattcccattttttgcctgtggatatccaactgtgccagcaaa

SEQ ID NO: 23468 - DNA, 183 bp, Homo sapiens
  misc_feature 122: s=g or c
acgcatggccacgagagggcgggggaggagtgaagaggttgaggcgccccgcccagtcagcaaggttgcgcgtgccctgtgagaccgccaagatggtggtgggcgcgttccctatggcgaastgctatacttgggcatccggcaggtcagcaagccgcttgccaaccgtattaaggaggctgc

SEQ ID NO: 23469 - DNA, 221 bp, Homo sapiens
ctttagagttcacaccataggctaggagcagttctagatgctaagtactaaggtcacagtgattcacagttttaaatccaggtgactgacatgcattcatttttttcaagttaatatggaaacatgtattacaagactttgaatgtacacactctttgagtcctgtttttgtttattttatttgtggctagtatacagttaggcttatctccagggctgtc

SEQ ID NO: 23470 - DNA, 121 bp, Homo sapiens
atactaaacacacagaccagacaagctcctacgaaaagccaacgctccacgcccattttcgtcagggaatatgtacccatcggctttagataaataaggaaacagcaggctgaaccagaac

SEQ ID NO: 23471 - DNA, 165 bp, Homo sapiens
  misc_feature 2: r=a or g
  misc_feature 3: s=g or c
trsaataaataaatatgtccttccaagctgggtacagtggcacacacttgtctcagctacttgggaggctgaggagggagtattgcttgagcccaggtgtctggcctgggcaatacagcaagaccccatctctaattttttttaatacaatagaataagcccctc

SEQ ID NO: 23472 - DNA, 251 bp, Homo sapiens
  misc_feature 7: s=g or c
  misc_feature 26: k=g or t
  misc_feature 28: w=a or t
aaggagsattcccctgtggtgagctkgwggttgtagcctgaagatggcacagctctgtgattcatctcctgcggttgtggcggccacggtgatggagactgcagctcaacaggagtggtaggagggtacccgtggaggccaagtagtaggagccttggagggtgggtaggtgcatggagggtgacagcagcgctggttccgttggcgtcggcgctaatggtggcagcagcagcaagtctaggggccaggaa

SEQ ID NO: 23473 - DNA, 307 bp, Homo sapiens
aatactattgccaacatggctgctgcagcacagattcacagtccactctccagagctggtacctctgttataaaggagcggatcccagagagtccttctcctgctccttctctagaagagaatcatcgtcctgggagccagacctcttcccacaccagcagcagtgtgtccagctctccctctcagatggatcatcatttggaaagaatggaagaggtaccagttcaaattccaataatgaagtcacccttggacaagatacagctgactcctgggcaggcattgcccgctggattccctggaccat

SEQ ID NO: 23474 - DNA, 230 bp, Homo sapiens
tctagcaatgctatttgtttttttaaaatgagttaagtgtgaacagacaaaaagcatatgccacacaagtgtatgtattgtagataatggttgtgattatggcaataacatgctcccatagaatatattcttcctaacaatatttcttgttacagcctttcacctgtaattcatagttctgttatattgcaactgcttttggcttttgaattgtttataccagcaactgt

SEQ ID NO: 23475 - DNA, 98 bp, Homo sapiens
  misc_feature 10: w=a or t
  misc_feature 80: k=g or t
tagtggctgwactagtttacattcccaccaacagtatgtaagagttcccttttctatgcattcttaccagcatctcattktttttcttttcttttttt

SEQ ID NO: 23476 - DNA, 208 bp, Homo sapiens
aaatgcatgtttccagcccctctttaggacattatgcacctgaaccagaactcttggttctccccttcactctctgcctggtaactcaccttgggttcccctatcacagtaaataatgccatttttgatccgattgttcaggcttagaaatcttggtttggatgagaaaacaatgagggtgtccttgcctcctctctcccagcgctcg

SEQ ID NO: 23477 - DNA, 297 bp, Homo sapiens
tacccaggcgtcatggctcacgcttataatcccagcacttcgggaggccgaggcaggtggatcacaaggtcaggagattgagaccagcctcactaacgtggtgaaaccccgtctgtactgaaaatacgaaaaattagttgggtgtggtggccggcacctgtggtcccggctatttgggaggctgaggcgggagaatggctttagcccgggaggaggagcttgcagtgagctgagattgtgccactgcaccccagcctgggcgacagagcgagactcagtcaaaaaaaaaaaaaaaaa

SEQ ID NO: 23478 - DNA, 159 bp, Homo sapiens
tgtaagaaagtcagacctgcttggtggtatgtggattgtggatcttggatctcgaagtgagaacctgtgataggttaccattgagaggatgagtagatttcaggagagacagtatcatgattggaatagaaaattatggttatttaatagcaggcaaga

SEQ ID NO: 23479 - DNA, 220 bp, Homo sapiens
  misc_feature 7: m=a or c
  misc_feature 8: v=a or c or g
  misc_feature 29: r=a or g
  misc_feature 30: m=a or c
  misc_feature 51: w=a or t
ttatttmvttacttaaagtcttctgccarmtcaactctgtaatttttcttwttttacatgacaccaattttggtcatttcttattaaccccaaaacaccattgaacattgggccacaatgaaaccttcatgactggctctttctgaccatctagtcagaagaaaacaggaccatattggcataatcaccttccccactcctctttttacccacctgctct

SEQ ID NO: 23480 - DNA, 337 bp, Homo sapiens
actaatagttaaacttattgaaagaaatgtaatcaactcatattcaatacattatgcattgtttttttctttcataactcattaacttgctaatggccattttactgcttattttcaggggtaagaagctgtgtggatttttgttctgtttgcttttgagaactaagctctgatttttttcatcttgcccaaattcctacttaagaggtctgggaagtcatgtcctacaaatcataaattctcatcacatggattttatttaacactgtatgtcataacttaatttccaatctgactctggtataaccaggaagaaatcaaaatgttttaccccaat

SEQ ID NO: 23481 - DNA, 104 bp, Homo sapiens
tagtggctgtactagtttacattcccaccaacagtatgtaagagttcccttttctatgcattcttaccagcatctcattttttttcttttcttttttttttttt

SEQ ID NO: 23482 - DNA, 91 bp, Homo sapiens
cactcatgccacttactccattctggaccctccttcagtcaaatgttcctgtgcttcaacctccattacccttggaaatgccaccacccgt

SEQ ID NO: 23483 - DNA, 220 bp, Homo sapiens
  misc_feature 8: k=g or t
  misc_feature 9: y=c or t
  misc_feature 106: s=g or c
  misc_feature 175: s=g or c
  misc_feature 176: r=a or g
  misc_feature 177: k=g or t
cgagctgkyctgtgactcccaggaagacgtggacagctggaaggcctcgttcctccgagctggcgtctaccccgagaaggaccaggtgaggagccgtcctgcgcascaggcccagagcccccacctgggagaggaagcagggctggctttccccaggacaggtcattttcaggcsrkgttagccaggagtctctgaaatcatgtagcagatgcccactcg

SEQ ID NO: 23484 - DNA, 63 bp, Homo sapiens
gttcttagtactctccccggtgacgtgcctgaccgaggccgcgccagggcgctgttgctgcca

SEQ ID NO: 23485 - DNA, 163 bp, Homo sapiens
agtgattctcagcgactatgcgttggagctcaccccaattcgagtgttgagttaatttgccgtaggtgttctggagaacgcatcttgcagagctaaaagcataagcaactgagcaaatatgaattttataaactagcacgatttccttagccaagaccaggaa

SEQ ID NO: 23486 - DNA, 86 bp, Homo sapiens
aaacacagaaagatcacatataacataaaatgtacagaaaaagacaactctagagacacaaagtcgactgagtagtgggtgcctgg

SEQ ID NO: 23487 - DNA, 78 bp, Homo sapiens
cacagttactattgataaactacttttgggttttatttcattgaggcactttttttattgtttgaatgattccggctt

SEQ ID NO: 23488 - DNA, 298 bp, Homo sapiens
acagcactaggaggtgaggagtcatggaaaacaaaaatcaatgacacctgccagagaccccactgcctgctgtggggagacagacaaaccaatacaaaatcatgatgcaatggcccaatgcttcaccatggtgaaaggcacctagcccagttttgagggtcgggaaggttgcctagaggaggtgatatgtaagctgagatctaaagggtgaggaggaattcacttgttgaagataggaggagtacaattgaaaatgaggcccagaggttggggagatcctggctgttcagagagccaa

SEQ ID NO: 23489 - DNA, 154 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatga

SEQ ID NO: 23490 - DNA, 189 bp, Homo sapiens
aaaaggtaaacttgataaaagtgacatgtaagacaagaaggggtggtcagaattaaagaatgttatggtttaagtcaaacatgcttgtaaagtatgtgaaagaaatggaatatgtaatttttaaataaattgaggggtaaaagtaaatacagaaaatttaagcaagtaaattagaaggtaggaggtgca

SEQ ID NO: 23491 - DNA, 399 bp, Homo sapiens
atacacttcctgtcttctccaaatttttcaagcatcttctcaacgcccaccatccggagctattttttttctgaattatttcaattaagagtgctttgtcctagctttgaacatttttcatcaaaaagggaacattttcaaaaatgagaatagtatcctatgcctctccttggcataggataggcacttctaaaaagtaaaagacatctgacttttacatagtggtttgccccgtattgtagaatcctttgtgaagtaaattgttccagggatggtggctgcatttctacaccaacagctcaatggcattgaaggaacaaggtagggcaagattccttgccttggagacctacttctgagaccattcttgtgaaaaattgcattttctttgctttcaga

SEQ ID NO: 23492 - DNA, 166 bp, Homo sapiens
cctttttttaaagtgtattacctggagcaagctctgaagccctgggcaggaggagctgcacagcctgcgggccatgcagtgcctgttgatctctaaacacaccaggatgtgcgcaagatcctgtagtgcccccagtgcacaggtgagcagttgtgtgcccaggcaa

SEQ ID NO: 23493 - DNA, 207 bp, Homo sapiens
ttaaagagatacaaaaatatctttttatctatgtaaaggcaaaataaaggctttcagaggaaaaaaaaagctgaggtaattagtcaatggtacatttgtatttcagaattattaacgtttttcaggcaaaagaaaaatggtatcagatataaacttagaactacaaaatggattgaagaacatcagacatagtaaattggtggtgaa

SEQ ID NO: 23494 - DNA, 282 bp, Homo sapiens
attttgtaaaagacggcccagccagcatctccctccctgagagggcggtgtgtgctgctgaaactctgattacaactgctcttaggatgaagtgactggagcccagataccttatttagcaatcagtgctcggcacaaggacttgctgtgccaacgaaaaggaagcgaggcattttggctagtcaccgcgtttttgctgcgtcacagggagacagaagatgggctgctatttcgtcggctaaatgctatcattttaagcaccgttccaaagaaaacagggac

SEQ ID NO: 23495 - DNA, 372 bp, Homo sapiens
  misc_feature 220: s=g or c
  misc_feature 258: h=a or c or t
  misc_feature 259: n=a, g, c or t
cataattttataatattatttgtatgtcttcggtctcctttgagcgctatgcatcacttgccaaaccccaccttgaccttgacctttaaacgcccggtccgcccaccctgggcccaccaggtagcgttttcagctcctcaggctgtcaaaggtgctggtctgctccggcctcgacgcaggactgcaggggctgcttttctgcctccttcggcagcgtcastctctcttgtgctctctccactgtgacctcgattccghnctggcactccgcccatcccctgcccctcagcttcccgcggcctttctgccgtcagaccgcgtgggttgcacttcttagctgtcaggatttatttgttgtgccctgtgagcccc

SEQ ID NO: 23496 - DNA, 361 bp, Homo sapiens
cttctggggaatgagaggcaagattaaggccagtaagaacaggtattcctgaaagcatttgccagctcacctcacttctgctgcattcacaagccatgtggcctcttgctgtgtggttgaggagtgatccaaggtagctgtgtccccatgagttgtccacagttgcctctgtccatagaagaggccaacatgtgcttgctctcacaagaacaatgctttttgctgtcctgaggcttggcttgaatctgcttttccttcctcactgaaggtttcgtacacttccctgtgattaggtgttcatgatctctgttgatgaataatgttagaagtggagactggcgcatgctcagaatggacccta

SEQ ID NO: 23497 - DNA, 200 bp, Homo sapiens
tagaagttgtattgtttttggatttattgctgccatctttctctattttttaatttattttactttgggtctttcttccttcttttctacttcccattggatagatcaagtcgccttctggttccaaagttaatggcattgatttttgttactatggtagtggcttataacctaatatctaagtttatttacccctgttg

SEQ ID NO: 23498 - DNA, 113 bp, Homo sapiens
catgtgatgtctctccccaaagtcatcatgggttttggatttgttttgaatatttttttctttttttcttttccctcctttatgacctttgggacattgggaatacccagcca

SEQ ID NO: 23499 - DNA, 158 bp, Homo sapiens
cttcgagttcattttttttcattctgcctattctggcatcagctcacttgaggagtccctcagccttcttgtatttaaggcatcgtcttagactttgtgactctaaagtacctgtctgttgagatttcaagtctcttgtcaccatcctcacacataac

SEQ ID NO: 23500 - DNA, 240 bp, Homo sapiens
tcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtggggtggg

SEQ ID NO: 23501 - DNA, 205 bp, Homo sapiens
tccggaacataactacttataatgcttaggtcttatttctttggaaaataagttacttattccagaagccttagaaggaattctgaaaattcttctaactggccattaagagtaaggaagttgaatggtactgctgaagatctgagttgactcactgaaattttattttcttatttttttaacattaaaattatttctttttggc

SEQ ID NO: 23502 - DNA, 239 bp, Homo sapiens
  misc_feature 18: w=a or t
  misc_feature 66: r=a or g
ccattaataaggactggwtaaacagtttatagtttattcactatatgtaattttataagttaccaraatcatagacttactgtaaaatgatttttcaattagtaacttttcaccataacttttttggggtaatttataccactttttcgatgactcttcttgtttatgctttcacctgaaaacatacaaactaaatataatctaaaaataatattttttattttagacaagaacacgat

SEQ ID NO: 23503 - DNA, 102 bp, Homo sapiens
  misc_feature 24: b=c or g or t
  misc_feature 100: d=a or g or t
  misc_feature 102: r=a or g
cgcctggtctcgtcaaggcctgtbctgtgtatatcctcccccgaaatcatttcgtttgggaaacaggagggagactgagcagtagaaggaagcggagaadgr

SEQ ID NO: 23504 - DNA, 81 bp, Homo sapiens
cattgagtatgttaccccatccaagaaattctattttaaaaaaagaaaggaaaactaatgtaaccatttgtcgaagcagtc

SEQ ID NO: 23505 - DNA, 228 bp, Homo sapiens
  misc_feature 116: m=a or c
  misc_feature 130: s=g or c
  misc_feature 211: y=c or t
attctcctgcctcagcctcccgagtagctgggactacaggcgcccgccactgcgcccggctaattttttgtatttttagtagagagggggtttcaccgtggtctcgatctcctgamctcgtgatccgccsgcctcggcctcccaaagtgctgggattacaggcgtgagccaccgcgcccggccagttcaatggattttaaaaattattatyctctagaaaaaagacgt

SEQ ID NO: 23506 - DNA, 167 bp, Homo sapiens
attaaattttgatgtaatccaaaatatttcggttgtttgtgttctttgttatcctgtctatttttgttgttgttgttttatagatatgggggtctcactacgttgcccaggctggtcttgatctcctgaactcaagtgatcctcccacctcagcctcccatccaaat

SEQ ID NO: 23507 - DNA, 458 bp, Homo sapiens
  misc_feature 322: y=c or t
  misc_feature 330: w=a or t
  misc_feature 333: r=a or g
  misc_feature 335: w=a or t
  misc_feature 356: s=g or c
  misc_feature 433: s=g or c
  misc_feature 438: m=a or c
ttagtattaaccactattgaaccttacctagagtgagcctgagtcccagtgttgctgacaacattggtagcctccccatcacagatgactcaagttttatttttcaatccatataactgtttccagatcatacctaagtacagtgggatttcttagcctctctcgcatttgacccttgtgggtgcagaagaataggggctcagatttacatgatagaacagttcttcagttccagtgttagattttctcttaaataaatgtgtaggtggaagggaatctaaagcctctttgatgctacccattctggttccctttatccatyatcttgawagrawaatctacagtgaagttacctscaattccttttaggttaggattttaaacaagaagatggattttagcaagttcagtccagatgtggttccaaggatascatcmaacattcggctgggggcgga

SEQ ID NO: 23508 - DNA, 196 bp, Homo sapiens
tatatgaatttatctttatgtgagaaataatcttttttgtaagttaaaggttaaagaccctgcttgtttcctaaatcagagggttagagctgttgaaattaaacctttatagtgcttaacctggaaacaaatgtactacagccccactgaagccgctctatgggttttttgcttacgatgttttagcaacaggctt

SEQ ID NO: 23509 - DNA, 333 bp, Homo sapiens
  misc_feature 252: n=a, g, c or t
tcatgaataaaaccccacattgtaagcagaaacttaacagtctctaagtaaaattctgtttgtcaataggtctgagtactccaggcaatgatgactctcatgatcaccttcacctggatgtgtttccagagatcaaagaactatcagacacagtctctgtcctgaagaatctgattatctttatacaatgacagagttatacattgagaaacataatgaatggtttaaaaaaatgctagaacacatttccanagtaaatgctcatttttagcacagaatcttttaaagaccttacaatcaaatttatatcacattagtccatttcaacgccca

SEQ ID NO: 23510 - DNA, 277 bp, Homo sapiens
cattattttctgtatctttcacttggcatgtaacacatacttcttcagagctccttatctttggagatgtatttgtcctgtttcttcaagttggactgtaaactccttaaaagtcaggactttgaatcttgatctcttcccatctcctgttggggctttacctaagaaatattttgtaactctttttctgtttttaaaagcatttgtgtagtagacacattcattatggtgcttggtctttaaataatttttcgaaactaaaacttgaggcatagaa

SEQ ID NO: 23511 - DNA, 205 bp, Homo sapiens
taaaatctgctcagtggaggtgatgcattaattcattcatgtatttacttatctggtgaatgtgtactgcgtgcatatcatgtaactaactgagaataggttctgaggatacagcaatgagaaataccatcaaagtccctaccatcatagacatataagggagaatagtagtcaacaaatgtgcacacaaattacttagcggtta

SEQ ID NO: 23512 - DNA, 260 bp, Homo sapiens
  misc_feature 4: s=g or c
  misc_feature 48: w=a or t
  misc_feature 49: y=c or t
  misc_feature 147: r=a or g
  misc_feature 180: r=a or g
  misc_feature 181: s=g or c
acasatgatttttgataagagtgccaagaccattcagtagggaaagawyaatcttttcaacaaatggtgttgggaaaactggatatctacatgcaaaaaaatgaagttggaccttttccttacatcatatacaaaaattaactcagraatagatcaaatacctaaacataagagctaaarstataaaactcttagaagacaacataggggataagcttcacaacattggatttggcagtggtttcttggatatgaccacc

SEQ ID NO: 23513 - DNA, 275 bp, Homo sapiens
cattttttaggtctattagtaattgttttataaatttggggactccagtgttatgtgcatatatgtttaggattgtggtattttcctgttggacaaggccttttaccattatttaatgtccctctttgtcttttttaactgccattgctttaacgtttgttttgtctgacataagaatagctacccctgctcacttttggtgtccatttacatgaaatgcctttttccactcctttactttaagtttatatgattccttgtgtgttatgtgagtc

SEQ ID NO: 23514 - DNA, 177 bp, Homo sapiens
  misc_feature 137: s=g or c
accagcgacacggtagagtcagtcatagagtctgctttggatgacctggacctgaatgagtttggcgtggccgccctggagaagactttcgataacagcacagtgccccacccaggaagcatcaccatcggcggcasttgctgcagagctctgcgcccgtgaacatccccggctcct

SEQ ID NO: 23515 - DNA, 147 bp, Homo sapiens
  misc_feature 12: y=c or t
  misc_feature 103: k=g or t
  misc_feature 104: s=g or c
  misc_feature 105: r=a or g
ttaaaagatgtyaattttctaggtttaaattttgtagtatattggcaaaaaatagacaatcaacctggactttttttttagggaagagttaaaggaaaccacksrtgctaagcaatgtgcttcaaaatatgattctttgggaaaaca

SEQ ID NO: 23516 - DNA, 144 bp, Homo sapiens
catatagattggaaaagaaggaataagaccccatatttgcagattacatgattgtgtacatagaagatcccaaggcatccacaaaaaaactcctagaactaataagtaagtttagcagggttacaagatacaagataacacact

SEQ ID NO: 23517 - DNA, 95 bp, Homo sapiens
  misc_feature 84: m=a or c
ccttctttccttgcctccctccctccctccttctttcccttcctttctccttccccttccccttccttctcccctccccttccmttccctcccca

SEQ ID NO: 23518 - DNA, 189 bp, Homo sapiens
taccaaagatcactggaaggcccagtcctaatgttaggggtttgtttaaagtcctttttattttacaatacagagccccagtcaattccacaatctcaatttcatacatgggaattttatttaaaaatctgtggtttggggctttaatgaattggcctgtgaaaatgagctctaaatttcctcccacct

SEQ ID NO: 23519 - DNA, 181 bp, Homo sapiens
ctacttcccgcgggtgttgacccctactgtcgcgggctcggcggtgcttttcggggactcgttctgcatgccttaccgggtagggcaggttagtggttccgctccgagagtcaggaaaaaagctccaaacaagcgagactgagagaccagtagctggctttagaccagttttagccgacgg

SEQ ID NO: 23520 - DNA, 92 bp, Homo sapiens
  misc_feature 39: k=g or t
  misc_feature 44: d=a or g or t
  misc_feature 45: k=g or t
  misc_feature 54: k=g or t
  misc_feature 57: k=g or t
  misc_feature 63: k=g or t
  misc_feature 66: k=g or t
  misc_feature 85: m=a or c
  misc_feature 87: y=c or t
attaaggagccacaatttccactgttttttttttgtttkgtttdkgtttttgtkttkgttttkgtkttttttgagactgagtctmaytctgt

SEQ ID NO: 23521 - DNA, 242 bp, Homo sapiens
ggaatacctggatagcttggagaaggagctagtaaagggaggggctgtgcaagtagcagattgcaattattcttgagggtaaaaaaatctcttggaactgtaaaaacggagtcactctgctggcaggattgcaggcattaattccaagccttttcaaggtgattgatattttggggcaagagggagagcttccaagaagtaagtctatgtgggcaactttctgctgtacctgaagaagaggc

SEQ ID NO: 23522 - DNA, 199 bp, Homo sapiens
  misc_feature 12: m=a or c
gttacaatcaamaaggatgcctagatttctgtgttaatatttcatgtgtaggcaaattgctaccaatgcttaaaaagagtttgaagcccacaattttaatgtcattttaaaacattaaacttttaattttgtgataattatagagttgcatatggttgtaagaaataatagagaaattctatgtatttttacccagtga

SEQ ID NO: 23523 - DNA, 243 bp, Homo sapiens
  misc_feature 12: v=a or c or g
  misc_feature 13: y=c or t
  misc_feature 98: k=g or t
cacatcagctgvyttagaatacttatgtagatagcggttggggtcgggggggtgcggaatgttcttttcagcttctttgccctgagaactttgatctkattgcaaggaagtcccttaccctcttctaccctagatctgatggacctcctgggatttcctggggcagaagcgggccaagctgaggcgagtgcataagaatctgattcctcagggcatcgtgaagctggatcacccccgcatcca

SEQ ID NO: 23524 - DNA, 160 bp, Homo sapiens
ttttgtccactgagtttggctctttgagtttgagaatttacaaaaaaaaatgttctttcctataattgttatattgtttggagagagggagaaaatatgtgtatatggtcaatgcgctattacctctaatagaattgttattctatatttcacctataat

SEQ ID NO: 23525 - DNA, 260 bp, Homo sapiens
  misc_feature 25: r=a or g
  misc_feature 120: w=a or t
tacatcggcttcctgaattaaccartttatctttatatagtgacctactttgtctcttcctatagtcttcgatttgtaatctattttatatgatgtaagtatagctacttctactctttwttgttttccagttgcatagactatattttccccaccccttcactttcagtctatgtgtatctttgtaggagaagtgggttccttgtaggcagcatatagttgggtcttatttctttgtccattcagccactttatgcctt

SEQ ID NO: 23526 - DNA, 184 bp, Homo sapiens
ttcccttccctccttccttctttccttgcttccattttttttgagacagagccttgctctgtcacccaggctggagtgctgtggcgcaatctcagctcactgcatcctccacttcccgggttcaggcgattctcctgcctcggcctctggagtagccgagaatgcaggcacccaccaccacgaa

SEQ ID NO: 23527 - DNA, 203 bp, Homo sapiens
  misc_feature 49: y=c or t
  misc_feature 178: w=a or t
  misc_feature 179: k=g or t
agaggacagtttgaaggaggagatcaggctggaagaagctgttaaagayagctaggcctgaggtgatgggggtctgtactagaactgtggcagaggcataggacaggggacaagtgacattgaagtgctagacttggcatagcctagtaagtgattggacatggaaggcaaaacagawkggggaagacaactggaaggagcac

SEQ ID NO: 23528 - DNA, 341 bp, Homo sapiens
  misc_feature 122: w=a or t
ggttgttctaactctacacattaagtattcaatttatctcactctacttgctccaattccattcccaccaacttcctaattattttttgtttgcagtgtaggtgtgctaccaaaaaagagcwtgttggtcactactttatgatattaataactgtatctcattatatgtttgttataaactagacaagtgccattctgatttacctatgagtttcatgagcttggtattttttgtctccgcttaaggaatagtgctgacaaactccatttctgagcctacttgattgggtaccagccaaaagcccattgtaaatttgccagagctaccttctgaagacccc

SEQ ID NO: 23529 - DNA, 117 bp, Homo sapiens
agttttcaaataggagtctttttctgcaatttgtttgcattttttagaagtgcaaacagtaagtaaataaaagccttcggtaataatcatgacaatacaagaggctgagctaggccc

SEQ ID NO: 23530 - DNA, 418 bp, Homo sapiens
  misc_feature 139: m=a or c
  misc_feature 140: w=a or t
  misc_feature 373: m=a or c
  misc_feature 377: b=c or g or t
  misc_feature 401: m=a or c
gttttttgcgataaagtcttgctcttgtcccccaggctggagtgcaatggtgcaatctccgcttactgcaacctctgcctcccaggttcaggcgattctcctgcctcagcctcccaagtagctgggattaacagattcmwgccagcaagcctggcttatttttgtacttttagtagagacggggtttcaccatgttggccaggctggtctcaaactcctgacctcaggtggaaccacatttctacaaaaatacaaaaattaaccaggcatgatggcgggtgcctttaatcccagctacttgggaggttgaggtgggagaatcgcttgaacctgggaggcaggggattgcagtgagccgagattgcaccattgmactbcaagcctgggcgacagagcgagamtctgcctaaaaaaataa

SEQ ID NO: 23531 - DNA, 327 bp, Homo sapiens
  misc_feature 148: r=a or g
  misc_feature 151: d=a or g or t
  misc_feature 311: r=a or g
agaaagtcacacatcttgtaaattctcatttgtttaaaagaaatcatagaaaacacatgtcttctggagatgacttttagaaatggagttgttaagacggcctctggaagcgatacgtccacgtttgttaagtgggttagatgacatrgadgtggaagacctgagaaggaagagaagaaggttctgtgctagactggtcatatttagaagacattttcatattctatccattgttttgtgtgcattttattcttcactactgtgtatatagttgacaatgctaagcttttttgaaatgtctattctttttrgatgttctgaagtgct

SEQ ID NO: 23532 - DNA, 151 bp, Homo sapiens
aatttcttaggtaatttgagggaaaggattttgttgttgttgttgttgttctgagacagagtctcactctgtcgcccaggctagagtgcagtggcacgatctcagctcactgcaacaacaacaacaaaatcctttccccaaaggcatccca

SEQ ID NO: 23533 - DNA, 187 bp, Homo sapiens
caggattactttaaaccatttgactttcgctccaaagttatgttggtagtatagcaaattatgatgaatagctttaattgtatgtttaaaagtctcatatgttcacatgcttaaatctgggtatcagaatttaagcaattcttgaaatgtattgtctccttaatatactaattacaaagcatctcca

SEQ ID NO: 23534 - DNA, 205 bp, Homo sapiens
tagctacttctccagtgcagtataaattgtaacataaaactttatgtgatataggaatagtgtcaatgacacagtttaaagacctctatattcacaattatatccagagcataattttccatggccatagtttgagccacagagaaagccaatgaaatagattcctacttttatttaatgccaagagttttcactagccccacta

SEQ ID NO: 23535 - DNA, 321 bp, Homo sapiens
  misc_feature 12: s=g or c
  misc_feature 305: w=a or t
gacgataaggasgagaagaacccaggagcagtgacggcccggcgacctcagcatccgcgcacttcagcacggtatgagcatgcccccaccggaatgtctaaatacagcatgaaatgcaataatgcttatttctatgaaatatatgaaatattagctgaaaggcaaagacgactagacagaggagatgagatgaaaggactctctggaggaaaggactctctggcctgctcattccctctgagtcacaaaatgcaatgaaaatcagaaccatttcagtctatgccgcactgaggatcttacagagwatcactgtcagaagcg

SEQ ID NO: 23536 - DNA, 471 bp, Homo sapiens
  misc_feature 282: w=a or t
  misc_feature 304: w=a or t
  misc_feature 366: r=a or g
  misc_feature 378: w=a or t
  misc_feature 423: w=a or t
  misc_feature 425: r=a or g
  misc_feature 448: w=a or t
caatagatgcagaaaaggccttcaataaaattcaacaccacttcacactaaaaactctcaataaactatgtattgatgaaatgtatctcaaaataataagagctatttatgacaaacccacagccaatatcatactgaatgggcacaagctggaggcattccctttgaaaaccggcacaagacaaggatgccctctctcaccactcctattcaacatagtgttggaagttctggccagggcaatcgggcaggagaaagaaataaagggtattcaattaggawaagaggaagtcaaattgtcccwtttgcagatgacatgattgtatatttagaaaaccccatcgtctcagcccaaaatctccttargctgataagcawcttcagcaaagtctcatgatacaaaatcaatgtgcaaaaatcacwarcattcttatacaccaataacagwcaaagagccaaatcatgagtgac

SEQ ID NO: 23537 - DNA, 76 bp, Homo sapiens
gaagactggaacgagatgagctcatagcaccagcctgtcttttgtggacccgcacaatgatccctgagccaggacg

SEQ ID NO: 23538 - DNA, 227 bp, Homo sapiens
ataaaagatgcttgtttttttaaaagtgcgtttttcgctggagatactttgagagtttctgtaggatgactattaggagcatttattagattttcccagttggtattttattattaaaatctgtctattacgagtagactcacagtttgtggcacacttttcaaataaatagattaaaaacaacctttagtttgtaacaaaaaaattcatgttaaatttggcaacag

SEQ ID NO: 23539 - DNA, 93 bp, Homo sapiens
ttagacttgagaatggtgtttttagctaatgatgaaacatctaagtggagatgtctcataaacatttgacaatgtgggaatgaagaacaaccg

SEQ ID NO: 23540 - DNA, 55 bp, Homo sapiens
atatgtttagtgacaaatcatataaaaccattcacaagttttggttttttttttt

SEQ ID NO: 23541 - DNA, 145 bp, Homo sapiens
  misc_feature 61: s=g or c
tttctttggttctcagtttccccagagaataggaatctagtaagtaacccagtaagcgcasagcgtttgctgagtgcttgcgcggaccgtatattgcagtcctcagagcacagccccagccccagcccccttccgctccggtccc

SEQ ID NO: 23542 - DNA, 133 bp, Homo sapiens
catcttttatgtatttaaagtaatccatactatgatttggtttttccctgcaccattaattctggcatcagatcagtttttgtgttgtgaagttctactgtggtttgacccaagaccacaaccatgagcccct

SEQ ID NO: 23543 - DNA, 132 bp, Homo sapiens
attctgaatgctttgctagcaaaacactgtggtgtgcaaacctagaacccaatagaaaaaaaagccatttatctgaaggctgcatagtggagagagtcttcagtttacctcattctttgtagcagccctcgt

SEQ ID NO: 23544 - DNA, 300 bp, Homo sapiens
attagtgctctccgtgctccaggaacaaggagcaggtccagaggccccgctcttcccactgacaaacgggcttggtttgctgccttattaatgactacgccactctcaccacccaaacaaaatgcacagagtaggaggaaagaattagcttcgaggaggtgctcttactatttttagacaatgcctgtcagctacagagcagcggaatagccctgaatacctaggggtgatctgtccttttacttaatgcaaactctgctttattttgcttatttattccattttcagtgccccccaaca

SEQ ID NO: 23545 - DNA, 350 bp, Homo sapiens
  misc_feature 321: w=a or t
tataatatccacctccacgccctcttctacctcttctggctgttggtgggtggactgtccacactgcgcatggtagcagtgttggtgtctcggaccgtgggccccacacagcggctgctcctctgtggcaccctggctgccctacacatgctcttcctgctctatctgcattttgcctaccacaaagtggtagaggggatcctggacacactggagggccccaacatcccgcccatccagagggtccccagagacatccctgccatgctccctgctgctcggcttcccaccaccgtcctcaacgccacagccaaagctgtwgcggtgaccctgcagtcacactgacccgt

SEQ ID NO: 23546 - DNA, 358 bp, Homo sapiens
  misc_feature 35: m=a or c
agttctaatcatgaagcccaaatctgacaagagamgttaattataagaagatgtcttattagaaagaaccagaagccgggtatggtggctggtgcctgtaatcccattgcttttggaggctggggagggaatactgcttgagcccaggagttcgggaccagcctgggcaacatggcaaaaccccatatctacaaagaagtcccagctcctaagtagctggaactataggcacacaccaccacgccaggctaatttttgcatttttttgttgagatggggtttggccatgttgcccgggctggtctcgaattcctgcactcgggcagtctgcccacctcagcctcccagagtgctggga

SEQ ID NO: 23547 - DNA, 119 bp, Homo sapiens
  misc_feature 6: w=a or t
gaagtwctgttctgagaatcagatctaggaagagttgacattgttaatacatagatatatgcacctactctgaaaatatcacactaaagaacaattaagagatttgagatggaagccct

SEQ ID NO: 23548 - DNA, 199 bp, Homo sapiens
aagatagggctttaagtaagtaattaagataaaatgaggttctatggatgggccctaatccaatatgactggtgtcctataagaggaggaaattaggacacagacaacacaaagactgaggacagctatgtggggacagagcaagaatgtggccatttgcaaaccaaggagagaggcctctgaagaaaccaaacccgct

SEQ ID NO: 23549 - DNA, 340 bp, Homo sapiens
  misc_feature 324: s=g or c
  misc_feature 325: k=g or t
aacgaagtagctttttctttgctcgtttgtctgtgtattaagaagagactaaaatagccaaacgacgctggtcgcatgcgctggctgtggtctgtctgctgaatgtctatttttgtctcctgacgagacgtgaggaccatgcccttgatccctccgatggaccagaaacccccttccttgcaaaaaaaaaggcaattgaattaggaaaagatagcccaacctagctcagatccaccaagataagcacagcaaagcttggctgcatttttgaggaataaaaacctgcagaaagcaccgataaccttcaagatctgaatgagattskattataacccgtctc

SEQ ID NO: 23550 - DNA, 319 bp, Homo sapiens
ctccaggggtaatgctgctgacaaccagggccccagtgattggctcagttgcttgcatcatatttatggtgatttttaaaaataaaatgcaatataaattgcagctatactacttaaaaactttagataattatgtataaactgggttgtattgatattcctgtcaatacacattgagtcttgagcatctacattgtatataccctgttgacctcctgttgatggtatattatagaccatgaagaggaatttgaatattgcactcttaaaaaggaactgtgaagcacatgacaatgataaatgcaaaaatctgaccggc

SEQ ID NO: 23551 - DNA, 231 bp, Homo sapiens
taaatagggaatcctttccccatttaataaatggtgctgggaaaactggctagccatatgtagaaagctgaaactggatcccttccttacaccttatacaaaaattaattcaagatggattaaagacttaaacgttagacctaaaacaattaaaaccctagaagaaaacctaggcattaccattcaggacacaggcatgggcaaggacttcatgtctaaaacaccaaaagc

SEQ ID NO: 23552 - DNA, 376 bp, Homo sapiens
tttcactgcggctcttctcagttttttattgagtgtgttgtgaccggccatgagatcatgggtaagtgacttaatctgagtatgcctcatagtgttcacctgtagatgggaaccatcagttgtttctcgttgttataaggatcaaacaatggaatttatggaattgctctgcaaatgatacaaaggtcagctgttaccgatggtgtaactgattgcctctcaaattcccccccatatctgctccaaatgacccttcccagaatggctgccactaagttcccaccagctgacaaggactgtgtgcaatgcattgctgtatcaaagttgagactgtggggcggggacagacatagctgctaacagggaaatatctgga

SEQ ID NO: 23553 - DNA, 87 bp, Homo sapiens
  misc_feature 2: b=c or g or t
tbagtttatttctttgtcagaatcgccaagaagccagttatcaaatagcgagccttctccccccacctttttttttttttttaaaat

SEQ ID NO: 23554 - DNA, 93 bp, Homo sapiens
ggagtgctgttcgtgtgttcgagtccctgggttgcttcctggggtctgtggtgctgggtgtgctatctgcgtgtgattctctagcgagagaag

SEQ ID NO: 23555 - DNA, 445 bp, Homo sapiens
tgttgttgttgttttaattgggcaaccctcagaactgaagaggttcagagaactttccaggtttatactatacctcaagaccacatagattagctactgcttattctttcacatgggctaggcctgttctcctcctccagacctagtattctaagttattaccacatagtatttttatgttacccatcatctttaaaaacattataggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgca

SEQ ID NO: 23556 - DNA, 84 bp, Homo sapiens
aggaaaattaagcatcccaagtgtgactggacaaagagagcagatgcaccagtgcctgtgccataaagttccgaatcccccagt

SEQ ID NO: 23557 - DNA, 409 bp, Homo sapiens
  misc_feature 260: b=c or g or t
  misc_feature 261: b=c or g or t
  misc_feature 262: k=g or t
  misc_feature 318: k=g or t
gtatttggtgagtgtttccggtggacgttcccatgaagttatttacctagtcctgacctgcagatagacgcagaaactgtctaggggcagcctggcctagttgctttctgatctgtaccaggcacccaatccttacactctacctcatgttttctgctgaggaaagggatagtagtgaatggtacttacttcttcgcagaaatggtatgagaattaacatatcaaaagatctagctgccttatatatgatgctgatgtabbkttaagacttttctaaattgtagttttttagctatttattagctattattattggtkacttattagatttcaatcagggatctgtagaacaagggaattaatgcctcaaattcccttgttctctctctcaaattccttatttcatggc

SEQ ID NO: 23558 - DNA, 187 bp, Homo sapiens
gaaaaatagagagtggggctgatccagggttagggctttgccagagagacgcaatgaaaagagaagagacacaaaggactcagctgggtaagaggggtataaaaaggagtgaaccgaaggtagagagagagaggccagacactcagaggtctcaagggagagagaggagtgggacaagccagcacta

SEQ ID NO: 23559 - DNA, 260 bp, Homo sapiens
aagcctggcaaggacctgccctgcatggcaaatgtttagactctggctgctgtcgatcagtctccctccagcctaacagtttgtgcattgaacactagtggattttgcacttaattaagagggttctagccaaccaaactgtatttagagactaaaaaattagccacatgaacaaaagtatacacttcggctgcattaacactcctacccaagactatttttaaatacaactcccaagccattaagtttgaaaaccgccg

SEQ ID NO: 23560 - DNA, 106 bp, Homo sapiens
tttaattgactcacagtttcacatggctggggaggcctcaggaaacttacaatcatggcagaaggtgaaagggaagcaagaaccttcttcaagtggtagcaggaga

SEQ ID NO: 23561 - DNA, 252 bp, Homo sapiens
  misc_feature 2: h=a or c or t
thcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtga

SEQ ID NO: 23562 - DNA, 198 bp, Homo sapiens
cttgtaaaataaacattttcactattgagctctgagaatttggattttgaggaaattaacccaatagagcattatgttctttccttgaagtggtcattctctgttctaaaatttaatatcctccaacaactctctcagctcatatcttcccaaactcatttcccattagtacctaatatgaatactcagttacagcct

SEQ ID NO: 23563 - DNA, 256 bp, Homo sapiens
  misc_feature 182: r=a or g
taaaaaatctatttttctggtcaggctcagtggctcacgcctgtaatcccagcactttgggaggctgatcagtggctcacgcctgtaatcccggcactttgggaggctgaggcgagcggatcacccgaggctgggagttcgagaccagcctgaccaacatggagaaagcccgtctctactaraaaaaaaatacaaaattagccagacatggtggcacatgcctgtgatcccagctgctcgggaggctgaggcagga

SEQ ID NO: 23564 - DNA, 150 bp, Homo sapiens
aatcagaaatgggtccatgatgaccactgttttccaaacccagtctgttccctgctccctcgctggcaagccccaccacacaggagtgaggccaggggctaggagttctaagaacagaggctggggtgagggtggcacccaggcagctgt

SEQ ID NO: 23565 - DNA, 214 bp, Homo sapiens
  misc_feature 15: v=a or c or g
catacaactaatgtvctttcttaggctaatgatataagagtgaagagcaggacttggtcaatggattgccattttatggtagacctctagagaaactgtctagttaaatggggctagaaactagactaggaattttattctattactccaggggacccagcagtgctcattctcgtgtgtgtgtgtgtgtgtgtgtgtgtatgtgtgtgtgtgt

SEQ ID NO: 23566 - DNA, 140 bp, Homo sapiens
  misc_feature 19: k=g or t
  misc_feature 67: w=a or t
  misc_feature 68: w=a or t
tttggccacgcgctgggakcagggtcgcgctccgtgtcctcctcccgacagctcccactcgccttawwttctctaagcagagcaacttcgcggacagcggagctcgcccagcatggatgttccaggttcacaggcgccca

SEQ ID NO: 23567 - DNA, 129 bp, Homo sapiens
taccatttgacccagcaatcccattactgggtatgtacccaaaggattgtaaatcatgctactgtaaagacacatgcacacatgtttgttgcggcactgttcacaatagcaaagacttggaaccaaccc

SEQ ID NO: 23568 - DNA, 185 bp, Homo sapiens
cctaaatgtttatgcacttaataatagaacttcaaaatacatgaagcaaaaactacaaagaaataaacaaatacttttgttgaaagatttctacatcccactctcaaaaatcgatggaacagatagaaaatcagtgaaggatttaggagacttgaacaacactaatcaacctacttgacccaact

SEQ ID NO: 23569 - DNA, 131 bp, Homo sapiens
attgaattcctttgccagcctactttgtgaaagaaaacattggggtttctttggctgttcttgataagcctataaaaaatgatattttttagttgcttatagttgctgaagtaaaggaaccctgcagccgt

SEQ ID NO: 23570 - DNA, 187 bp, Homo sapiens
acagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggc

SEQ ID NO: 23571 - DNA, 175 bp, Homo sapiens
  misc_feature 91: n=a, g, c or t
atttcttctgggaaagtcgagccactgatggaagcgagaagccactgctggttatagagagaaagcacacacagcacggatcgtgaaacanacacgacccagaggcacacacatcctcattctttcccttttctcttccgactcggacccttcccgatgggattaccaaagccgc

SEQ ID NO: 23572 - DNA, 100 bp, Homo sapiens
ttagtagagacggggtttctccgtgttggacaggctggtcttgaactcttggcctcccaaagtgttgggtttgcaggcgtgagccaccacgcccatgcca

SEQ ID NO: 23573 - DNA, 300 bp, Homo sapiens
ttgagaactggtgtttgcagctatggttctgaggtcttgcagaatacctactgttgttgttgttgctgttgagtcacccaggctggagtgccaatggcgccatctcagctcactgcaacctccacctcctggcttcaagtgattcttctgcctcagcctcctgagtagctgggattacaggctcatgccaccatgcccagctaatttttctgtttttattgaaaacggggtttcaccatgttggccaggctggtcttgactcctgacctcaggtgatccgcccgcctcaacctccctcga

SEQ ID NO: 23574 - DNA, 156 bp, Homo sapiens
cacccactctgcactggggcgtttcctactgcgcctcgtgctggcggacgcagctgggtgcagaagctgtggggtcggagaggcgtttggagaaggtctgtggtgcagtgtgtgaaaattcaggtgctagaagcctactggtagaaaaacccaact

SEQ ID NO: 23575 - DNA, 202 bp, Homo sapiens
tatttgtggattctttcatatgattgattgattgattgatcgagatatcatttgcacatacatatagttttacttcttcttttccaatctggaagcattttatttcaatttcttgcctaattttcctggctagaactgcctgtacaatactaaatagaagggccaagagtggaattcttgtctttctgatcctagagagagg

SEQ ID NO: 23576 - DNA, 212 bp, Homo sapiens
ctatgctctagtacataagtcctagcataccattctaaagcaaaagtttttaaatttatatcatattagcagaaagcacaatgttgctcaccctttgaagttatatattaatagttatttttttacttcttcagtcaactaattggacgcttaagtcatttatattatattctaagttatcagctgaacaaaccagtttgaatgccagccgg

SEQ ID NO: 23577 - DNA, 80 bp, Homo sapiens
catctccataatattttatttattacactttccaccttttgctgtcaagggaaaatatttcatcttgcaccgcgaactcc

SEQ ID NO: 23578 - DNA, 229 bp, Homo sapiens
tgtatctgctctgtatctgttcaagtggagataatccatgcaaatcaggagccgtggctctcaatgcctggttcacagataggactcagcttgaggaggtcactcgttcacagccgctcctcccattatatttttccccttattgcagaactgctgtatgtatacagtgactgaaaggactcaatttactgcaactgctgcctggctttacttacaacttttttttttt

SEQ ID NO: 23579 - DNA, 370 bp, Homo sapiens
tttaacttcagaaccaagatgttggcatgaaccaggctgctgttgaagtacatgtatattataaattatcttatttgtgttatactcttacatgttatcttttctaagaaaacaaagtccctattattcctattgcaaagcacacaggaattaagaaagtacagtaatttttaaaaaaaaatccggtaaatgtagtattcttaacctgttctatattacttatacctattgtctatatagctttaatttatagttgtcagtttaactattggcatgtctggcaaagaaaattaaactttaagagttttataaactgtttctaggttgctaaagaatttatttttctactatatatggtatagacaaagca

SEQ ID NO: 23580 - DNA, 147 bp, Homo sapiens
tcttattgtaaatttgagtgcttgttgttttttatatttgtgatgactcttccagcagttgttgacaattgttagaggtttgacttttaaataattacttatattttctgattgtggttcagtttaactgaagaatatcctgagata

SEQ ID NO: 23581 - DNA, 403 bp, Homo sapiens
  misc_feature 233: w=a or t
  misc_feature 239: r=a or g
  misc_feature 240: s=g or c
  misc_feature 271: k=g or t
  misc_feature 337: w=a or t
  misc_feature 338: w=a or t
  misc_feature 358: k=g or t
  misc_feature 359: k=g or t
cttatccccaagcttggtatcgccactccttcagttctcagttattttctaaaactttgcagtttttttatggatttgcccccaaccagttcattgacgttgcttttgccttagagatcagtgatatcctacttaccgaatctactggatattttagtccttgtcttacctgatttctgggaagtttttggtgctaactgctcccttatttcaactgtactttgttggcattwatgatrsctttttcttcctatctctgtgactacttctktgtctgtatttcttttgaaggatcttactatttggttactggctaaatactggtgtttttacatawwgtgctctgggccatcttttkkcttcttcaattcctatattgtctctagggaggctgattaatact

SEQ ID NO: 23582 - DNA, 150 bp, Homo sapiens
gaataaagttgaagggaaccttgggttatcatcttgtctgcctccggttgttggtggtggggatttttgattctgaatcaccttccagtaatgggtattctaaaagatcttcaggaaaacaggctttctcagtaattttcaggagctccc

SEQ ID NO: 23583 - DNA, 233 bp, Homo sapiens
aatagtgttcctgcagggatgtctgaagtactctgcaaggctaattaggacagatcaatgtacacttacctctccagaaggctgaaaggtgtgtagtgactatgtgtcattaaaaatttacttgaccatgggcaacagatgtccatgaaagaatgaccctgatacagactgaaatgttaccagataaaatgatgtcatgtctgggattcgcttcaaaataatttgaggtggaa

SEQ ID NO: 23584 - DNA, 103 bp, Homo sapiens
cttaaacccaggaggcggaggatgcagtgagccaagatcgcgccactgcactccagcctgggcaacagagtgaaacaccatctcaaaaaaaaaaaaaaaaaaa

SEQ ID NO: 23585 - DNA, 440 bp, Homo sapiens
  misc_feature 75: r=a or g
  misc_feature 76: s=g or c
  misc_feature 286: y=c or t
actgcctcagctgcctcaccaggaatgcaggagatgcagatgcacggatgagaaagctttgcctgtcccaatgcrsagcgatgcctgacgctgcctcagagtacctgtgctctgcccatccagcttctggtcatccgaggcccaggtcccaaaggggcgtgggaggagatggtgggagagacagctaggccccatgctggacacctgagagggagaccctggctttgtgttgagatgtactgattcatttcccatttttacctcattcccctcacggatttggtcyagcagagttagatggcgctggtaccttttccctccatgacctttaaagcttagactgatggccagtagggtggtagtttgtgtttaatatttttagtctgtgattagtttatttgaaggctttcctgttttctaatgtaagaattaagtgctat

SEQ ID NO: 23586 - DNA, 187 bp, Homo sapiens
tggctgtgctaccccagcactttgtagctctctgccttggttttcttttaggtaaaatagggcaaatatgctaaaaagctatgattctatggtctttttacttaatattcttttcagttatgatcgtgacttggattgtgacattttaattgttttatacattgagaccaatgaaggatgagagtac

SEQ ID NO: 23587 - DNA, 124 bp, Homo sapiens
acaatgacatggatggatttctaatgcattatgctaagtgaaagcagccaggcacccaaggctacaaacgaaaattcctgcacttatatggactctccagaaaaggcaaatctataggaacaat

SEQ ID NO: 23588 - DNA, 183 bp, Homo sapiens
caattttagtagagacaaggtcttactctgttgctcaggctggtcttgaactcctgggctcaagcagtcctcccattgtgacctcccagagtgctggtattatagtcatgagccaccatgcccagcctcaattaatttttaaatctgtcaacaatataataagtatcaattgaaaggaagcct

SEQ ID NO: 23589 - DNA, 282 bp, Homo sapiens
gcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgcaaccagt

SEQ ID NO: 23590 - DNA, 379 bp, Homo sapiens
aataataaggataataaaggaaaacagcatatcataaatggtaatttctactaccactactatggctgcttctacttataggatcagagaaactcaaggtctctagttcaactttgcactcaatgcctgagtcctgtctccgtgtttgacaggcagcctcttgcctctgcttaactactttgaaggatagatgtctgtgaccctgtgatgcagtctttcttcccctggagtggacagtagtaactccccagctggttattcagtttcccctcattttgtgcaatgcaatagaatgcactctggaaacattggctggctttctttccctttaacaccatttgcttgttcctagttcctggtgtttacatttactgccctt

SEQ ID NO: 23591 - DNA, 412 bp, Homo sapiens
  misc_feature 146: n=a, g, c or t
  misc_feature 147: s=g or c
  misc_feature 148: m=a or c
  misc_feature 285: w=a or t
  misc_feature 286: k=g or t
  misc_feature 287: w=a or t
  misc_feature 311: w=a or t
aatagatttcaagccagtttttccattcaaaccaagatgcaaattcataaaattactcttttcctggaatagatccaggcagctgccttattagaactttagattcggatctattttcttaacacacatacacatacacgcgcatnsmtacatatacagagagatacgtggagaaaggaaatttactctatcattgcaatacttcaagaaagagctgtattttgcctttctgtaatctccaagatagtgtctaggaaagtaatagtataactatagggataccgwkwacaggaaaaaccagccatcactcwtagagaaagtttgagttcgactcacatgggagaatcgaggtctgctactcgtcttgctttgtgccccatctgtgcctggatgccctactacatctgcttga

SEQ ID NO: 23592 - DNA, 108 bp, Homo sapiens
tatttaaatagaagatttttgtaggtgtaccacataggaagagcaaatgaaataaactctttaggtgaactttggttctttttgcatattttgttactcactgcccag

SEQ ID NO: 23593 - DNA, 386 bp, Homo sapiens
actattaactacttcagcccagcaggcagatctgtttgccctcgcttgagcctgactccttgctacaggaaagacaatgtttatgtaagcagcaggaaggaggagaatcagaaggtcgccattgaaactattgaattcaagagcttatcggtgcaactgcagcccaactatcaggaatcagcatcaaaactacttcctgtctctcactaactgggtaattggtcacaaaaagtggacttcagctgccgctgaagagggaggagtgaagcatggttaaacagagaaagatggtatctagatgaactctaagaagccataaaatgtaggtgggcagcaagtttggactgcatcttacaagatattggaatgagtgtacatacatcagt

SEQ ID NO: 23594 - DNA, 192 bp, Homo sapiens
  misc_feature 12: y=c or t
  misc_feature 139: m=a or c
  misc_feature 141: w=a or t
  misc_feature 147: y=c or t
  misc_feature 149: k=g or t
  misc_feature 157: r=a or g
  misc_feature 159: m=a or c
  misc_feature 163: w=a or t
  misc_feature 167: w=a or t
  misc_feature 182: w=a or t
cagaagtgtgtyatggatgtggaaataatgcagatcacacttggacacttttactaatatacttaacctctgaatgtcattttcctttactgaaattgaagaaaataacgtctttattctgatatttaaaaaaaaaaamcwttaatyckgatttgaramctgwtttwaaaaatgtaagacawtgtagaggaa

SEQ ID NO: 23595 - DNA, 129 bp, Homo sapiens
  misc_feature 16: k=g or t
  misc_feature 98: m=a or c
  misc_feature 119: w=a or t
tcgctctgtcacccakgctggagtgcagtggcccaatctctgctcactgcaacctctgcctcccggcttcgggcgatccttctgcctcagcctcctgmgtagctgggactacaggtgcwcaccaccctc

SEQ ID NO: 23596 - DNA, 297 bp, Homo sapiens
aagataataagtagtaacaaggcaagtcttttatgtaagacagtcaaacagtgtcacttcagggacaaaggcctggaagcccttaaaataagttatcttagatgtgccagaacatattcagagctttattcctttaagcttaaggcttcaatacttgtagaaatgcaaatattcttgagaaatgatacattttttgttctcaatttctcaattctacatacctgattatgagtgaagtatccaaagcaggttttcatcagcatgggggatggaaggtaggtataatatgaggactgt

SEQ ID NO: 23597 - DNA, 252 bp, Homo sapiens
  misc_feature 242: n=a, g, c or t
ttcctccttctagatttgtctgatttacttgaggtgccatttagtttgtatttcctataaacttgacattatgtctaatggagtcaagttttgcctaaaatatttcataggtgatgttgtgttgtctgcttaatgttgtatcatgttagacctgttagtggactgttactcatattaagatggctctcttaattggagtgaagataacagtttgacccttacattccatttttttcttgccnaggtccccca

SEQ ID NO: 23598 - DNA, 331 bp, Homo sapiens
gaacattggcgaagacccaagatcaccccattcattgccttctatttctttcaaaaatcccatgcactggtggtgattcacagcatttgtatgtatacactgaacagttttaacaactgtacccatgacactttccatggagcctgcttccaaaagcagcacaaatattttcagtatttatcatacagtgggatgaagcaataagggaaacatcagtctcttgttttgaaactccaataaaaccagatttttgaccaaacatagctggaggaccatctggcatgatagaaactaattttttcatatctaagtgaaatttttttggtcagat

SEQ ID NO: 23599 - DNA, 182 bp, Homo sapiens
ttattgagtgtttttagcatgaagggttgttgaattttgtcaaaggccttttctgcatctattgagataatcatgtggtttttgtctttgtctctgtttatatgctggattacatttattgatttgcgtatattgaaccagccttgcatcccagggatgaagcccacttgatcatggtggac

SEQ ID NO: 23600 - DNA, 136 bp, Homo sapiens
  misc_feature 12: s=g or c
ggctttgattgsgagaaaataagtgggaaacaagagtagcttggacagggggcttggacggccagcgcattgaccagaagcggcccacactacacgcgcgcgaacacacacacacacacacacacacacacacttc

SEQ ID NO: 23601 - DNA, 382 bp, Homo sapiens
  misc_feature 268: w=a or t
  misc_feature 269: w=a or t
  misc_feature 310: h=a or c or t
  misc_feature 311: w=a or t
tttaaaactttctttttaatttcttcgttgactcagttgtcattcaggaacatattgtttaattttcatgtgtttgtgtaattttcaaagtttctcttgtcattgatttctagttttattccattgtggccagagaagacacttgatataatcttaatatttttaaatgttaaagcctttttttgttgcttaaagtatggcatatctttgagaatgattcttgtgctgaagagactaatgtggattctgtagccattgagttaagtgwwctgtaaattaggtctatttttataatcaacaccctcctaghwcttactactaataattattacattttgactaccacaactcaacggctacatataaaaatccacccctctcg

SEQ ID NO: 23602 - DNA, 380 bp, Homo sapiens
aatacaaaaaaattagctgggtgtggtggtaggtgcctgtagttccggctgctcaagaggctgaagcacaagaatcacttgaacccaggaggtagaggttggagtgagccaagatcatgctactgcactctccagcctgggctacagagtgagactctcaaaaaaaaataataataataataagagaaaatagacaaggtctccaggctggtcaactcctggcctcaagtgatcctcccacctcagcctcccaagcagccgggactacaggcaaacatcaccatgtccagctgtccccagctttctaatctggtctttctcttgccccagaacctcaagaaggcatgaagccagcccctgcagtgccgtccacccgcaac

SEQ ID NO: 23603 - DNA, 403 bp, Homo sapiens
  misc_feature 224: r=a or g
  misc_feature 225: k=g or t
  misc_feature 286: d=a or g or t
  misc_feature 287: s=g or c
  misc_feature 288: w=a or t
atagtgttgtgacattgaaggtttttttttggtctctttattgatactgcatgtatactaatttaaaataaattgattactgcagtatccatcatttatagacaaattacattttccgtcaatagctttgtcttcagttttcctagtgatagaatacattttattttctgtggccacattttgttgtacagaatttggaatgtatattttggacatgaatttarkataatggtcttatgtgttaaatttgcttttaagaaatgttcacctgtttactcttttattdswgcttaatcaaactatgaaacatttaaagcataacccttatttttgattagattgaagttgaaaaaacaaggcagtaagtagtctgtgggacacttgccattttccaggcagtata

SEQ ID NO: 23604 - DNA, 146 bp, Homo sapiens
atgtcttgacctcgtgatctgcctgcctcggcctcccagtgctgggattacaggcgtgggccaccgcgcctggccaaaatatataaccttaagtgtaagtttactaactttggaaagtacatacaccagcataaaccaacccccca

SEQ ID NO: 23605 - DNA, 354 bp, Homo sapiens
tagatgtggataacaaaaatgaaagactcttgcagagattctttaggccctagcattataagaactatatgtgaggtagtatttgtagtagcttattggagaagtgcagagttggaaggatccagaacatatgtaaaattgctgagtactttacgcattaggtgatgaagaactagatgattaaattgatggcaaatacttaaatataaatatgtatacataaatatagaaatatatttatgaacctggtaatgacaaattgaaaagtatacacacatgcaccacaaagtatttaaccatatgaatccattttactaaaattgaattaaagaaaatattatttctccccatttt

SEQ ID NO: 23606 - DNA, 127 bp, Homo sapiens
tagaagatgaatgcatatattagattttcatttaaatcacttctgttataaatcatataaagaactttaaacttgttttatctaatactgagcactgtttttttgtcaagtatttttttaagaccac

SEQ ID NO: 23607 - DNA, 108 bp, Homo sapiens
  misc_feature 3: k=g or t
  misc_feature 4: w=a or t
agkwaggggaagaagattgctttagaacaagtggcatgaaattaccatctttgtagaaaccgcagctaacagtgggagttatctaagcaatcagatgttacaggacat

SEQ ID NO: 23608 - DNA, 304 bp, Homo sapiens
caagagaccttcgcagacagctccgcaaggctattatagatcatgtgtcagactctttcctggatacgacagtccctcttttggttctcattgaagctgctaagaatggccgggaaaaggaaataaaagaatatgctgcgatatttcatgaacacaccagcaggcttgtagaggtaagcatgctagaactgtaactcactaaagtccaggagaatgaggctcccattctccatttatggttgaattgtacctaaataaaaacttttgacaccgtgttacaaaaaaaaaaaaaaaaaaaaaaaaa

SEQ ID NO: 23609 - DNA, 263 bp, Homo sapiens
catagggccatttaggggttatgttaaacttagtttctttgtaatagacatggtttttcatattttcacccaaatcttcaatttgcacttttgaaaataatttttttgagagggtcttcttctgtcccttaggctggagtacagtggtttgatcacagctcgctgcagcctcaacctcctgggctcaagcgatcctccaatttcagccttctgagtagatgggattatggatgtgagccaccatgcttgactaattttttttt

SEQ ID NO: 23610 - DNA, 325 bp, Homo sapiens
accccgctttatttttcctctggcacagcacttagcaccataggacccatcagatatttacggcctgtccccgctgcccctcccgggcagggattttgttttggttcgcagctgcagctccagggcctagaacggcccgggcacttagtaggcccagagaagaaactgaggcctggaatttgattaactcattcaaggttacccagttggtaattcatttgcacacctgttagcaagaaacagaagttgaaggactggaacaagtgaactaggaaagagggaacgccaatccaaggatagaaggacaaggacagaatcaccagcc

SEQ ID NO: 23611 - DNA, 195 bp, Homo sapiens
  misc_feature 195: n=a, g, c or t
gagttagtgggtggtggtttggaaggagggagacagaggtggagggcttgtttgaatgcaccaagccttgcaggctttcctcctccccgcgctggccgggtaggttctcttcagttcctgatgaggcaaacgagaacaaagcagtcgaacagcaccatgatcgacgatactttgggggcggcgtgatcagaggan

SEQ ID NO: 23612 - DNA, 281 bp, Homo sapiens
cggttctaattatacatttctctgtgactgattggtttgtctccctcccttcccagacgagctcaagagtagcagcagctgaatctgtttttaatcacgattgcatctctagcgcctagaaataaatgcacgtggtaggtgcccaataaatattcctcgagtgagtagatgatctttagtagccatcctgctactacatacagacaaatagatatgacttctgttcccacgttccttttttctttaactcattggccttttggacctgtccttgcccgtct

SEQ ID NO: 23613 - DNA, 297 bp, Homo sapiens
gtgcggctccctgctccgggcccgcggggccgggactggaccgggctcttctctaggcatctgcgggattcactcgaggtggccgggttcgtgcattaaaaacaccgggccagcgttgtcagtgttctaaagaggtgtgcgttcagtttgctttctgttgccgcctaagcctaaccttgggaccggccgttttcccactctcctgaatatcctccggcccgcagggaagggcggagacgcggtgtttggcgctggcatcgactggtacttgtttagtggtgtttaactgggatggct

SEQ ID NO: 23614 - DNA, 253 bp, Homo sapiens
taggaacacttttacactgctggtgggactgtaaactagttcaaccattgtggaagtcagtgtggcgattcctcagggatctagaactagaaatacaatttgacccagccatcccattactggctgtatacccaaaggactataaatcatgctgctataaagacacatgcacacgtatgtttattgtggcactattcacaatagcaaagacttggaaccaacccaaatgtccaacaatgatagactggattcc

SEQ ID NO: 23615 - DNA, 447 bp, Homo sapiens
  misc_feature 432: m=a or c
aaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgaatttcatacmgaagatgactgtgat

SEQ ID NO: 23616 - DNA, 160 bp, Homo sapiens
tcatcaaaggccacctgcgtttttttcttttttgaaagtgaaatggcccttctctgcccttatctgtagcatatgaacttgacttagttttccagttgccctgatagatttgctttgcccatctacattttcccacagtacttgcttcagttgaacccga

SEQ ID NO: 23617 - DNA, 370 bp, Homo sapiens
ttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacctctatacactgttttttcctatacatatatacctatgataaagttctatttataaatcagggaca

SEQ ID NO: 23618 - DNA, 164 bp, Homo sapiens
  misc_feature 124: s=g or c
acttgccattactgacctggagagcggccgtgaagatgaggctggcctgcatcagagtcaggccgtgcatggccttgagctggaggcgctgcgcctgagtctgagcaacatgcacacggcgcastggagctgacacaggccaacctccagaaggagaaggagac

SEQ ID NO: 23619 - DNA, 376 bp, Homo sapiens
cttggtgcagccttgcccaggacccgggagccacgagtcaggtggcaaacaccgccttctgcttctccagcacgcgtaagtccctgggaatcttcgagcccactcagagggagccacagaagccccgacgttgcacagccctgcaggcaggggctgggggcatccttcactgagctggacgaaggggtcctgggagcggcctccggccctgaggcctcactctctcgtagcctttgggaaggaatcgcggcatcctggataatttcgtggattcccgaggcagctcaggtgtccaccagcgggcatactgctgcctcaaagagttgggcaagatgctgttcggggtgaaggacattgcactgttggagcacgcgtg

SEQ ID NO: 23620 - DNA, 360 bp, Homo sapiens
  misc_feature 304: n=a, g, c or t
  misc_feature 305: n=a, g, c or t
tcaaagaacttggtcataaatatgataatgagaagacaaagtatttatattaaaacagtttagtagccttcagttttgtgaaaatagttttcagcacagaaactgacttctttagacaaagttttaaccaatgatggtgtttgcttctaggatatacactttaaaagaactcactgtcccagtggtgatcattgatggcctttagtaaattggagctgcttaatcatattgatatctaatttcttttaaccacaatgaattgtccttaattaccaacagtgaagcactacaggaggcaactgtnnacattgcttccttaaccagctcatggtgtgtgaatgttataaaattgtcactcat

SEQ ID NO: 23621 - DNA, 372 bp, Homo sapiens
tgaggaccctgtagtcactataataaatttctaagccaaatttttcaaacaagatagttcttatagaaggagaaataataaatatgtgtgtgttgatgcatgcacacagaatgacctgtgaaaggaaacttaaattttgccggtaaaacaaacatatctctacagactgtgattatacttcataagcatttaaatacagttttatttatttccttaaatatattacttgggtaattaattttagatttgattgcaaagagcactgtatagcagttgggaccagctcttggcttggcttggcttggcttattgttatgagtttattggatcagactaacaaataactttgtgatgaaaattcttcaaaaatat

SEQ ID NO: 23622 - DNA, 115 bp, Homo sapiens
  misc_feature 111: r=a or g
cttgggagactgaggcaggaaaatcacttgagcccaggaggcggaggttgtagtgagccgagatcatgccactgcactccagcctggccacagaacgaaactctgtctcaraaaa

SEQ ID NO: 23623 - DNA, 70 bp, Homo sapiens
tatgtaaaaggaaatacagaggcagtgaaatagaagatctagtactccttgatgaagaatcgaggccttt

SEQ ID NO: 23624 - DNA, 302 bp, Homo sapiens
tcctaggctcaagtgatcctcctgcctcagccgcttgaatagctgggactacatgcatacaccaacacacccaactaatttttaaattttttgtggaaatatggtcttgctgtgtttcccaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagca

SEQ ID NO: 23625 - DNA, 127 bp, Homo sapiens
aaactaaaaggctggaagggaggcagctgcctttgtttgccatggatgggtaggggctgcactgagcagcaccggtgttcttcatccggctgcacccccaacagagctctttcttccccagatccca

SEQ ID NO: 23626 - DNA, 266 bp, Homo sapiens
  misc_feature 211: b=c or g or t
aattttctcagaaatgttttgtagttttcactgcgaaaatcttgcatattttcaataaattattgcctatatatttaatattctttgacagcattgtaaatgatattttaaattttgttttctaattttttatcatttgtatctaaaattgctcttgatttttgtgaattaactttgagtccttaaatcttacaaaatgtacttagcagtbcttgtctttttgaagattccatgtgattttctacatatataataattttgcctac

SEQ ID NO: 23627 - DNA, 295 bp, Homo sapiens
  misc_feature 4: m=a or c
  misc_feature 5: m=a or c
  misc_feature 12: m=a or c
  misc_feature 62: w=a or t
  misc_feature 85: m=a or c
  misc_feature 102: r=a or g
  misc_feature 239: m=a or c
  misc_feature 243: m=a or c
atcmmaatatcmtaggcacctcaaagacatgtacaactcttaatttaacatttttgaaagawaaaaaaaccggccagagcattamaacaaataaaataagaracacagaggccagtgttaggtgaagaactccgctgcttcagaaagagaatagcagcgctcgcttaccgtgggaacacggccagttaacaaaatgggttttggttttttgttttgttttgttttaccattggtaatamgatmagttaacataagtggtcagaacttcgctgaatttgtaataaagcatttgtta

SEQ ID NO: 23628 - DNA, 179 bp, Homo sapiens
  misc_feature 79: w=a or t
  misc_feature 80: w=a or t
  misc_feature 148: w=a or t
  misc_feature 179: s=g or c
taacaggaagaaaagaaaaccgtcatgtcaaagagctaatgcccttcatatatgaaaagttcttccaaattcgtaagawwaatgttcaaaaatgatcacttcaatagaaaaataggcaaaggacatgagccaatttacaaaaaaaaawtaccatttttctgcacacacacacgccccas

SEQ ID NO: 23629 - DNA, 375 bp, Homo sapiens
  misc_feature 326: n=a, g, c or t
  misc_feature 332: m=a or c
ccttgtatcttagtcaaatgtatctttaattatggggctaaaagaacagaagtatccagtgaagtatctttagtgatccaagtaagattccctctcatcaaagagtttcacttaacatggtttccgaagactttaaaaaataaaacagcaggcgctgagtgttgtgtttactttcgctctgcctgtgttcacattccctctcgtgaatatttattgactttctaccgcctgcaagaggctgggctgggtgcatctcgtgacgagtcacccagaacggtcagcacagttctgccggcccctgttgagtgtgattatcgaggccagtnctccgmtgcctctcacgtaccatttcgctgctggtcactcctcattagt

SEQ ID NO: 23630 - DNA, 341 bp, Homo sapiens
  misc_feature 149: d=a or g or t
  misc_feature 150: k=g or t
  misc_feature 296: r=a or g
aatttgcccttcctccacctttttgtcctatttgagcccttaatggaatgattaatgcctacccacattggtgaatctgatcttctttacatagtctacttaaatgctaatgtcttctggaaacaacctcacagacacacccagaaatdkcgttttaccagctatttgggtatcccacagcccagtcaagttgagacataaaattaaccatcacaaaatgctttcaaatccagagcaatttatcatggactttattgctcttctgagaaaacatgtattttttgaaaatctttgarctgtgaagcctggcatggtgtgtcaggaattctccatcttggaga

SEQ ID NO: 23631 - DNA, 251 bp, Homo sapiens
  misc_feature 12: s=g or c
  misc_feature 13: y=c or t
  misc_feature 70: s=g or c
gaagaaggctasycacctttccttggcgggtgttggaaagcaaagggctggaacgtcccgggctgcggastcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaagggaggtcagggctgtgcgatggggaagt

SEQ ID NO: 23632 - DNA, 249 bp, Homo sapiens
gtgctttgaagtaaatgtaatgaaacaatctttctcacatattcatatattaaatctaagaggacctaaattaaagaatagatatggagtagaaaagttaatattttaaagatgctatttcttttcagattgatcagtgtagattgatgcagttccaatcaaaatctgatggggttgcttaaaaaatttaaatatatgatggataaatagaagtataacaatagatcacataacattatcaacacgcac

SEQ ID NO: 23633 - DNA, 334 bp, Homo sapiens
  misc_feature 243: w=a or t
taataataatggtatcagatgttaattgagcttactgtttgttagacaactcattttatatggaagaaagctgagacaagagaatttagccatggtcacagattaggtggcactagtttgaaaaatttaggaccttagagacatcattttcattccataactttcctttctcgtatgtgaagaagaattagccacctatttaatttctatctccaccaacaaaatatcagtaggatatgtgtwgcttattggtaaggaatactggtgaggaataagaggctaaggtacaggtggagatgtttttaaaagtaattactaatgtataggagaagac

SEQ ID NO: 23634 - DNA, 433 bp, Homo sapiens
  misc_feature 12: s=g or c
  misc_feature 125: r=a or g
  misc_feature 257: m=a or c
  misc_feature 258: m=a or c
  misc_feature 264: m=a or c
  misc_feature 272: m=a or c
  misc_feature 273: m=a or c
  misc_feature 286: m=a or c
  misc_feature 292: y=c or t
  misc_feature 293: y=c or t
  misc_feature 381: m=a or c
gaacccatattsataagtgggccagaattatttaggggcctggcttgctgctctccatttcctgtatcgctaatttatcatttttccaaccttggtattttatattatttagagaaaatgctggrtcactctctttgcctaaggtgactcaaacagccaaacgaaacttccgttgcctcccagccctctgtatccacctggttttgttctttccctgtgagcatttgtggttatagcttcccatatgccacattcammggccamctcctcgmmgtggaaccctgcmctctcyyctcctgctgctgtagagttttcccaaagcagtgtccaggagagaatttgagagagtgaagaaattgccttgtagatgtggagggctgmaatctgtcttgatttctccaagcacttaactttctttgactgcactgagaat

SEQ ID NO: 23635 - DNA, 385 bp, Homo sapiens
  misc_feature 13: w=a or t
  misc_feature 98: n=a, g, c or t
  misc_feature 99: h=a or c or t
  misc_feature 151: m=a or c
  misc_feature 152: m=a or c
ctaaaccgttgtwtgggctcttataattaggtcctgagattttataaaaatttagtctgtagctttttaggttcttcactagagttggttgtacatanhaataataaagaatataaagtatcccaaaattcttttaaagtctggatttttmmgctaatatgtactttagagaatattttgttcatgcatacttccacgttaaattgaaaatgtcttcagcttctcttggtaaatgtgaaccatttgttttttattgtgcttgggggagagggtattttaatataatttttgcctaaatcaagaagtcccctctgaatgttaatttttaaatgtcaaaatatgatgaacgatatatcttgaaagtgagattgcaatatgcttaaac

SEQ ID NO: 23636 - DNA, 210 bp, Homo sapiens
  misc_feature 13: s=g or c
  misc_feature 197: y=c or t
  misc_feature 198: s=g or c
tgttaaatcctasagtactttttgaatcctcaaaagactatgttcagcatactgcttatttgaaaaagttatttagagattggttgtctgtaagggcagtagttcctagtctaacctttttgaaaatctgataaaagttgtagactttcttcatcagaaacatttgtctgtactcacagctcagttttaggtaagtysaagagccccata

SEQ ID NO: 23637 - DNA, 124 bp, Homo sapiens
gttcctgtcggggctgcagcggcgggagggagcccagtggaggcgccctcccgaagcgccactgcccatgctgaccacccagccctccggctgctgatgtcatgagtaacaccactgtgcccac

SEQ ID NO: 23638 - DNA, 102 bp, Homo sapiens
  misc_feature 39: d=a or g or t
acgtttattgaaaatcaattaaccatatgtgagtgagtdaatttctgggctttctgttctgttccattgatctatttgtgtctccctatgacaataccacat

SEQ ID NO: 23639 - DNA, 236 bp, Homo sapiens
  misc_feature 58: k=g or t
  misc_feature 146: m=a or c
  misc_feature 171: d=a or g or t
  misc_feature 172: w=a or t
  misc_feature 173: k=g or t
agcgccccctgcgctgccaacccgcgagcccgcatcatggatgtcgagctcccctatktcgcattgctagccctggaattcgagaccccagacgaggaccaggattcatgaaatcagtcgcaggggccggggcaggggcctctggmtcccgacactggccgagaggtgatdwktgaggttcgaagaacggaagatttaaaaagcagccggggcctccgtattgaatgaaagaccca

SEQ ID NO: 23640 - DNA, 281 bp, Homo sapiens
ccttttatggctgcatagtataccatggtgtatatgtgccatacttttttatccagtctgtcattgatgagcattcaggttgattccatgtctttgctattgtaaacagtgccacaatgaacgtacaaattcacgtatctttgtaacagaatgatttattttcctttgggtatattcccagtggtgggattgttgggtgaaatggtatttctgattctagatcttcgccacacaatcttccacaatggctgaactaatttatattctgaggggacacatcc

SEQ ID NO: 23641 - DNA, 344 bp, Homo sapiens
ttcctcctttccttgcccagctatggccccctctcattcacaaagtgccccctccatgtccctggacccttaagatatccccttggcaccctggtcagagactctgtgtctgactcaggtggtccctgcagagtgccctgggaagggaaggagcactgatttgggggttttgagggtcaagtaggggttggtaacacctggaaagaaggactctttcacttcgatccctggacaattatggaggattcggaggtagaagaggggaaggaagatggtttctatctcatgacccccactccctgtgagagggaatgggggaagcctgatgaccctcagctgtccca

SEQ ID NO: 23642 - DNA, 147 bp, Homo sapiens
tgaatgatatgatgagtcttggtatccatcgtgtttggaaggatttgctgctctggaagatgcacccgcttcctgggacccagctgcttgatgttgctggaggcacaggtgacattgcattccggttccttaattatgttcagtccc

SEQ ID NO: 23643 - DNA, 302 bp, Homo sapiens
  misc_feature 212: s=g or c
  misc_feature 213: s=g or c
aatatctgtgcgacatagtgacaataacctcacctctctgtgcctgtttcttcatttgcaaactggaaataataataatttctgcctcccaggctcattgtgagggacatgtaaatgagttaatacatgtaaagcatatagatcagtgtccaaaatagagtgtgtactcaggaaacagtaatattattgttatatgtactattataattgtsstttttcttttctctctccctcccctcagtacgcgccacgattttaggataagggctgcattcattatctctctatctatagtaacagct

SEQ ID NO: 23644 - DNA, 189 bp, Homo sapiens
agtctttcatcagtaagtaggaggctggctgtgggtgttttgcagatgctctttaacaggttaaggaagatcccttttattcttagtttgctgtgtgttggtattatgaaggcgtgttggattttgtcaaatactttttctaactatattgagtttagcctatgcatgtattttcctcagagagcccac

SEQ ID NO: 23645 - DNA, 120 bp, Homo sapiens
ttttttcttttccacctcgaggtttttcttttgagacttcacaatgttgttctctttcccttgtccactgttttttcaaaggaccatttctgtcatttgtttatgtttcctaccccacgc

SEQ ID NO: 23646 - DNA, 97 bp, Homo sapiens
ctgatagactggcctgaaggtagtgagttatctcaattgattattcagtcagttacagattgaactcctggttctactctttccctccttctcacat

SEQ ID NO: 23647 - DNA, 111 bp, Homo sapiens
  misc_feature 56: y=c or t
agatggtgttttatcatgttggccaggctggtctcaaattgctaacctcaggtgayctgtccacctcagcctcccaaagtgctgggattacaggcctgaggcaccgtgcct

SEQ ID NO: 23648 - DNA, 51 bp, Homo sapiens
cattccttaagttagactttcgggtgtggcttctctcccaggggtaacatt

SEQ ID NO: 23649 - DNA, 102 bp, Homo sapiens
acgtttattgaaaatcaattaaccatatgtgagtgagttaatttctgggctttctgttctgttccattgatctatttgtgtctccctatgacaataccacat

SEQ ID NO: 23650 - DNA, 146 bp, Homo sapiens
attttaatttccaatctaggatgcaagcaagaatatatgtttatttgaatagagtaagctatggcaaagaatgaccaaattagctagaaatagaaatcagccagaattaactaatttcttgctaatctagaaatacaatcatcttt

SEQ ID NO: 23651 - DNA, 315 bp, Homo sapiens
gaccaaaattctgacaccatcacaaaagtgctttgcattctgactgattaaagaaattgcataacttaaactccttgctttttactgctggccctacagagtatgacagaaacatggggctgctaatacaggtttctgggttcttgtccctgcccacatttctcaacacatgataaaaaagatgcaagtaggaaaatcaagccatagactaaagaaatcaccaacggtggttttattcttagaagtaagtgactctttcttaacttctgatccatcttttaaaacatttgtttttccattagcatccgtacccac

SEQ ID NO: 23652 - DNA, 68 bp, Homo sapiens
  misc_feature 7: s=g or c
aggcagsactggactgcagagggaacttgccttgaagaggcctggtccttaaagagacacagcacaca

SEQ ID NO: 23653 - DNA, 231 bp, Homo sapiens
tcaaaaagatgaggtcttgctgtggtgctcaggctggagtgcagtggctgttcacaggcgtgataattgtgtgttacagcctcaaagtccagggctcgagtgatcttctcacttcagcctcctgagtagctgagactaggcgtgcaccaccgtttctgacaggattttaatttttaagtaggtttttaacccacagccacgagagctaattttaactacattgttagaggt

SEQ ID NO: 23654 - DNA, 179 bp, Homo sapiens
cagccagatatttgttctctttctcattcagtataagacagctttcaatttgcttagcaggcaacattagaaggttagagttcatggaaacatagaattttaaaatgtgagttcaaccgaataaatttgaatttctgtaggaggtaaagaatcaaaatacttgtttatttaaaggttgc

SEQ ID NO: 23655 - DNA, 126 bp, Homo sapiens
aggctcgagcggtcaaagctctttccgggggcccggggaactactctccttgcctcgctctgtctccttcgaagtgctctgcgcgaggttcagagcggccgccgcctccaaagggacggttttcta

SEQ ID NO: 23656 - DNA, 107 bp, Homo sapiens
tcggtcggagaggacaggaaggagccggctgcaccgcgccagggtctccgcaaaccgggagcccagggagggcgggaagactggcgggggtccgaggcagcccgctc

SEQ ID NO: 23657 - DNA, 220 bp, Homo sapiens
  misc_feature 138: h=a or c or t
  misc_feature 139: n=a, g, c or t
atccattttggcggaaccaacggtgttgtcacgcagaaaatgtcgaccctcggaaaagagaggttctgcgaccgagaaattcggtgcaacaagtgctgtgacagaaaaccccccgctcggcgctgctggcgaaagaghnaacaaaacgctgggtgctgccaccgtgacaccgactttaggaccccggcctcggatggagaaaggagggtacgaagccacc

SEQ ID NO: 23658 - DNA, 140 bp, Homo sapiens
gcctttgtgtgaagcggcggcggcgatggtgctcggggcgccgcagagccggattaactgtgctgataaggaggtaatttcataggagctgctaagatgggcatgaggatcaaactgcaaagcaccaaccaccccaacct

SEQ ID NO: 23659 - DNA, 292 bp, Homo sapiens
tagccaggtgtggtggtgggcacccatagtcccagctactcagaaggctgaggcaggagaatcacttgaatccgggaggtggaggttgcagtgagccgagattgagccattgcaccccaatctgggcgacatagcgaaactccgtctaaaaaaaaagaaattcctgggctcaagtgatcctcccacctcgatctcccaaagtgttgggattgtgggtgtgagccaccatgcccagccctctttcacatacttagaatcctgtttaatgcctcaatatttttttgtacaagcc

SEQ ID NO: 23660 - DNA, 257 bp, Homo sapiens
ggagtaaaaaagatttttaaaaagcaaagaaaacaaaatataagggaaaaatatgagaaaaataaaaataaaaagagaataataggccaggcactgtggctcatgcccctaatcccagcacttttgggaggtcaaggtgagcagaacacctgaggacaggagtttgagaccagcctgcccaacgtggtgaaaccccatctctatgaaaaatacaaaaatcagacgggcacagtggtggtgcccacctgtgatcccct

SEQ ID NO: 23661 - DNA, 248 bp, Homo sapiens
ccccagccccaaagccagcccccttcatctgtgacttaatctgttgtagtggtgagctgatacattcaggtgtgaccgttggtgaaaacttgtgccccttctgtggtatgcccttgccctgttctataaatatctataaatactcatatatatacacacctacacatggccaaccgcctcgcctctagcgctgggaatcagtcactgtgctatccttgtggagtcttgtggcccaactaccagagaga

SEQ ID NO: 23662 - DNA, 454 bp, Homo sapiens
  misc_feature 7: m=a or c
ttttaamagttatgatgtacctccctgcctttaaacagaatacttttttcttttttttggcctttctcagattagtcaaaaattctatagaatgactcacttcgaatactaagacacaggaggtttagcctgctttcttaccaaattcatgttacccagacttgtgttctcttgcgtcccttggactgcctgttgattgatggaaagtgtctgcactgacacttttcgtcagtagtctgtagtttcgtggcctcttttgattataactggggtcaccaagaaggtttacttaattaaataccgcatttctaagagaagatactttgtgtaagaaaagatgccacatttagtggtttaacttttgtaacttcacttgatagtttttaagcaattagaatggagttagggaaagaacatatcatactgaacaatgtcattctagtttagatagcat

SEQ ID NO: 23663 - DNA, 143 bp, Homo sapiens
atcaaataacctccagcattcactgaggatggtattacccagtcgacgattggcacttctggaacgcagaagaatcctggcccaccagctgggtgactttatcattgtatacaacaaggaaacagaacaaatggctgaaaaga

SEQ ID NO: 23664 - DNA, 136 bp, Homo sapiens
  misc_feature 17: v=a or c or g
ggctttgattgggagavaataagtgggaaacaagagtagcttggacagggggcttggacggccagcgcattgaccagaagcggcccacactacacgcgcgcgaacacacacacacacacacacacacacacacttc

SEQ ID NO: 23665 - DNA, 323 bp, Homo sapiens
  misc_feature 157: y=c or t
  misc_feature 206: w=a or t
  misc_feature 221: r=a or g
  misc_feature 222: d=a or g or t
  misc_feature 223: n=a, g, c or t
  misc_feature 251: r=a or g
  misc_feature 256: w=a or t
  misc_feature 278: w=a or t
  misc_feature 283: m=a or c
  misc_feature 285: s=g or c
  misc_feature 286: m=a or c
  misc_feature 293: y=c or t
  misc_feature 296: y=c or t
cctgtgattccaggtctccttccatggtgagagaggactgaaaacttagaggaaaggaggtctgattatagacccccttttctcgcagctgccatcccagaatttccacccactcacaaacatacccattatacattgatgtgtccacacccctccyaggactaggcaccgcccttaggaatttcactacagcatttttttattcwagtgttttttgccardnacccaccaaagtgtctacaagtctcctracatwattcctattcccagacactgawtctgmasmagcagcytgytctctccaccaaccaaggattctggac

SEQ ID NO: 23666 - DNA, 153 bp, Homo sapiens
aagacagatagataaacgcgacataaactaaaaagcttctacacagcaaaagaaataatcagcagagtaaatagacaacccacagagtggaagaaaatcttcacaacctatacatctgacaaaggactaatattcagaatctacaaggaacat

SEQ ID NO: 23667 - DNA, 118 bp, Homo sapiens
  misc_feature 118: r=a or g
atctttccctctcgggagggaggctgcctcctttcatcaggctgagtagcggggagggcgatggtaatcccggggataggaggggctaggtaaaggcggatccgatggagctcacggr

SEQ ID NO: 23668 - DNA, 463 bp, Homo sapiens
  misc_feature 356: m=a or c
  misc_feature 357: n=a, g, c or t
  misc_feature 358: d=a or g or t
  misc_feature 397: y=c or t
cataattatgagtttgttcatataaagaaaagctgtggaaaagagtcttagagattttgtaatatcattctaaatagattaagaaaagatataatttctttactgcagttaaatcatataatgtttgtatgattaaaaataaatttctcagaattgtgattttagtaactttatataaaatgtgtgagacaaaaacttattaaggttaaatagaattgtttcttctgaataatctaacaaaggaaaatataagtgattgaatcataagatataaggggggtgaagtattaaaaataacttttttgtttgataacttgagaatttagaagattttgccaagtatgtgttgttgcttmndtccttaaatatggcattgatgaatttaaagtaggagcayagttattacttctgattcattaatggccagaattttgtgtttggtgtaatagttgtgtcaccattc

SEQ ID NO: 23669 - DNA, 160 bp, Homo sapiens
taaagggggtgggggggaatcttgggaacgttgtggggtacaagccacaagttaacttgctattctgccagaagggatttctggtataaggttgaaattgctgagataaaataaactaaaacaacaaacatccttaaagaggtagggtgtgggctgctga

SEQ ID NO: 23670 - DNA, 322 bp, Homo sapiens
  misc_feature 133: n=a, g, c or t
  misc_feature 145: n=a, g, c or t
  misc_feature 146: n=a, g, c or t
aagaaaactatctcacagagttgtcatgaaggtggaatgcacaggaagcactttccactgtgcacaacacctggacaccaatggatggagcccttggacaaataaaagcccaagagacagacacacaacatgnacaggctcactnngttgagggtcactcatctgttctccctacaataaaggaataagcaacatttcttggcctgactttccagggcttaccagggtagacagtgaatgccaaatcccaccctctgagagatcaactatcctcaaaataggatttgggtatgtgtgtgtgtgtgtgtgtgtgtgtgtgtgt

SEQ ID NO: 23671 - DNA, 359 bp, Homo sapiens
  misc_feature 195: m=a or c
  misc_feature 196: m=a or c
  misc_feature 318: r=a or g
gataacaggtgtgcgccaccacacccggttaatgtttgtatttttagtagagatggggttttgccacgttggccaggctggtcttgaactcctgacttcaggtgatccacctgccttggcctaccaaagtgctgggaatgacaggcatgagccaccacacctggcctatcctgacaatgatacatgaacaaatammtgtatagtctaatgtctggtcggtaagtgctgtgatgaaaaataaagctgttaggggacaatgagtgactggggtcaggagagacctctcactggcccatgagcacagttctgtatggagargggttgtgtccagcagggctctgggtgggctggatggtcaa

SEQ ID NO: 23672 - DNA, 293 bp, Homo sapiens
  misc_feature 276: h=a or c or t
  misc_feature 277: n=a, g, c or t
caaatattactaatttttaaatctatcaattgattgcattttatatcaccttgtaatagaaaacagtacagagataatttatctgccattacaatgcatgttacaaatttaattttgttttttaatttagggaacacagagcttaaatccccataatgattactgccaacattttgtagacactggacatagacctcagaatttcatcagggatgtaggtatgtcaggtttgtttggactacgctattgctgactctcaattacatgcatgtaathnatccaatttgtggata

SEQ ID NO: 23673 - DNA, 270 bp, Homo sapiens
  misc_feature 121: m=a or c
  misc_feature 243: s=g or c
  misc_feature 252: s=g or c
cccttgtttctttgttgactttctgtcttgatgacctgtctagtgcagtcagtggagcattacgtcccccactattattgtgttgctgtctatctcatttctcaggtctagtagtaattamctactagattatggttgcctctgctgagtcatacaggtcaccagggaagtgagggaaccccagcagtctcaggcctcaccccactcccacacagcccacagtcccaaaagctggtctcactsccaccatgscccaacccccgcccaccc

SEQ ID NO: 23674 - DNA, 59 bp, Homo sapiens
  misc_feature 26: r=a or g
tatctgatctttgacaaacctgagaraaacaagcaatggggaaaggattccctatttaa

SEQ ID NO: 23675 - DNA, 395 bp, Homo sapiens
  misc_feature 7: n=a, g, c or t
  misc_feature 8: n=a, g, c or t
  misc_feature 9: v=a or c or g
  misc_feature 10: r=a or g
  misc_feature 312: k=g or t
  misc_feature 313: h=a or c or t
tacttgnnvrttgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtackhctcttttccctcagttgatatttcttatatgatattctagatactatagaactcaatttgtcagattcagtataacctcaga

SEQ ID NO: 23676 - DNA, 98 bp, Homo sapiens
  misc_feature 19: s=g or c
  misc_feature 20: s=g or c
agttcgaaactgctaaaasscagtgccaccagccaccaacactagctgaaaccatctcttggggaccatccacccagccaggggaggatcccgagagc

SEQ ID NO: 23677 - DNA, 190 bp, Homo sapiens
  misc_feature 129: r=a or g
  misc_feature 174: s=g or c
  misc_feature 175: w=a or t
  misc_feature 176: r=a or g
ttgctgagaatgatggtttccagtttcatccatgtccctacaaaggacatgaactcaccattttttatggctgcatagtattccatggtgtatatgtgccacatttacgattaacaaaatgtggtttcratctctttgaccttgtgctctgcccaccttggcctcccaaaatgswrggattccccacgtg

SEQ ID NO: 23678 - DNA, 161 bp, Homo sapiens
agaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaagt

SEQ ID NO: 23679 - DNA, 185 bp, Homo sapiens
cttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagt

SEQ ID NO: 23680 - DNA, 202 bp, Homo sapiens
tatccatgcatatgcataatgtttcttctcataattttgttggttttacttgagatataattaacataccttaagtctttcttttaaggtgtaaaactttgggggtcttagtatatttacagaaatgtcaacaatcaccactatctaattccagaatattggcatcatcacaaaatgacactctgtactcattgagagcaac

SEQ ID NO: 23681 - DNA, 324 bp, Homo sapiens
  misc_feature 245: d=a or g or t
  misc_feature 246: w=a or t
  misc_feature 247: h=a or c or t
  misc_feature 277: s=g or c
  misc_feature 278: r=a or g
aagggctttaagactgagtaatcaggtttctgttaatattaagaggttaaaaatgattctagtattcaatatgagcttccagcctgaagttttatttaatttcaggttataaccttaaataaacaattttcctagcctcattaatgcttaatctaatgttgcataacaaagtatggacttccttagtcggttgatgctactgagaatgtgcaaatgtgtcacggccacataccagtacattagadwhctctgtttttaaacggtgtccctcttctasraacgttgtctatcctcactgctcacagtgtgctcctcaggccagca

SEQ ID NO: 23682 - DNA, 107 bp, Homo sapiens
  misc_feature 78: r=a or g
cgtgaggcaattaaacctcgttcctttaggccaggtgcagtggctcatgcctgtaatcccagcactttgggaggccarggcaggcggatcatgaggtcaggagataa

SEQ ID NO: 23683 - DNA, 315 bp, Homo sapiens
  misc_feature 219: h=a or c or t
  misc_feature 220: h=a or c or t
ctccttgttctgtgccaatgactggtgaactcccttctgaggaccatcttcttttaggtagaattacagtgatattgctaacaagtcgtctgtgagatactctgaaggtgcctttgcatgtttcctcactgtcccacatatgcctcttgttttcatattactgaaatagatcttgccatagcccctagattgagaaacaagcataagattaacttgaghhtaacctaagtctactgctatttggcctcagaggagttgctaaaaaagataaggactggttgaagacaggtaataagcgaaagatgaagaaggaac

SEQ ID NO: 23684 - DNA, 107 bp, Homo sapiens
cgtgaggcaattaaacctcgttcctttaggccaggtgcagtggctcatgcctgtaatcccagcactttgggaggccagggcaggcggatcatgaggtcaggagataa

SEQ ID NO: 23685 - DNA, 81 bp, Homo sapiens
ttagtttatttctttgtcagaatcgccaagaagccagttatcaaatagcgagccttctccccccacctttttttttttttt

SEQ ID NO: 23686 - DNA, 133 bp, Homo sapiens
ttctatatgaactaatatatatttataatttttaatatttatacatggtatattttcccacaataaagatgaaaattaaagcagttggatgtttaaaaagaaaagaaagaagttaagaatacacaccagctaa

SEQ ID NO: 23687 - DNA, 404 bp, Homo sapiens
  misc_feature 254: k=g or t
tgttgttttttaaaactaaaggagttctctccacagaccttctgcttctttccaggtcacagaactctgtatgtgggagttcggatgccgcttggccggcagagccatcggcatcaccgcactcatggccagaagcaccggagacgagggcggggcaaaggagccagccagggggaggaaggcctggaagccctggcccacggtaagggccttgggagacagggcgggtgtccatggcccaggggaatggggakgctgaggggacatgtgactgacattagcagctggtcttgattcttgagcctttttgtaggatttccaaagcttgcttctaagaagaaatgcctctaagagtcaaaaatattttcgtgaaaacttcacagttccgggcggctgggactaca

SEQ ID NO: 23688 - DNA, 124 bp, Homo sapiens
tgattaatgtttcttaaatggaattattttgaatgtcacaaattgatcaagatattaaaatgtcggatttatctttccccatatccaagtaccaatgctgttgtaaacaacgtgtatagtgccc

SEQ ID NO: 23689 - DNA, 189 bp, Homo sapiens
agctacagacacaagtaatgaaattatgagtcacttaaggggggaggtaatatgcttgtatgttacattgacattgctctgcatgtctctactgggaaatatttggatttcaatgatagcttgactggttggacattgcatcaaatacacgccccatgtatcctttctgtcgtaaagttaagaacgctg

SEQ ID NO: 23690 - DNA, 322 bp, Homo sapiens
  misc_feature 49: m=a or c
tgaaaaacacgaaaaagtcatcttagagttaagagcaaagggtatatgmgacgcagttgccagaagaggccaggctaggatactcgaagatacagtgcaggatgcctttctcctttcctggaagttattcctcatctacttctagatgaaagtgcttccaggcaattgacaagtgcagagagactgcagagggtgggagaggtggcagcagcaactacagcggaaagagaggcaaatgcattgagaggcagctcccagccataaggtgtcactgctgtttgaaagttgattcaatcaatattaataacatgatgccaacacc

SEQ ID NO: 23691 - DNA, 497 bp, Homo sapiens
  misc_feature 318: d=a or g or t
  misc_feature 320: h=a or c or t
  misc_feature 321: n=a, g, c or t
  misc_feature 484: d=a or g or t
  misc_feature 485: y=c or t
taaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgadthnttgcaaacagtgttaagtgatattgctagatggtgatatttttttcagcctaaaactctgttgaaatctgtgatcaaaatgttttaaactatccaaaaaaaatttgtatatttgggaaaatggattttttacatagcttttgtatgcagatataaaactgtadyaatgaatatagt

SEQ ID NO: 23692 - DNA, 112 bp, Homo sapiens
ttttttactagggagcagtttccccgcgcgacagttcgggagcgcgcaggcagtcgcgcgcacacacgcacgcaggcacacacacacacacacacacacacacacacaacac

SEQ ID NO: 23693 - DNA, 380 bp, Homo sapiens
  misc_feature 34: n=a, g, c or t
  misc_feature 319: b=c or g or t
  misc_feature 320: r=a or g
  misc_feature 321: v=a or c or g
ctcacaattctggagactagaagtctgaagttanggtgacaggagggcctcagtctctctgaaggatttagggaaggatccttcctttccctcttccagcatctggtggccccaggggctccttgattggtggtagcataactctgatctctttctctgtcatcacatggccgcattctctgttactgtgtccaaatctccctttcttttcttttataaagatgctaatcattggatttagggctcaccctaaatccatgataattttcatcagaagatccttaactatatctgcaaagaccctgtttccaaataaagbrvcattatgagattctgatggacgtgaatttttggacaacgctattcaactcaccacgaac

SEQ ID NO: 23694 - DNA, 327 bp, Homo sapiens
aaaaattagctgggcatggtggtgtgtgcctgtagtcccagctacttggggggctgaggcaggaggattgctgaagcccaagaggttgaggctgcggtgaactgtgttcacatcattgcactccagcctgggtgacagagtgagaccctgttggtaatacagccccttggaggagaaagacacggatcaacaaatattgactaacttcttacaagttattgtaccaaacatatggggaatacaaggaaatataagtcatgcactagaccacaaaagactcataatctaggtggcagaatggttgaaagttagaatgcacgagggcac

SEQ ID NO: 23695 - DNA, 140 bp, Homo sapiens
atacatattctatacatctgtaaatttaatcatttccagtcttacattgatagtatatagaaatatggctttttgtttttctttttggttttttgttttttgttttttgagagtggacatctgtacctttttaccgacct

SEQ ID NO: 23696 - DNA, 240 bp, Homo sapiens
tatgtagattcacctctttcatcaaatttgggagtttttcaaccattatttcttcaaacattctttctgatcctattgcacttcccctcttgagactcctgtaatgcatatgttagttcacttgatgatgtcccacaggtcccttggactctgtttacttttcttcatttttctttctgttcctcatactggatgattgattgattgattgattgatttagactgaactcaaaccatgac

SEQ ID NO: 23697 - DNA, 424 bp, Homo sapiens
agagttcagtgcggctgcgcagtagcgggggtgggcgggagcgcccttccaggagatgggttggctgcagtagtgagaggctgggggtgcggctctttccctgcagtcctgccgaggaagcgtgcgtccctggcgcttccttcttctcttccggcggagagcttgggatgtggtaatgccagccacactcctcagagccgtggccagatctcatcatatattatcaaaagcacatcagtgccgaagaatcggtcatctaatgttaaaaccacttaaggaatttgaaaatacaacatgcagcacactgacaatacgtcaaagcttggatttgttccttcctgataaaacagctagtggtttgaataagtctcagatcctggaaatgaaccaaaaaaagtcagataccagcatgctgtctccatta

SEQ ID NO: 23698 - DNA, 159 bp, Homo sapiens
aaaaatcggtacaagatggcggagggggacgaggcagcgcgagggcagcaaccgcaccaggggctgcggcgccggcgacggaccagcgacccaagcgccgcgattaaccacgtctcgtccacgacctccctaggtgagaattatgaagatgatgaccgt

SEQ ID NO: 23699 - DNA, 212 bp, Homo sapiens
  misc_feature 196: m=a or c
  misc_feature 209: k=g or t
tatcttcaaagaacaaacctacacttctgttgatatctttgttttattaacttctgatctttattattgcctcaattctactttcatttattttaatttttattctttttaaactttttgagatggatacatagcttgttgattttgccagcttgattttcttttgcagttttagaattgagttaaacatgctaamtgcattccgtaakcga

SEQ ID NO: 23700 - DNA, 280 bp, Homo sapiens
cataaagatttaaaagaaattgacccatctgagataatttttaatataacctgctcctagtataaaacccaggatataaatcatgaaacagaatacttcttcagtcttcatgaaaagctgggtggcaattttatgctcaggtttgtccactggagcttttcaagataaagacgtgaataaatacaagtgacaagtcaggcatctttgaagtgtcattcattaagaagtgagaggaaatattttaaactatgacaaaaaaacagttatgactgagggataa

SEQ ID NO: 23701 - DNA, 139 bp, Homo sapiens
tacatattctatacatctgtaaatttaatcatttccagtcttacattgatagtatatagaaatatggctttttgtttttctttttggttttttgttttttgttttttgagagtggacatctgtacctttttaccgacct

SEQ ID NO: 23702 - DNA, 110 bp, Homo sapiens
atgttggacggaaccatctgctgccacacatggggtggtcaatgctcccatgagtttactgatgcacagaaacaatcttgctgaatggaattaagcactttcttgtcaca

SEQ ID NO: 23703 - DNA, 431 bp, Homo sapiens
  misc_feature 319: v=a or c or g
  misc_feature 320: n=a, g, c or t
  misc_feature 395: b=c or g or t
  misc_feature 396: n=a, g, c or t
tcaggatctcagaccgtggtggaggaatcgctcacaaagatctggaccgggtcatggactaccacttcactactgctgaggccagcacacaggacccccggatcagccccctctttggccatctggacatgcatagtggcgcccagtcaggacccatgcacgggtgagaccctgccaggccaggatggaggggtgggggaccccaggagactcaagcctctgaagcctcctgtcctgtccccctgcccacccccagctttggcttcgggttgcccacgtcacgggcctacgcggagtacctcggtgggtctctgcagcvncagtccctgcagggcattggcacggacgtctacctgcggctccgccacatcgatggccgggaggaaagcttccgbnttgaccccacagcctttggcctgctcacccgacca

SEQ ID NO: 23704 - DNA, 335 bp, Homo sapiens
  misc_feature 253: n=a, g, c or t
  misc_feature 275: n=a, g, c or t
  misc_feature 276: b=c or g or t
  misc_feature 277: b=c or g or t
aataaaaaattcatttaaaatggagtcagtttaaggaaatatgattaactgataacttaggtcatacttttctacaaatggccagtagaaaatgttttaggctttgcaggccataggatctgttgcaactactcaactctgccgttttagcacaaaaggagctctagataatgcatcaatgaatgggcatggctgggttataatgaaactctatgtacaaaaactgggtggtggactggatttggctcacagnctgtagtttgccaattcctggnbbtctacaatgttgagaggttgggaaggtgatgacaaaccatcaaggaggctgacaggga

SEQ ID NO: 23705 - DNA, 141 bp, Homo sapiens
ctcctgcctcagcctcccgagtagctgggactacaggcgcccactaccacgcccggctaatttttttgtatttttagtagagatggagtttcaccatgttagccaggatggtctcaatctcctgacctcgtgatccacctc

SEQ ID NO: 23706 - DNA, 99 bp, Homo sapiens
  misc_feature 2: v=a or c or g
  misc_feature 19: m=a or c
  misc_feature 53: v=a or c or g
  misc_feature 59: v=a or c or g
  misc_feature 71: k=g or t
tvctactcatctttttggmgaccagggctgccctgctggcagcctgccttctvagtgavatcgactctgtktccccactttgaccccaaattggggctt

SEQ ID NO: 23707 - DNA, 291 bp, Homo sapiens
  misc_feature 2: n=a, g, c or t
  misc_feature 7: n=a, g, c or t
  misc_feature 8: n=a, g, c or t
tnctganngtggacaacaaagatgctcctggtatctgggttgaagatgtggtaaaaaacaacaaagaagacaaaaattacacataccaagatccataaatataatgccctaaacagtctgatgaaaatgtggtgaaagattggtcaccgctgtttttctgttctaccataaggcaattatcagagtggaatggccaccacaatggggagctggaaatatgatttttaaagtcctctctagaggtcttattttatattcacttataaattaagaaaattattgccttgagga

SEQ ID NO: 23708 - DNA, 62 bp, Homo sapiens
  misc_feature 19: k=g or t
  misc_feature 27: b=c or g or t
  misc_feature 43: m=a or c
  misc_feature 53: s=g or c
attaaaattttgagaagtkagtgatabagaagtactattttgmaatgttaatstgtttgagt

SEQ ID NO: 23709 - DNA, 229 bp, Homo sapiens
tactataaatggtcattttagttgtgtctatgtctcacaactttgttagatagtgttttattatcaatcagtgttttgatatttgtttcaagatttttggaagaaaccaaggggtgattaagtgtattgtttaggtttctgccatatgtgcttataaaagaaaagattattggttattgattttattttgttgcattataggaagcataacaattttatggtgttgaca

SEQ ID NO: 23710 - DNA, 261 bp, Homo sapiens
  misc_feature 124: k=g or t
  misc_feature 145: k=g or t
tgttaaggtggatgcggctgaaatgggaattatccctccataggctttgctgtaaatgaccaggtcctttagaatgtacaacctctcagtgctgctgcaagctgggagctggatttctttctgkctttcttttttaaaatccgtkccttgtgttttcctaaatagccctttaaagagaaatgcaaccccagggctgctgaatgccagggaagactcccccaccccgcagctttgaactcagcaaaccaaaaaaaaaaaaaa

SEQ ID NO: 23711 - DNA, 207 bp, Homo sapiens
  misc_feature 147: s=g or c
  misc_feature 150: s=g or c
ccttttttatgtgtgtcctctttgatttacttcatcagtgttatatagttttccatgtattcttattttatttttgttgaagtattgtaaatgggatggctttcttgatttctttttcagctaattcattgttggtgtatagaaatsctsctgatttttgcatgttgattttatatcctgcaagttcagtgaatttatcagtccaag

SEQ ID NO: 23712 - DNA, 310 bp, Homo sapiens
gaaccggcggaggcgatgaccgtgacggctgggttgggaccggaacgccgaagcggggttgggggtggcagaaaagcatctgctttgtaagacctacacgaggtgcaggagtggttgggcctcccctctccacttaagcaagcgcccagactgatggcgatggtgatggcagcagttactcgcacaaccccagttaagctgcgctccgggagatacatccagaaagtgcccagaagaaacttcctgctggaaaaaatgaaaaagcagtatttataacattagaatctggataatttgttaacatggcagc

SEQ ID NO: 23713 - DNA, 497 bp, Homo sapiens
  misc_feature 31: m=a or c
  misc_feature 95: m=a or c
  misc_feature 96: w=a or t
  misc_feature 97: w=a or t
  misc_feature 163: r=a or g
  misc_feature 164: m=a or c
  misc_feature 310: r=a or g
gcgcttcggaagcatggatgtgcgcctgcgmtgcgctagggcgcggacgggcggtttgaattttgcttacagagttccgtctcaccatcctgggmwwccaacggagactgcggtatccgcggctggagacccagcggcgagtagccttttgctcccggacggrmttgagaggcttaaaggatggcctcgtcagatctggaacaattatgctctcatgttaatgaaaagattggcaatattaagaaaaccttatcattaagaaactgtggccaggaacctaccttgaaaactgtattaaataaaataggaratgagatcattgtaataaatgaacttctaaataaattggaaattggaaattcagtatcaagaacaaaccaacaattcactcaaggaactctgtgaatctcttgaagaagattacaaagacatagaacatcttaaagaaaacattccttcccatttgcctcaagtaacagtaacccagagctgtgtta

SEQ ID NO: 23714 - DNA, 358 bp, Homo sapiens
  misc_feature 122: s=g or c
actactgctgccagcggaccgctaggagtgagcatcccctctccgggatacccagctccgcggcgtctcccgcgcgccctggccccacacggacctgccagccccagggaacaaaagcggasccgctcgccctctactgcagccggaggatgagtcgagagggctgagcggagagtgtggtcctcggcggctggagctatttccttggcttctctccatgacgattcctgactcgtggccccggcaatcttgggaagacatcatccagcttcttcagtccagaccctgggcaccccccttttgccaggatcgtccccacccagcctggacacattgactgaactgttttctaggacac

SEQ ID NO: 23715 - DNA, 401 bp, Homo sapiens
  misc_feature 74: s=g or c
atttggtcaaagccttctcctcaagcagtacttcaccctcctgcactagacgcctccagggagctggagcggasagggctcggtgggccagctcttagcaacccagggctaagacccggtgtggagaggaacaaccacagacgcggcggcttagctaggcgctctggaagtgcaggggaggcgcccgcctgccttggctgccgcacccttgacctctagtttcagctgtgaacctgggcggaggaataattgaggaactcacggaactatcaactggggacaaacctgcgatcgccacggtccttccgccctctccttcgtccgctccatgcccaagagctgcgctccggagctggggcgaggagagccatggaggaaccgggtgctcagtgcgctccacc

SEQ ID NO: 23716 - DNA, 123 bp, Homo sapiens
gttgtttggtagacaattcatttttgaattgtgaaggagccagttgaactcatgttagagaatatgtgtctatttaccaaactgcctcttcaaggtcagtttcaaatttctttttttcttttt

SEQ ID NO: 23717 - DNA, 173 bp, Homo sapiens
  misc_feature 19: n=a, g, c or t
atacataatagtatttaanatattttcttttagtagtttcatagtttgagatcttagatttcagtctttaatccactttgatttgatttttgtatatggagaaagataggggcctaatttcattcttttgggtataaaaatccagttttccctgcaccatttattgaggagac

SEQ ID NO: 23718 - DNA, 257 bp, Homo sapiens
cttccatccctctaacccagctcctagcatctagtgcttcttggacttttgtaccaagtagccccaacagtaggagagaggtctggggataagtgaaatgaatatgactatttgaattaccactatcagttttagtatcttgaggcttcaagaactgctctacctagcaccaccaccttccctaaggacataagtacgtactctagactgaaaggttctactatacaccatctaatctgatcattccccggttccgg

SEQ ID NO: 23719 - DNA, 192 bp, Homo sapiens
cctttagtattagtagaaatagagctaaaatagaaaagatgccaagttgagtttcagacgctttgaatttgaagtgatgatagaacatctcggaagctcagataaatgacaggtttaatgataaagaattgggagtcaaatgcagagtgaggcaggtgaatactatgtgaggagatttgcactgaaagaacc

SEQ ID NO: 23720 - DNA, 371 bp, Homo sapiens
tattatcacttcacactcatattcttattttattcaataggttataatccattgcagttatttaatgttcaaattgtcttaggtctgaccagagggtgtccctggttcctatgtcttttttaaaaattgagctataattcacttaccattaaactcactcttttaaagtactctgtccaggtgcagtggctcatgcctgtaatcccagcactttgggaggctgaggcaggtggatcacctaaggtcaggagttcgagaccagcctggccaacatggtgaaaccctgtctgtactaaaaaatacaaaaattagctgggcgtggtgtcatgtacctgtaatcccagctactcaagaggctgaggcaggagaac

SEQ ID NO: 23721 - DNA, 65 bp, Homo sapiens
ctaaattttgactagttactttttattatgagttaatatagtttagcagtaaaaaaaaaaaaaaa

SEQ ID NO: 23722 - DNA, 138 bp, Homo sapiens
tttaagttcaggggtacatgtgccagtttgtttcataggtaaacttacgtcatgggggtttgttgtatagatgatttcatcacccaggtgttaagcctagtacccattagtaatttttcctgatcctctcccacctcc

SEQ ID NO: 23723 - DNA, 95 bp, Homo sapiens
cttgtctgtgatctttgttcttgacctctagaccccaagatgtgaacagtgcacgtgttaatgtcatctttgctcatgtgttataagccccaagt

SEQ ID NO: 23724 - DNA, 213 bp, Homo sapiens
catgaaaaaatattgccaaaaagattgcctaatctgaacaagcctctaaatttaacaaacattaaaaaaaaaggatttatacagggggcagaggaatgtgttaaataaaactatgggagtgcaatcagcaacatttagaagtaggaaactacagaaaaataacctggagtttcaatagttgccaatagatatgaaaaaaaagatggagggtcc

SEQ ID NO: 23725 - DNA, 112 bp, Homo sapiens
ttgcttgggctcccccttcatggcctctgcacctccacactcccaaccactgacccttccacatctaccttccaaagaccatcgttttctctgcttccaaagacccccccca

SEQ ID NO: 23726 - DNA, 59 bp, Homo sapiens
taaaacctcacatcagaatgaagattctgccaaagagattagtggaagttttttttttt

SEQ ID NO: 23727 - DNA, 272 bp, Homo sapiens
cttcggtgactttctccaccacacgcgatctcttcttcaacaccgacagcccgaggtccagcatcacgagagtgaggatcaccgtgaggccggtgacgagcgagtagtcctcgcccagcagcgcgttctgcgtcgcctcgctgatgatcagcagcaaaatgaagtcgaacgtcgacagctcactcagcgtgcgcttgccgctcagccggaacagcaccagcaggaagaggtagatcgcaagcgcgcgcaggatcgtgtccaccgccgggcac

SEQ ID NO: 23728 - DNA, 95 bp, Homo sapiens
gagattggagcaagaatcagtaccacgactgcagtgcccctggacccctggcctgtggggtgccctacacctgctgcatcaggaacacgacaaga

SEQ ID NO: 23729 - DNA, 413 bp, Homo sapiens
  misc_feature 211: n=a, g, c or t
cagaatttttaaaatatatagtcaagaatattaagattatatgaaaatggagtcagtgatttttagtaaaggctcaagagaaatcttggtaaatgaaaactgtattaaatctcacataaattttgctctgcagaaggtatctcaatataatttatcaatacttcatatttgcataattcacataattcacacaagtacatatgtaatggcnatgaagcatggttattattaatatgatattatgaatatctaccagagctctctcattttctttcttggagacataacataattatatgtgcaattaaattttgtacccattgtattgaagaataatgctcttttctataaagtaaatgaaagagagggatgtttgttattgtgtttgctcatcaatgtctcataattggcat

SEQ ID NO: 23730 - DNA, 91 bp, Homo sapiens
ctgtatcttttgtaatgtcattcatagaaaactggtaaatgtgtttccctgagtactttgagccactctagcaattcaatttaacccacat

SEQ ID NO: 23731 - DNA, 287 bp, Homo sapiens
tgttatatgacaggtactattctcagtgctctatgtatcttcatttaatcctcctgacagccctacctggcagatactattatcccctttcatggaagaggcatctgagacagagaggttaaagtaacttgtgcaaggatacacagctaataagcaacaagcctggatgagaacccagaaaggctgggtctatgggtaaaaccacaattccttatcatcttttcacatgagctttagctacagctagtctggctctaattttaggaggtatttttgttggagtctac

SEQ ID NO: 23732 - DNA, 118 bp, Homo sapiens
acacagatatccttcctccgcgcgccgaggagtcccgacgccgccgccggcttcgcaggcgctgagggtgagaggcacgctaaactgctcggctccgccacataacgaagcgacaatg

SEQ ID NO: 23733 - DNA, 231 bp, Homo sapiens
  misc_feature 101: r=a or g
  misc_feature 113: w=a or t
  misc_feature 117: k=g or t
  misc_feature 118: v=a or c or g
  misc_feature 124: m=a or c
  misc_feature 143: r=a or g
  misc_feature 144: r=a or g
  misc_feature 166: m=a or c
taaatagggaatcctttccccatttaataaatggtgctgggaaaactggctagccatatgtagaaagctgaaactggatcccttccttacaccctatacaraaattaattcawgatkvattaamgacttaaacgttagacctrraacaattaaaaccctagaagamaacctaggcattaccattcaggacacaggcatgggcaaggacttcatgtctaaaacaccaaaagc

SEQ ID NO: 23734 - DNA, 417 bp, Homo sapiens
  misc_feature 237: r=a or g
  misc_feature 259: k=g or t
  misc_feature 294: r=a or g
  misc_feature 295: m=a or c
  misc_feature 296: w=a or t
  misc_feature 315: r=a or g
  misc_feature 316: m=a or c
  misc_feature 317: n=a, g, c or t
  misc_feature 389: r=a or g
cagtttgtaattttgggaggctggaaaagcaacctgtcttcatgttctgccaagctattatattcagctatccttcaacccacccattcatcctgattttgggaaacaagaaagctaaaagcagatttttctttcagttttgcggcatgtgaggtactgggtgaaagacagaagccttcgtctccatagattcacaagaggggcattgtgtgtcttctagcagaaaacaaactggtrgtgtatgaaacattttatattkcttactgggttttctgtaatatatgtatatgaatrmwttccacatgtatacctagrmnagtcttttacctaaagttagtctagaaaagtacatatatatagatgtgtgtgtgtgtgtgtgtgtgtgtgtrtgaaaaactgaagaacattgacaataac

SEQ ID NO: 23735 - DNA, 491 bp, Homo sapiens
  misc_feature 265: n=a, g, c or t
  misc_feature 266: n=a, g, c or t
  misc_feature 287: r=a or g
  misc_feature 288: r=a or g
aggaacaaaacatttctgttatagggcctagcctaaagcgtggaaactggcagcgtccacacaattcatgaaacgatgttctacatttcaactccatcaaatattaaatttgatggttatgggctaacctggaaaccgaaaaacagtttgtttcactacaagaataagaaaatatgtccaaattcctgtcagctgacttataaagggacttttagaacacaacccaatgcatgaggtactccttaagccctgacaaccatcttgnngatggaatcatgaatatggcrrattttctacggggctttgaagaaaaggggataaagaacgacaggcctgaggaccagttgagctatgatatgtgcttgtgtgtatgtctatgtgtatatattatatatacattagacacacatatacattatttctgtatatagatgtctgtgtatacatatgtatgtgtgagtgtatgtatacacacacacacacacacacac

SEQ ID NO: 23736 - DNA, 182 bp, Homo sapiens
  misc_feature 115: k=g or t
ccatttgtcaaatttggcttttgttgccattacttttgattttagtcatgaaatcttttcccatgcctatgtcctgaatgatattgcataggttttcttctagggtttttatggkttttaggtcttacatttaagtctttaatccatgttgagttaatttttgtgtaaggtgtaaggaaggt

SEQ ID NO: 23737 - DNA, 93 bp, Homo sapiens
atcaccgagtgccgggccgacagcagcccggaggttggctatgtgaccaggcaacatgctgagccggcttcaggaactgcgcaagaaggaggt

SEQ ID NO: 23738 - DNA, 193 bp, Homo sapiens
atggtaatgagcggctctgtctagcgaggagcgtgtgaaacccgtcaatcctgtttgccatttccccgtggatttccgaggagaggttctgcaggatgcccccaggtgatcctccgactgtgaaaaaccagacctctggctgcctggctccctaggaatcaagaagacgcacagactgaaaatcaagggaagt

SEQ ID NO: 23739 - DNA, 189 bp, Homo sapiens
gaccaatttttccagatctctgtttgtggtgaggtgtaattatgtgtgtttttcctagcttagtgtgtgcgttctttctttttgtttctgagaatgctgtgttgagggggtttttggagaaaacggtggggttgggaggttgtagtacttcaaacaaaggtgaacggttttttaggtgagtgagcgtta

SEQ ID NO: 23740 - DNA, 204 bp, Homo sapiens
aggtttctttgcaggaggtgagattttggtacctctgtcctggcgtccggaggcagggcccgggagcattgagactattgcgagagaaaggaccgccgcacggtggtagcgagcgcatctttttcatctgggacctcggaaactgtggtgacccataggtgctgggcttcttggctctcgtcctgagaaagtgctcacagtgct

SEQ ID NO: 23741 - DNA, 98 bp, Homo sapiens
  misc_feature 2: s=g or c
  misc_feature 10: y=c or t
  misc_feature 16: s=g or c
  misc_feature 17: k=g or t
  misc_feature 31: s=g or c
  misc_feature 32: m=a or c
  misc_feature 33: m=a or c
astgtctcgyttgcaskcggcgctttagggsmmctgtcttcctccgcaggcgcgaggctgggtacagggtctattgtctgtggttgactccgtacttt

SEQ ID NO: 23742 - DNA, 130 bp, Homo sapiens
tttccaagattcccccaattactatgatgttaagggaggagaccacccctcatattgtcttatgcccaatttctgcctccaaagaaagaagtagtaaaaagtaaaaggcagaaatgaaatccacaagcga

SEQ ID NO: 23743 - DNA, 306 bp, Homo sapiens
  misc_feature 287: v=a or c or g
caatttggtggttggtggggcggaggtcaggattttgttttaatactattgtaattaaaaatggaaaaagttatctttttctcctgtatatatattactatatcttcgagaacgtgtttcctcctttgtattagtttcctgttgctgatgtaggcaaattaccataaacttggtgacttaaaacaacagaaatttattatattttagcctggaggtcagaaatacaaataggtctcactgggctaatatcaaggtatttcttgggtatgtattataatagaaaagavaggtatagagagaagagct

SEQ ID NO: 23744 - DNA, 464 bp, Homo sapiens
  misc_feature 8: r=a or g
  misc_feature 219: d=a or g or t
  misc_feature 220: r=a or g
  misc_feature 221: w=a or t
acaaaagragtcaatgaagttatacttacgttaaattggtggttattgtaggtcagtggttttaaaactcaacaatgaaactgttttcaaaaagagttgttatacagaacagaaaaaagcagccacaattttaaaaaagatatgaagacccagattctcactaactcattcagctcccttcatactccctccccacagccacctcagctcctgaggcadrwtcccagggctccaaggaacatacttttaaaaaatcagtattttgaatatataataagtgatgtaacttaaaagtatggtgagaaagtcccattgccaagagaaacatgttaattttttatttaaaaaaccatcactcttttcattgtgacatcttgaagaacgctgaatggcttcaaaataactgcatatgccaagatttctggagtgggcacgtttggtcttctttcataatgaaaactgac

SEQ ID NO: 23745 - DNA, 134 bp, Homo sapiens
catccagtgaaagtcggactgtccgatgcatttgtcgttgtccacaggatccaacaaattcccaatgttcgaagaagaacaatttatgaataccaccgagtagagctacaaatgtcaaaaattaccaacatttc

SEQ ID NO: 23746 - DNA, 139 bp, Homo sapiens
  misc_feature 4: s=g or c
  misc_feature 11: m=a or c
  misc_feature 70: m=a or c
  misc_feature 71: m=a or c
  misc_feature 99: s=g or c
  misc_feature 113: m=a or c
  misc_feature 118: m=a or c
acasgagtgamaaacagatctcgttcctcttccctgtgtcatcttcttaattataaataatgggggatgmmgataaaagaattacatatgaagattcasaaccatccacaggmatgamttacacgccctccatgcatca

SEQ ID NO: 23747 - DNA, 127 bp, Homo sapiens
  misc_feature 118: y=c or t
  misc_feature 122: s=g or c
caacttttattttagagacgggggtacttgtgcaggtttgttacatgggtatattgcatccaggtagtgagcatagtacccaatagttagtttttcaacccatggctcttctcttccytccsgcttc

SEQ ID NO: 23748 - DNA, 202 bp, Homo sapiens
  misc_feature 69: s=g or c
  misc_feature 70: s=g or c
  misc_feature 101: s=g or c
ttactaataaggccaaggggccgggctcagtggctcatgcctgtaatcccaatactttggaaggccaasstgggaggattgtttgagcccaagagcttgasaccagcttgggcaacacagtgagaccccatctttacaaaaactaaaaaaattagctgggcatgaagatgcatacctgcggtcccagctactcaagagggcc

SEQ ID NO: 23749 - DNA, 259 bp, Homo sapiens
  misc_feature 121: s=g or c
  misc_feature 194: s=g or c
  misc_feature 241: s=g or c
  misc_feature 253: s=g or c
actgtggtggtgtgagtgggaggcggcggcgctggtggctgcagctggggtgaggcgcgaggcggcgcactcgacggctgactggagcagcggtaaaggcgaggatggagaccgaagtttsgggagtgggaaagacagggtcatgggcagccctggccactaggagacggaaatgcgggagcgagggaagggasgggtctggcctggttaaagttccccagtgcctccttgtgcatagacsttcttctcccascccccc

SEQ ID NO: 23750 - DNA, 328 bp, Homo sapiens
  misc_feature 48: v=a or c or g
ttttttaaaataaaagctcttataataaaatgtacatatccaattttvagataacagctaacatttgtgtagcagtatgtaccaggcattgttacaaatgctttacatatattgacttatataatttctgcaatagtagctgccattaacatcaccattttatagatgagaaaactgaggcaaacagagagtttacagtagagctgggacttcaacctggaattttacttctggaatatgtactcttaactactgttatatggtcttcaaattaactgacttacctctagggaatacagttaccataataatgctactttaaacaccc

SEQ ID NO: 23751 - DNA, 425 bp, Homo sapiens
  misc_feature 336: m=a or c
  misc_feature 357: m=a or c
  misc_feature 358: k=g or t
  misc_feature 359: h=a or c or t
tgccctgtaatatcttccttccgagactgtaagatcttttgaaagatcttgtgtgtattttcatattgtgtctacagagccagacacatttttgactcagtattataaagctaaagacaaaaagctacacaaatactgacatctagttagtaaatctgtttcagagatatgactagcagttttgaaattactttatgtgcatattagcattggaaaaatatgtttacttttgtaaattatagatgtgagtagcaaacacttgtacaaaatgtcctttgcaaagaaaatttcttcctttaaaagtctaaatacaaaaatacatttgtggaatttggmtgttcagcttttttcaagtcmkhattaatttctgaatattgttttttctacccaaaagaatgtatagctctctaataaatccttcacta

SEQ ID NO: 23752 - DNA, 204 bp, Homo sapiens
tgcaaattaaatccacaggagacacctgggcacaccctccagaaagcacacaatgacctgctggcaaggacaggaacgaccactttggaaaactctttggcagcacagccaaactgagactttccactcgaaaatgccctttgctcagaacccagcagcagctccaaagtctccacccagcctatggggccccagtacccactt

SEQ ID NO: 23753 - DNA, 416 bp, Homo sapiens
  misc_feature 260: v=a or c or g
  misc_feature 271: v=a or c or g
  misc_feature 272: n=a, g, c or t
ttctgctcgaggagcccattagagacttggcacccaaagtttctattgtaggttggtcctgtaggcactttctgctttgcatgtaccaaaattccacattcccagaaggaaagcaggtattcaacatgacccacttttatttgcacaaacaatctagtaaaaggccaaccttggcagcaggtcttcctaaggatactagtctcagtctgtgcacataagctgaatgtgtaaaatggttaaatactggacccttctgtaavtgatcacatgvnaactgcttaagggcagaagtgggccagtttaataagaatgagtttaaatacatgattcctgttgtatttggggcatgctaaaaaatattgggagtcctttaggttaagttaaagacaataacctaagcttacaggattttaaac

SEQ ID NO: 23754 - DNA, 171 bp, Homo sapiens
cagaatagcatggaattaggtccttcagtccatttctatgcttatttttgaatttttaaattttaatgtcacatggtcatctttaatgttgcattttctcttaatgtgaaagattaatatatttatcatctttcaagagtagctgttccagttttttaataagcagaccct

SEQ ID NO: 23755 - DNA, 168 bp, Homo sapiens
cagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccata

SEQ ID NO: 23756 - DNA, 185 bp, Homo sapiens
catttatctcagcatcatttatcgaacagggagtcttttccccattgcttgtttttgtcggctttgttgatgattagttggttgtaggtgtgcagccttatttctgggcttatattccattttattggtctgtgtgtctgtttttgtaccagtaccatgctgttttggttactgtagccccttgt

SEQ ID NO: 23757 - DNA, 301 bp, Homo sapiens
  misc_feature 183: r=a or g
  misc_feature 264: w=a or t
taaccttaaaaataattcagaaaaaagataaatgcatgaagacatttatgtctgcattctttataataacaaaaattggggaaaaaaactccatgtcaagaaagtgggataagaaaaatagtgaagtattatactgccattaaaataattatttggaagactgtagaaacgtggacatgtttratatggtaagtaaaatgagcacaatacaaaatagtatgcatactatgattgtgactttgtaaaatctttatgcatgtggawggtaatctgcaaaacaaattcattgtgttagtgtagc

SEQ ID NO: 23758 - DNA, 228 bp, Homo sapiens
  misc_feature 167: w=a or t
ctttttctctttggactaaatttcatactttgtttccgtttcatgtttcaaatttgttgtcataaaattgttcttaatatccccttatgcttttaatgtttttaggatcttagtggtatcccctttttatttcttggtattggtaattttgctctctcttttttgtwttttattaatttagccagttgatttatcaagtcttttgatgttcttaaaaaaaaaaaaaaa

SEQ ID NO: 23759 - DNA, 383 bp, Homo sapiens
  misc_feature 178: s=g or c
  misc_feature 205: r=a or g
  misc_feature 358: r=a or g
  misc_feature 359: d=a or g or t
ttaaatcagttcccttcttaaatactaaatgaacagtaaaaccctgatttactggaacataatcagaaatttttctatgctctatttgtattaatgaggaaagcacaattaaataatttatgttgggaaaataggaaaaacaaaaccacaggttagctaaacctttaaccttattgtstctaggcagtacagtgctgtgattgaratggtttaggatgatgactggcattggaatcatctctatcctgaaagattaatttggtcaccatttctggctaaagggtaatagtgcattttagaaataaattttggcaatgattgatacacaagaaaaggtttaactcttagtaaaccagardaatcagttaaccagaacacccacg

SEQ ID NO: 23760 - DNA, 122 bp, Homo sapiens
cattaataataatctttggccttcttaatatctttgggattgtagaggtaattcccattttattcttgatattggtaatttgtattcttcctatttaaaaaaaaattaatttagcttgccta

SEQ ID NO: 23761 - DNA, 364 bp, Homo sapiens
  misc_feature 153: r=a or g
  misc_feature 154: w=a or t
  misc_feature 270: v=a or c or g
  misc_feature 319: n=a, g, c or t
attttgaaagtctgcatggattataaaatcttgttgtagcgaagtctgattcttctttccattataaagtactatactactgatcagtttttttagtctctctactctcttagccaagcaagatgagttcgtctgttggggcacatacatttrwtttcacctgggcagacacccattatttgtagaacctaagacacctgccagttggtgagtcatcttattgctatggcttcagaggactgctgtacagctggagtatttaggcttgavattgtttgattaggtatgataagcacattcctctgatttacaggttgcnatatataggtaacttatattgaactgtgactagttttgaggtagt

SEQ ID NO: 23762 - DNA, 321 bp, Homo sapiens
  misc_feature 184: d=a or g or t
  misc_feature 248: h=a or c or t
  misc_feature 250: m=a or c
  misc_feature 316: s=g or c
agttcagcagcgccggcggggcgctagtgcgcaggctcggccggtccctccagcccgcagactgcgcgcagggagaccttccccaggttggtcttcccaggtgcctcagccggtgccttcctctgtggaggcttccctagggaaactggaggccatgtcttggcggttagcccccaggatgaadacagcaaaaagagggtgggtagctgaccagagatcacagtacattagggtgccaagctgacgchcmtcagaaatctaggaccttggaggccacgtgactattcatcgcctgcaacaaaatcttaactagaascggga

SEQ ID NO: 23763 - DNA, 397 bp, Homo sapiens
  misc_feature 7: m=a or c
  misc_feature 148: n=a, g, c or t
  misc_feature 182: m=a or c
aaccggmcccgcctttgctcggcggagacagcacgcagagaggtctgttttacagatgaggaaactgagacccagaaaggtggaagcacttgtctaaggtcacgcctccaggaagcagtgtgtccacgactccagtccaagtggtcangctccagagcccacagtcccagatcagcctgtcmtcggggaccctgcttctgctgctgggtgtggcggctctgaccactggctatgcagtgccccccaagctggagggcatcggtgagggtgagttcctggtgttggatcagcgggcagccgactacaaccaggccctgggcacctgtcgcctggcaggcacagcgctctgtgtggcagctggagttctgctcgccatctgcctcttctgggccatgat

SEQ ID NO: 23764 - DNA, 220 bp, Homo sapiens
aatgcctcgttggtgtctctcctgctttcgtggtacagcctcatgtatgctcaccacagctgccagcagcccttctcagcaggcacatctttttggatatagatgctctctttcagagcacaccacaggcaccaggccctatgggcaaattacatcaagaaccatcctttttcttcaaaggttcaaggtgggccccagataacatttttataagctgcat

SEQ ID NO: 23765 - DNA, 363 bp, Homo sapiens
ctagtagaatatatttctcttttaattctgtatacagtatgagtaactccagtttaaaacactggtattttaatgagtttaaattgtactgttatatattatgatacatatttttcttctggctgtggtttagtttttaaaatttttgatgtccattttaatttttagaaataaaaacttaaaaatatgggtggaagtagatttcagtttgatgattatcttggtgaaagtatagtacctgtgaaatggtggtaataatttgattctttattctattttgattgtagctccttttgtaaggagcatttgtaaaatttagttgctttagagttatacaaatccttttattaccatttattaact

SEQ ID NO: 23766 - DNA, 197 bp, Homo sapiens
cgcttctagatacgctcctacaagtaaaacttggctttctgttggttgtctggtactactatgccaatagactccctattctttagtccttttaaaaaattaaacagatgcaagaaatatgtaagtattaagactgtttatgttgtggtgtttctgcaactgactgcaaacacgtgtgtattttttcccacccatac

SEQ ID NO: 23767 - DNA, 104 bp, Homo sapiens
tcatatgtgaggcgtgtgctgggcagtgaaggaaatacccagaatcatccctgcctcctagagctgcggggaggattagacaggcaggaagaaataccggacaa

SEQ ID NO: 23768 - DNA, 54 bp, Homo sapiens
cttcttcccgagggcggcacgagggaagaaggatctgggaaaaattaagaaact

SEQ ID NO: 23769 - DNA, 194 bp, Homo sapiens
  misc_feature 169: k=g or t
cattaagaacttgaggtctgaagttttgaatactaccttcaccacctgtgatcttgggcaagttactaacacatttccttgtctatatctagctaccttattagatattaaatgatcgaatgagggttaaatgattatttcatgtaaagctcttagccctgtgcctggkacatagtaaatgctaaataaatagt

SEQ ID NO: 23770 - DNA, 168 bp, Homo sapiens
ggtaccttcagttaacagtcgggtttcgtttgattttgttacggcgcccctgggccttcgattaataaggttcggtcaacggacaagtgagcggttccattgctcgtcagtcgatagggggagtcggtagtctgtccgaccgtaccattaggcgcctgggccggagga

SEQ ID NO: 23771 - DNA, 224 bp, Homo sapiens
tttacataaccgtcagtaatagactacttaatattctgacaaattttaaaggtcacagaacaatcgtaacttttcccattgattattaagattgccttgcatggtcctttttaagaactgctttttttgaggttaagaaaaatgattcatgtaaaaaaatttatcttttatacagtaactttgtggtagatcagtcttctgtggcttttagacttagagccgct

SEQ ID NO: 23772 - DNA, 350 bp, Homo sapiens
tcactccttcaacaacttccagatgaagatcgggctcaacatcggccccgtggtggccggggtgataggggcacgaaagcctcagtacgacatctggggcaataccgtgaacgtggccagccgcatggacagcaccggtgtacccgaccgcatccaggtcaccacagacatgtaccaggtgctggctgccaacacgtaccagctggagtgccggggcgtggtcaaggtcaagggcaaaggcgagatgatgacctacttcctcaatggagggcccccgctcagttagcagctgttggccaatggtgccaggcagcctggcctccagaggcatggaagcagcttctctgtgt

SEQ ID NO: 23773 - DNA, 193 bp, Homo sapiens
attacaggcgtgagccaccgcgcccagccaaggagagctggtattttaagagataactggcttcaggttttacaaaaataatgagaaaccgattcacagatcccagaaggaaaacacatcccaagcagaataaacagaaattcacacctgcatgcatcataattaaactgcagagtactgaaaacaaaagaga

SEQ ID NO: 23774 - DNA, 373 bp, Homo sapiens
  misc_feature 364: s=g or c
taacgcctcctagctctgaagagagcatcctctcatatggacgtcccatgctggttttcccatgaaaatctacggccacgtctcaacgcagcaaggacagcgacggtgagaccccggagctgcactcgcttcccaccagtgccctctgggaagctgtcaaaggctaaactgtggaccagaactcaggctttgatttcacctggctaaacaacaaaagttccagaaagggagagctgaaactggcaagaaaacaaagcacaaaatgcctccccgggatgtaagcgtctctgccctgcagcctgagatcagctgattggccagcatcctgcactgctcaggaatattaaacctgcccggctccgasaactttcaa

SEQ ID NO: 23775 - DNA, 160 bp, Homo sapiens
  misc_feature 82: w=a or t
  misc_feature 99: w=a or t
  misc_feature 101: w=a or t
ccattttgcatctccacctacactgaataattttctctctgtattcttaccaacacttggcattgttggtctttttcatgtwagcccttctagtgggtwtwtagtagttttaattttcatttcttaatggttagtgatgttgaacatcttttcatatgtt

SEQ ID NO: 23776 - DNA, 60 bp, Homo sapiens
  misc_feature 14: h=a or c or t
  misc_feature 42: m=a or c
cttttctgattgchatagtgtcaattggccaatctcttctcmcagggaaaaaaaaaagta

SEQ ID NO: 23777 - DNA, 105 bp, Homo sapiens
  misc_feature 41: k=g or t
ttcttccaatccatgaacatggagtatttttttcatttgtktatgtcatcactgatctctttcagcagttttttgtagttttccttgtagagatctttcacctcc

SEQ ID NO: 23778 - DNA, 345 bp, Homo sapiens
  misc_feature 115: m=a or c
  misc_feature 240: n=a, g, c or t
  misc_feature 241: d=a or g or t
  misc_feature 258: s=g or c
  misc_feature 281: d=a or g or t
  misc_feature 282: d=a or g or t
agctgtggtggttcacacctctaatcccagcactttgggaggctgaggcaggtggatcacttgaggtcaggagttcgagaccagcccggccaacatggcaaaatcccatctctamctaaaagtacaaaattagccacatgtggtggtgggcgcctgtaatcccagctacttgggaggctgaggcaggagaattgcttgaacccaggaggtggagactgcagtgagctgagatcgcaccandgcactccagcctgggtsacagagcgagactctttctcaaddtaaatgaaacatttaaatgcgaaaaatgtaagttaaaatcaaaaagcattcagaaaagggtga

SEQ ID NO: 23779 - DNA, 105 bp, Homo sapiens
ctagataatcctttactcaaaatcataagttaaagattcacatcattaagagttatctaacttttatgttgtcaaatctttaaatgtggatgatattcagcagct

SEQ ID NO: 23780 - DNA, 209 bp, Homo sapiens
  misc_feature 120: b=c or g or t
gcttcctcccagtcagtggggagggtggctgcagcatcccggggaagccagaggatctgcagagaggagaggtcagagaaagtggcgaacttggaatgataacacgggagttgacaaggbaccctgctgagggtactcagagctggaagaagtgtcgatgagggaccccgctaagggcactcagagctggaagaggtgtggacgaggcc

SEQ ID NO: 23781 - DNA, 252 bp, Homo sapiens
ttggttgaattatatagtagggactctactaaagacaagaaaataaggggtgttccatgggacacccacagagggtgaactttgaatgtgtgtgggtgggggctggtcgggaaatgggaaaatctgcctataaaattaatgtttcagtttatttttcagattacatgcctttctttataagggatgctggcacagaccccctaaaataagcttttggtagtactgtacctttgaagagtggtgaaggataca

SEQ ID NO: 23782 - DNA, 428 bp, Homo sapiens
tgaactcctgacctcaaatgatcctcctgccttggccttccaatgtgctgggattacagatgtgagccaccgtccctggccagatgatgcagatttctcaacatctgcaagcttgcaacataaatggccaaaagcaaggaaattccaagtgcatgcttacattccatttttccttgatacttttggcctggtgatttattatagggtttcagatgagtgtgttctattagctgccatatgtacacaaaacaccaggggacaaactgaggaccaaggggacagctgaccgttgaatatctccaatttggggattaagtttgaaatggttggtttgtgaatggtaggaggaatctttagcctatgcactgagcctgtcagcttggatgatgaccatgcccaagagtggagccttactccctggagtcata

SEQ ID NO: 23783 - DNA, 146 bp, Homo sapiens
tacctcaacttcctgagtagctgggactacagatgtgtgccaatgggcccagctaatttttaagagttttttggagagattgggtctcgctatgttgcccaggcttgtctcaaattcctggccttcagcgatctttcagcatcagc

SEQ ID NO: 23784 - DNA, 167 bp, Homo sapiens
attttgaatcctgagaaagacgcgctcaaagaacccagcgaacaaaggagagggttggagcccacgcaaaacatgggtgtgataaagccacacgcgacctgagcccccaccctcagtaactactctccagcgcccaccgggaggaggggtccggggaaaggattgtc

SEQ ID NO: 23785 - DNA, 119 bp, Homo sapiens
actttgaactgcttttcttttctcctttttgcacaaagagtctcatgtctgatatttagacatgatgagctttgtgcaaaaggggagctggctacttctcgctctgcttcatcccacac

SEQ ID NO: 23786 - DNA, 350 bp, Homo sapiens
tatgttggcctaccatctgaagctgtcaatatggtgtccagtcaaacaaagacggttcggaaaaattagaagaaaataacatcatgactcaagaatcaagagcttgctcatcagtttggaaggaatttggctccgtgggacgttgtaatgtgcacagacatttccaaggaaattctaaacagtcacccttcccttttgcattcccccaaatcttaagtgtatacataaaaccctgggtacatattgttgtggtaatagaagggaattggttaaacagtacacttgtttatggaactttctgtggccacctacgaaagacaagttaacaaactgtcatggaggctgttgtt

SEQ ID NO: 23787 - DNA, 368 bp, Homo sapiens
  misc_feature 32: w=a or t
ctcttagtcactgctgtgtgtcagtctccctwggcactagatacaatggtgattagggtagcataatgagccttttggactgcttgcaaaccatgaactactgcatctttgagttttaagggcttagcttaggactaggggatatgcatggaagcccaaatcataggtgtcctttatctgtgggatcaaagtttgtcactcagcatcctgaacattgtgtgcctttaaacaaggcaaatctgataccataatttggacaacaacttagccaaagcatcatttctgtatatggaggccaagtagtactaacaaacatgcaaattctaattttaaaactcagacaaacattttacagctaaaacaatcca

SEQ ID NO: 23788 - DNA, 209 bp, Homo sapiens
atttcacaagaagcacttattttagccataggaaaaccaatctgagctacaaatagttctttaaaataagcccaggttatttagctattctagaaagtgccgacttctttcaagaagcaggcattgtaggacagctgagaattatcacatagcctaaattctagcctggcagcaagagtcacatctgagatgtccaaaaaaaaaaaaaa

SEQ ID NO: 23789 - DNA, 202 bp, Homo sapiens
  misc_feature 7: s=g or c
  misc_feature 32: m=a or c
  misc_feature 33: w=a or t
aattctstctctaatctctgcaacagccgcgmwtcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagacccct

SEQ ID NO: 23790 - DNA, 201 bp, Homo sapiens
taatgaatacccattgtggctttttccctcattcacctgggaggaaccatctattgtcctgtcttgaagggagttccttctaggtctggttggacctttgtatggtaattcattaagagttagatcccctgttagcaaacctgctgggttaagggaatgatcagtggttaatgttaaatcatctttttctgacagaatcga

SEQ ID NO: 23791 - DNA, 79 bp, Homo sapiens
agtgtgatggaggagaggatgggtgagcagggccttgaaagtctggctaagattgtgaactgtggaattgaagggcact

SEQ ID NO: 23792 - DNA, 201 bp, Homo sapiens
aatattttcttctgatttttaggaatatttcatatatttaggtctcttctgtatctgtaatttattttgtgattgatgagaggcagtaattaaaaattttaaatcttgtatggctgatcatttgtaccagcacaatttattaaatagctctctttttctttctttctttctttctttctttctttctttcttttttttttt

SEQ ID NO: 23793 - DNA, 227 bp, Homo sapiens
tcacttattgtaggtacttgtgataacagtgataagcttaatagacaaggttcttctgcttaaggaacttcagggatacagacagaaaacaaatgagaacaaaattcagactgttgggtgttcagtgaaggcctttctgaaaagagatagtcaagcagacatgttaacgtcaagaagcagtttggcatttggagatttggggtaagatcgttgaaaaggagcagccg

SEQ ID NO: 23794 - DNA, 112 bp, Homo sapiens
catgtcaccactctcagctgagttttgtattttttgtagagatgaggttttgccatgttgcaaaggctggtctcaaactcctgagcttaagcgatccgcctacctcggcctc

SEQ ID NO: 23795 - DNA, 214 bp, Homo sapiens
actacaaaggatctgtaaatatgaatatctgtgatttcactctaaagattggtaatgatatgtgtcttgcatactatgggcacaaatgggcacaaaaaaatgatagagtagaaccaaaggaagctttgaaaataacatgttacacataaagaaactgaggctcagaaaatggaaatgatttgagcaaaatcactggacaacttaaaggcagaca

SEQ ID NO: 23796 - DNA, 160 bp, Homo sapiens
tctccctacctcaacaacaattgcattggcagaatctatctgatgtaactattttggaactctggagtctattcaactcttgcagcttctacagtaggggtgtccagtgttttggcttccctgagtcacattggaagaagaactgtcttgggccaccatt

SEQ ID NO: 23797 - DNA, 178 bp, Homo sapiens
tccaaagtttgttttttaaaaacattattcgaggtttctctttaatgcattttgcgtgtttgctgacttgagcatttttgattagttcgtgcatggagatttgtttgagatgagaaaccttaagtttgcacacctgttctgtagaagcttggaaacagtaaaatatataggagctaaa

SEQ ID NO: 23798 - DNA, 174 bp, Homo sapiens
agtgcatacgagggatctagtttacctgcttcttatgagaatctaactaatgcctgatgatctgtcactgcctccatcacccccagaaagactgtctagttgaaggaaaacaagctctgggctcccactgattctacgttatggtaagagaagaaaataagtgcaacatgccgc

SEQ ID NO: 23799 - DNA, 462 bp, Homo sapiens
  misc_feature 385: n=a, g, c or t
  misc_feature 434: k=g or t
tttatcattttttattgtgtctatttgagtcttctctcttttcttctttattagtcttgctagcagtctatcaattttgttgatctttaaaaaaaaaactgctcctggattcattgatttttttgaagagttttttgtgtctctatctccttcagttctgctctgatcttagttatttcttgccttctgctagcttttgaatgtatttgctcttgcttctctagttcttttaattgtgatgttagggtgtcaattttagatctttcctgctttctcttgtgggcatttagtgctataaatttctctctgcacactgctttaaatgtgtcccagagattatggtatgttgtgtctttgttctcattggtttcaaagaacatctttnatttctgccttcatttcattatgtacccagtagtcattcaggagcaggktattcagttccatgtagttgagcggtgt

SEQ ID NO: 23800 - DNA, 271 bp, Homo sapiens
tctagtgttttggatttggaaaataagttcatatttcataaataatatgatcagttgtctaaatcaaaatagtcatgcttgggaaaatgttcataattagcttaagtggggaaaaatacaacatacattctatcatctcaatctctgtgtacatgtgtcggaaggaaatagatcaaaatgataatagcttctgtcacccactgggctgtaggattttgatggaatgatttttatgttcttttttatatctttcaactttttaaaagcacac

SEQ ID NO: 23801 - DNA, 84 bp, Homo sapiens
ttattcttgctaatgatctatcaattttatttatcttttcaaagaaccagctttttttttttaatctcagaataactttatttt

SEQ ID NO: 23802 - DNA, 381 bp, Homo sapiens
gaactttttcctactgttttcccatcagatatttccatcacttcctaatgtgttaagtgtattttcacttgaaacatagattttagaggcctgaagacaatgaaagagcagattaatggatttcttgatgagtttgacgaagatcttttggtttacttaggaactgcattatgaaacattttgcagctgtcaggtgctattctttttctactttgttgaaagacttcctacttcctctttgactcatgacttttaaaaatagcaggacaggctgggcacagtggctcacgccccttgatcccagcactttgggaggctgaggcaggagggttacttgagcccgggagttcgagaccagcctgggcaacataacaaaacccc

SEQ ID NO: 23803 - DNA, 383 bp, Homo sapiens
  misc_feature 137: r=a or g
  misc_feature 138: r=a or g
ctttactttttacatgctgacacatacatacactgcctaaatagatctctttcagaaacaatcctcagataacgcatagcaaaatggagatggagacatgatttctcatgcaacagcttctctaattataccttagrratgttctcctttttatcatcaaatctgctcaagaagggctttttatagtagaataatatcagtggatgaaaacagcttaacattttaccatgcttaagttttaagaataaaataaaaattggaaataattggccaaaattgaaaggaaaaatttttttaaaatttctctaaatgtaggcctggctgggctttgaccttttccgtttttaaatcactcacagagggtgggacaggaggaagagtga

SEQ ID NO: 23804 - DNA, 279 bp, Homo sapiens
aagccagatatcctttcacaggtgaatgactaaacaaactttggtacatctataacatagaatactacacaacaataaaaaggaatgaactattggccaggcacggtggctcacacctgtaatcccagcactttgggacaccgaggcaggtggatcgcctgaggtcaggagttcaagaccagcctggccaatatggcaaaaccctgtctctactaaaaatacaaaaaattagccgggcatggtggcagacgcctgtaatcccagctactcaggaggcac

SEQ ID NO: 23805 - DNA, 313 bp, Homo sapiens
  misc_feature 7: s=g or c
  misc_feature 8: s=g or c
  misc_feature 9: d=a or g or t
  misc_feature 269: r=a or g
  misc_feature 270: k=g or t
  misc_feature 272: n=a, g, c or t
gattagssdcatatctctcgccgggagtggccgcgcggctccgaagctcccggccggcggctatttaagcgaggcccgccgcatccgctgcgctgtagcctggaggctccgggcgcggggaagtcatgctcgcttcacggaggcaatagctagccggtgtctgtgggaggttatgtttatttgagacttctccatcgggatcgcctggtgtcaccaagtgtccactggtactgaggtttgctgcctgccttcttgccatgtctaacgarkgnaaacaagtgcaaccaatggtcagcccgaccaacaggcaccg

SEQ ID NO: 23806 - DNA, 158 bp, Homo sapiens
cacacctgtacatcgggaggccgaggcaggtgcatcactttgagctcaggagttctagaccagccagggcaacatggtgaaaccctgtctctacaaaaatacaaaaattagccaagcattggttgtgggtgcccatcatcctagctactcaggaggct

SEQ ID NO: 23807 - DNA, 146 bp, Homo sapiens
agaatcaattgggtgcaataggagaagtttctgacaaagggctttggagactgagaagagagagaaacaccaccaagttccttgcagagaaaggcatttgataaaatgtgtgttgaataaggaccagcggtttgtggaggatgaag

SEQ ID NO: 23808 - DNA, 123 bp, Homo sapiens
gtagctgggagtacaggcgcccgccaccacgcccggctaatttttcgtatttttagtagagaaggggtttcaccatgttagccaggatggtctcaatctcctgacctcatgatcctcccgcca

SEQ ID NO: 23809 - DNA, 186 bp, Homo sapiens
tattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattaga

SEQ ID NO: 23810 - DNA, 452 bp, Homo sapiens
  misc_feature 219: v=a or c or g
  misc_feature 348: r=a or g
  misc_feature 357: v=a or c or g
ccttttgtaggggccctgctaatcttctctgtatcattccaattttagtatgtgtgctgctgaagtgagcgccgaactaacctttgtcttttagatctcagcacaatcatttcttcaatgaagcattccatgatctgcctcattagatcaaattctccagttatatgcattcatagtgttctgtacttctttgtagcttatatcacagttgtgattttvattcatcagtgattcatagattaatgtctttttaacctctatcccagtattttcgttcactgtgtatcatcagcatttatcacagcacctgactcatggcaggtatgcagtaaatatttgttgaataaratgaatgavaaataataataggtctgcattttagatacatcggaggatatcggttcttcaatgtgacaattctttaaaaatgttgagacagctagaacgtgtgt

SEQ ID NO: 23811 - DNA, 307 bp, Homo sapiens
attcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgcg

SEQ ID NO: 23812 - DNA, 348 bp, Homo sapiens
tatatacgcttcttaatctggagagactgattttttttctaaacgagagatattttcaatgcctgttataaagaaagtagaaaaacattttagcagatattaaacgttacagagagcttcaggataaatgcttaagttcctcttggtgacttatattagcccatgattcaacaatcaactgtctagatgaaaaataaaaattcaagagtttagatgcctacatatataacacatttgatgcaaacaatctgaataatgggacatttcaaaaataattttctcctctgttattatgttctcttaaaaaaaccaaatatctgattaaataacattattttagagggaatt

SEQ ID NO: 23813 - DNA, 469 bp, Homo sapiens
  misc_feature 315: m=a or c
  misc_feature 447: m=a or c
ctttctattctcattttattcagtaccctaaaaatctggatcttccccattgctttattcccatttcagtgaatctcagatctgtatctccagccctcgcctctcttgagtggcagataaatgtatttctaactagttacaaaaatatatttctaactagttacaaacactatcacgaatttcaaactcaggaagtcttaaagtaaatttattatctcactctcctgtttccacgaactttcccgaaattttcttctttcccgcccttgcgaatcccttgcatttctcagttaaaggacagcaccatccacccamctctcccaaagccgagctttggatttatcctcattggctaaatccctcctgaaacatgaaactgaaacaaagccctgaaccccctcaggctgaaaagacaaaccccgcctgaggccgggtcccgctccccamctgcagggacccaattctgggc

SEQ ID NO: 23814 - DNA, 296 bp, Homo sapiens
ctgagtttaaatcccagctgggctgttttccagctgtgtgacttacggcaagtctttgagcccttttccccctctttgagcctgcttcctcagctgtcaaagataaggaccttccttgcagtgctgttgtgatgattaaatgaaatcacagatgtaaagagtgcttggtacaacaggaggcacagggtaaatgcttgggtaatggaactactgtcattatcacccatctggctgcatgttacaaggtcaatgagataatggatacaaaatgtaaactagatgaacataaagggcga

SEQ ID NO: 23815 - DNA, 227 bp, Homo sapiens
aagaaaagagagggaattacactagaaaggctgtttccatgccttgtttggcatgccactgaaagctcttctttgaactaagatgtgttccttatgatagcttgcatcgaagaggataatttcttcttaaaaccagacttattattttatttgctttcattttatcacccatcaggcatattgaagaatctcaaagagcagaattgcgttgcgactgtacccccact

SEQ ID NO: 23816 - DNA, 412 bp, Homo sapiens
acaaatgaggacagagacgtgaagagttaattctgtcagaacttaattaaacttttcattaaggttaacgtaaaacgaattttgctcagagtctagtaggtttcattaaactttcgaaacaccagtacttagacttcaaaagaacgcctcagggctctggtctccttcctgtgcacttagcacattgcgtgagcgtgcacgcatgcatgtacacaccaggaatgtgcgtgcaagctcagctcgtaggtagcagtgttaccagcgttcatcttcatgataaatggggcaaagctgtgagacggagtcagacaacctagggtccatcttgagaggcgtcatctgctgtgcaacctaaggcaacgcctcttcacttctctgggtccctgtctcctgctatgtaaagtgaaaagac

SEQ ID NO: 23817 - DNA, 457 bp, Homo sapiens
atacatatctgtggaaaaactttattgtgatacttttatattaaaaatcagtcacttagaagaaaatatcaaactttaattacaatgatactcattttctgtaccgagttgtcaggaggtataagctggaaaccaggatggcgccaccatcacagctgagaatgatggcaacagaagtcttcattgtagtgtgtcaggtcttttgaggtaccaagaattgcggaaattattttcttctatgtatcttactctgtgataattttttcttattttttaaaaatacagcaaaacacacaataaaacacagcaatatactgaggtctcacattctcacggcttgtcttcctacacttattccaattcagagtacactttgtatacatctcttcgctggttagttctgaaacagtactctttcttatatttgttttaaacatctccaatactgaatattgta

SEQ ID NO: 23818 - DNA, 183 bp, Homo sapiens
gactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacaca

SEQ ID NO: 23819 - DNA, 180 bp, Homo sapiens
tcctttccaagtttagtgcttccttcatgagctcttataaggcaggcctggtggtaacaaaatcccttagcatttgcttgtctgtaaaggattttttcacttatgaagcttagtttgactgcatatgaaattctgggttgaaattcttttctttaagaatgttgaatattggcccccaca

SEQ ID NO: 23820 - DNA, 223 bp, Homo sapiens
tattatttgagacagagtcttgctctgttgcccaggctggagtgcattggtgtgatcttggctcattgcaacctctgcctcccgggttcaagcaagtcatatgccttagcctcccaagaagctgagacgacaggcatatgccaccttgcctggctatttttgtgtttctagtattttgtattttcaccacgttggccaggctggtctccaattcctggcgcca

SEQ ID NO: 23821 - DNA, 413 bp, Homo sapiens
  misc_feature 12: y=c or t
  misc_feature 86: s=g or c
  misc_feature 330: y=c or t
  misc_feature 332: w=a or t
ccattgggataytgggagtggaagactactctcttcctaagactcatttaagcactaacgtctctcagcaactctcatatgtgagsatacaaaaggtcttcatgagtcttatgatggaagtagaacttcctgcaaacccgctagagagcttggccaccatcagttacctattgctgcttaacagagtacgtccaaacatagtgatgcaaaatgccattttatttatttgctcacagtgtggcaatttgggcagggcccagtggtaaggttagctcatccctgtgccactggtgtcagctggaacaacttgactacttggggtgggggacycwttgacaaggtggctggctgcactcctgtggctggtgagatggtactggtgcttggctgtatctgctagggctgctggctaa

SEQ ID NO: 23822 - DNA, 274 bp, Homo sapiens
aaagaaagtcttccttgaataattggagtttgtcttgagaggcaaatatagccccaagaatcacaagattcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggtaaattcttaaactgtggaaaccactgaaggtggtt

SEQ ID NO: 23823 - DNA, 371 bp, Homo sapiens
  misc_feature 312: b=c or g or t
  misc_feature 313: b=c or g or t
aagaaagtcaagtgaatactttgaaagaattgatgatggataaggcaagtacattgatttctcaaggtgtgaattgttatcttcaaactttgtgcttccataattgttttttctttaataatgagacatctagaccataactggctatgtgattctgaatctacctttacaacttaatctttgtgattcccctatataagatatctagagtagtcaaattcatacggacagaaagccaaatggtgcttgtcaggggctgggagaagaggagaataggaagttactattaatgagtacagggttgtcgatttbbaaggatgaaaaagttcgggagatggatggagataatcgttgtgcaacagggggatata

SEQ ID NO: 23824 - DNA, 254 bp, Homo sapiens
ttaagtattccatatttgatgtttcataatgctttctccctgcctaatcttgtctgcaaagcgaaaatttgctttcttaggtttctttaaatatttgatttctgataattattttgattcccaaattatgaactgtattaaaaaaacactctcatgttttttcttctgaaaatctgatgttccaacatccagtccaggacagaagataaaatagagcgattcaagaaagcagttgagtattattcagtcacttt

SEQ ID NO: 23825 - DNA, 345 bp, Homo sapiens
  misc_feature 305: w=a or t
  misc_feature 312: w=a or t
  misc_feature 316: k=g or t
  misc_feature 318: k=g or t
  misc_feature 320: w=a or t
  misc_feature 322: k=g or t
  misc_feature 330: y=c or t
  misc_feature 334: y=c or t
  misc_feature 336: s=g or c
  misc_feature 338: w=a or t
  misc_feature 345: s=g or c
cttgtgtttattttctctggtattccttttcatttcatctttgtgttggaaatgtttttccttttatctctaattcttttgtcgttttgtcccctcagtactgagcttttctgattgtaacttataagttacccagtgaacacattcttccacaaaacaccattattcaaaaccttgaataattttcctaatgttcttagacttgttttaacgtgtgaagttactattttgagctgttttgtgggcacatcttcctggcctgctttccttgtctgtagatgtttatttgctcctttttttttttwaaataawaatkgkgwakgggatttycccycsgwactctcs

SEQ ID NO: 23826 - DNA, 199 bp, Homo sapiens
tcatcttggttttgtaatttcctgggccagggcctcacaggacctcccctgtagcgcagggttgagggtgatgtgttgcagagtaagattttctgtgattgtcagctttaccagaatcagatggtttcctaaggaaatggaggtgctagaccaggggtgccttcctatattagaaggaggagaattatctaggaccatc

SEQ ID NO: 23827 - DNA, 186 bp, Homo sapiens
tagaaactagaatccctctgcccccaaggcaggtcatagaaaccagaatcttttctccccaaagctagtcataaaactgaaaaatactactttaattttccctccacttttctgcataaaaacaggctataaagaaattatctgacccaccttgtttgactatgagtcgtataacgccccccccat

SEQ ID NO: 23828 - DNA, 355 bp, Homo sapiens
  misc_feature 132: y=c or t
tccaagggtcagaggcacatgaacttgcattgtaaaatcaaaaggtcaagacttttaatcgggctgggcacagtggctcactcctgtaatcccaggactttggtgggccgaggtgggcacaccacttgagtycaggagttcgagaccggcctggccaacatggtgaagccctgtctctgctaaaaatacaaaaataagccaggcttgatggcgggcgcctgtaatcccggctacttgggaggctgaagcacttgaacccgggaggcagaggtctcagtgagccgagatcgtgccactgcactccagtgtgggtgacagagtgagatcctgtctcaaaaaacaaaacaaagcaaag

SEQ ID NO: 23829 - DNA, 216 bp, Homo sapiens
  misc_feature 179: n=a, g, c or t
tctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgcttnatctttcatgctttctctgtacacacacacacacact

SEQ ID NO: 23830 - DNA, 150 bp, Homo sapiens
tggaaaatggatgtgatgagatttttgaattgtaattagattaacattgtcactagttatcagtctgatatatcttataaatcaaacgttgggttgatttatcttttatcacttctagggacttactcctaacagtaactcacaaaccac

SEQ ID NO: 23831 - DNA, 194 bp, Homo sapiens
attaagtctaaactagaaattccacagaaacaaaggaggggcagaacttaactgcatttctaagctcccactgtccaatctttttagtgggcatagactaccttatataatgtacttttcttataacacaagatgaaacagacaacccaaaattaaaccattccttttgccatgtgcatgcatacaccctaccg

SEQ ID NO: 23832 - DNA, 135 bp, Homo sapiens
  misc_feature 13: y=c or t
  misc_feature 14: m=a or c
caaaccagcttcymgactcccaggagctcaagccaagcccagaggcagtggctggggtccctgcaggtcatgaggggcctatgcctttactccttttaaacaccagcacccgtcttttccccaacctaaaaccac

SEQ ID NO: 23833 - DNA, 235 bp, Homo sapiens
tgactgactggtaggaaatgtaaaaaggccatacatttattctgaatgttggtatctggaagaatggtgatgctgttcaagtaataaggacaaaggggaaccaggcactgtgagcctctgtggggtgtgttactcttttagctcatgtgtttcaagtcattctaccccttgccgtctccacatccaaacctaactactttggattttaattgcagctcctccacccccaccacct

SEQ ID NO: 23834 - DNA, 97 bp, Homo sapiens
aaaaggaggcaaatcctgactttcgtttcttctctctactagctggcaatatagcaactatgaagagaaaagctactaataaaattaacccaacgca

SEQ ID NO: 23835 - DNA, 404 bp, Homo sapiens
  misc_feature 311: r=a or g
ttgttagaacctgttctcttgtatctgaatctgatttgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaratggctttgttacaccagagccatctggtgtgaagaactctatatttgtatgttgagagggcatggaataattgtattttgctggcaatagac

SEQ ID NO: 23836 - DNA, 486 bp, Homo sapiens
  misc_feature 433: y=c or t
tcagggtaaggggtcctgtcctaggaaagaaaattcaagtttaaacagaaactgccagctaacctcaaagcagaggccgtgtgactgctgtttcacttcaatccatcctttttctgttcttccttccaagaacactgatgaaggttttccttgtgctccttggtagagcccaaactgctgtagttcagtgctgcccagctcatggattcctgtctcctcaaataactctttacactttcacgtgcctacgtttatcttctaacacttggatcaggtggcgtccgccaggtgtcttcgctgtaaagtcactgtcttcccttccaccgctccactctttgggatgagtcacgaagcctgtgctaccttcaggggagggctggggaagagttaaactccatctcctggaggggctgctacatatgatcatatgacygttatttggagtagaaagatttgcctcttctccacatttacttgtttattcaa

SEQ ID NO: 23837 - DNA, 135 bp, Homo sapiens
  misc_feature 44: b=c or g or t
  misc_feature 101: k=g or t
  misc_feature 103: n=a, g, c or t
  misc_feature 104: b=c or g or t
acattgaaggatagagtggcagcagaggccaaggatcgtgagtbgatggagtttgctgctgaaaatgaagggaagtctgggggaggtctccacagcgtackanbggggtgcggctaagtccagagcctggcaggg

SEQ ID NO: 23838 - DNA, 248 bp, Homo sapiens
  misc_feature 9: s=g or c
atgcgtaasgcgcctgcgttcccaacgccgaagctggttctacctttctccgggattcctctgagggccaaggtctggtcacccagaggctgctaatttcaaaggcaatatgagagggactggatgtttggagggggacacggggctggacatctggatccccaaacccggactcacctctcggacagggctgattccgatcggacacttccggtggaaggactgagcggcgctacacttcaagaatt

SEQ ID NO: 23839 - DNA, 89 bp, Homo sapiens
acacagatgctaagggtttctttttactccgtaagctttgttcagaccctgggtattgccaagggggaatgttccatttaatggagagg

SEQ ID NO: 23840 - DNA, 154 bp, Homo sapiens
caatctaagcaaaaagaataaagccagaggtatcacattacctgattccaactatactatagggctagggtaaccaaaatgccaaggtactggtacaaaaagagatacaaggactaatgggacagaagagagaacctagaattaaagtcgcacc

SEQ ID NO: 23841 - DNA, 188 bp, Homo sapiens
ttataaataaaataagaattgctcttctgcccaccgttcttgattggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctt

SEQ ID NO: 23842 - DNA, 397 bp, Homo sapiens
  misc_feature 278: r=a or g
  misc_feature 319: r=a or g
  misc_feature 356: r=a or g
  misc_feature 360: r=a or g
  misc_feature 366: r=a or g
  misc_feature 369: v=a or c or g
cagtgaaagatggtacctggtaaactattctaaagtatgaaattattgaaactgacaatatctgaggtagaaagtgttatgttttattaaaagaaaaataaaagagggaaagaagaagcaagacagagacacagagagagacaaaaaaatgaaaagatatacaaaaggtaaagataaaagtgtaaatgatctcttacccaagcatttttctttcccgccggtactggaaagggttaaatctgtatctgtcagagaagagagtagtatggatgagggarattactaaaaagtatttttatttcactattccatctttaaratacatgataaagtatagatagttcctttctattaartaaratgaaraavaatctacagtgaggttgtctcagtcttt

SEQ ID NO: 23843 - DNA, 313 bp, Homo sapiens
ttttatcaggatcacagagcccatagtggtagcggggccagggtttgaagtcaggacagtcatgcttaaagcatttctctttaaccagccagggctcttggagagggtgggctttgaagatgatgcctcctcatgccagactaccctgaggtggattcctcctgcagccctgcccaggtgtgaagagggccagtggggggaagaggatggccataggtgctgaccccttggctttgggggcaggagcgggagatggagctgcggcggcaggccctggaggaggagcggcggaggcgtgacaggtagaacggag

SEQ ID NO: 23844 - DNA, 274 bp, Homo sapiens
  misc_feature 141: y=c or t
  misc_feature 142: y=c or t
  misc_feature 180: k=g or t
  misc_feature 188: m=a or c
  misc_feature 199: m=a or c
  misc_feature 209: m=a or c
  misc_feature 260: s=g or c
gagtctcactgtgttgcccaggctggagtgcagtggcgtgatcttggcccacttcaacctcctgggttcaagtgattctcctgcctcagtctcccaagtagctgggactataggtgcctgctaccatgcccagctaatttyytttttgtatttttagtagagatgaggtttcactatatkggccaggmtggtcttgaamtcctgacctmaggtgatctgctcacctcggcctcctaaagtgctgggattacaggcgtgastaccgcgcccggca

SEQ ID NO: 23845 - DNA, 226 bp, Homo sapiens
ataaatggcatttaggatgcttagaacttttgaaaatggggttaggaatagaaggtcaggtctgcccagtgcaaagtgttctttttaatattagagatagagggtaaaataaaacattgtgtctgccctcagaaagctttcagtctggaagagaagatgattaagggggcgatcacaagatggggtatgtgcggtggcaagcctggcctatgaacttgtagggaca

SEQ ID NO: 23846 - DNA, 324 bp, Homo sapiens
  misc_feature 194: k=g or t
tgaaacagtggcaaaaggattcaaaaagaatacagcggttgggactatctacttttttaatttttttattacactttaagttctagggtacatgtgcacaatgtgcaggtttgttacatatgtatacatgtgccatgttggtgtgctgcacccattaactcgtcatttacattaggtatatctcctaatgctakccctcccactcccctcaccccacaacaggccccagtgtgtgatgttcccccatcctgtgtccaagtgttctcattgttcaattcccacctatgagtgagaacatgcggtgtttggttttctgtccttgct

SEQ ID NO: 23847 - DNA, 244 bp, Homo sapiens
taaaacttgcagcatttcagaaggtggaagataccctgaaagacagtaaagtagataatggtgaacaggagtgaaattttaaaacagggaagttctcactgataaaatgacatttgagtaaagatctaaaggaggtaaggtagtgaattatatagctatgtgggaaaagaacataagcagaaggatgactaatatgtttggaaaatggcagggcagccagatggctacaatgaagagagggggg

SEQ ID NO: 23848 - DNA, 478 bp, Homo sapiens
  misc_feature 343: r=a or g
  misc_feature 345: r=a or g
taagtaaattgatagaataatgttaagtaggccaggcacagtggctcacagctataatcccagcactttggggggccaaggcgagagaatagcttgagctcagtagttcagggaccagactgggcaacatagtgagaccttatctctacaaaaaaagaaaaagaaaaaaaaattagccaggcatggtgatgcacacctgtagtcccacctagtcgggaggctgaggcaggaggattgcttgagcctgggaggttgaggcctcagtgagccttgatcacacgattgcactctagcctgggcaacagagtgagaccctgtcttgaaaagaaaaatgttaagtaartrataacagaatcacatataaggtcaaagcagtgatggctgaaattgtggatagagtggaccaaatgtgtctgtgctgccttccagctctaaaatcctgcttcagtgattcagaccacatagtctcccattcaca

SEQ ID NO: 23849 - DNA, 456 bp, Homo sapiens
  misc_feature 12: m=a or c
  misc_feature 13: s=g or c
  misc_feature 431: r=a or g
agagtccgagcmsaggaagcttgccggacaccaggagagctgccacccggacagagctggccagaggcctgtgcatgggccacaaggaaagaaggcacagcctaacataacctggcaagcacctgtgtagcctctgtaagtgcttacccagagaagcaggagcacggcgatctgggtgtttggtgacacttccatctgagagcagggcccaggtggaagaggcagctggatgcaggtccacgctgcttttatgagctgtaacactcaccgggaagatctgcagcttcactcctcagcccagcaagaccacgagcccaccgggaggaacgaacaactccagaggcgctgccttaagagctgtaacactcaccgcgaaggtctgcagcttcactcctgagccagcgagaccacgaacccatcagaaggaagaractccgaacgcatcttaacatcaga

SEQ ID NO: 23850 - DNA, 103 bp, Homo sapiens
acgctgccgccggcatccgctcggacgcggccacgttgtcttgcgcgctttgcccgcctggccctgggactctgaccctcggctaccctttcctgccccacac

SEQ ID NO: 23851 - DNA, 103 bp, Homo sapiens
gtcagacatgatctataaatgcattaccttctttatcattaaaacctcagttggggctaggcacggtggctcatacttgtaattccagcactttgggaggcag

SEQ ID NO: 23852 - DNA, 290 bp, Homo sapiens
  misc_feature 7: b=c or g or t
  misc_feature 8: s=g or c
  misc_feature 44: s=g or c
  misc_feature 45: s=g or c
  misc_feature 118: r=a or g
  misc_feature 124: k=g or t
  misc_feature 177: s=g or c
  misc_feature 289: d=a or g or t
  misc_feature 290: b=c or g or t
agtcgabsgagggaggggtaaaggcggctggccgccgcggcggssggtgggaaaagagaagcagagggaggagttgttgctgccgccgccgcagccgcagctactgtgacttctccgrttgtgkgagctttgttggagcctgcgtacgtggatttatcgctgccacggtctgcgtastccagaggtttaaccataggatagagaaaccaggtaagtcctacattggcttcccgtcgtcctttctcctggagggggtcttctgtgctgtcagtttgtactacgagtgtgdb

SEQ ID NO: 23853 - DNA, 161 bp, Homo sapiens
tttccagattgtccccaggctcgcgtcgctcccgggaacggccaatggacgcttgtgttcttccagcgccccctacagccttgcaatggcattaaatcaccctgccggaccagttacttttgcttgaaaagttttctttcttctcaatacttcgctgctga

SEQ ID NO: 23854 - DNA, 458 bp, Homo sapiens
  misc_feature 375: n=a, g, c or t
  misc_feature 376: b=c or g or t
  misc_feature 377: s=g or c
  misc_feature 379: n=a, g, c or t
  misc_feature 387: r=a or g
  misc_feature 388: k=g or t
  misc_feature 390: m=a or c
  misc_feature 401: s=g or c
  misc_feature 404: w=a or t
  misc_feature 405: n=a, g, c or t
  misc_feature 421: r=a or g
ttagccgggcgcggtggtgcatgcctgtaatcccagctactcgggaggctgaggcaggagaatcacttgaacccaggaggcagaggttgcagtgagcagagatcatgccattgcactccagcctgagcaacagagcaggattccatctcaaaaaaataaaataaaataaaatattggccaggcctggtagtgcattcctgtggtcccagctatttgggaggctgaggtgggaggatcgtttgagcctgggaggttgaggctgcagtgagccctgtcatgccactgcactctagcctggacgacacagtgagaccttaatcaaacaataaaaataggctgggcacggtggggcaccatgtctgtaatcccagcaanbscnggaggcarkgmgggcaaatcgsttwnagctcaggagttcgaraccagcctggccaacatggtgaaacccatctctacca

SEQ ID NO: 23855 - DNA, 300 bp, Homo sapiens
gacttgaggcaccagcagggccctcttccccagtgcctgtcctaatctgtgagaacagcaatcctttgaggttcgaagaagccttttgttaaaaacactgccttttgtttgtttttttttgtttgttttgttttgttttaattttttttttaattattatactttaagttttagggtacatgtgcacattgtgcaggttagttacatacgtatacatgtgccatgctggtgtgctgcacccactaactcgtcatctagcattaggtatatctcccaatgctatcccttccccctccccca

SEQ ID NO: 23856 - DNA, 446 bp, Homo sapiens
  misc_feature 329: k=g or t
tgggtgttggattttgtcaaacatttcttctgcatctgttgatatgaccctatgatttttttcttagcctattgacctgtggatttcattaattgatttccaaatgttgtacctaggtatcccattgcatacctaggataaatcccacttggctgtggtgtataattatttttatacattgttagatgtgatttgctaatattttgttgggaattttatatctgtgtttatcagagatactggtctgtagctttctcggaatgactttgtctggttttggtattaagttaatgctggcctcataatgagttaggaggtattccctcctkctgcttctatcttcttaaaggaattgtagataattgctaagatttctttcttagatctttgacagaagtgacagtaacccctatatctatagccaactgatttttgacaaagttcca

SEQ ID NO: 23857 - DNA, 164 bp, Homo sapiens
tcttccctacagattgatctttaaatctttttctttgccctcaaccatttttatttttattttttttgagacagtctcactctgtcacccagcctgaagtgcagtggtgtaattttgactcactgcaacctgcacccccccggcttaagtgatcctcccacaca

SEQ ID NO: 23858 - DNA, 375 bp, Homo sapiens
  misc_feature 362: d=a or g or t
ttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaatttttttaattatatttttatatcaaaaaaatatatactttaaatagcaaataatatgaactttaaaaadttgctgtggccct

SEQ ID NO: 23859 - DNA, 168 bp, Homo sapiens
aaattaaacttacattcttaacctattctcattttacaactcactcaaaaaaatcataaattggcacccatcctttttttctataacacaataacttacattttctgagtgctttacagtactttttgttttgttttgtttttttgagatggaatctcactgtgtcca

SEQ ID NO: 23860 - DNA, 181 bp, Homo sapiens
tatcaaatcatttgaaaatttgcacatttttgtgcaaaactcaatctacagtatcagtctcgtcagatatattaattttacacttcacttcagttttgattggtgagaaagtacccattctcttcaaataatcaaagataattattattttgttttgtttttggaatcaacagggaggagc

SEQ ID NO: 23861 - DNA, 347 bp, Homo sapiens
  misc_feature 10: w=a or t
  misc_feature 311: r=a or g
ataggtaggwattacgttaataaaaatgaagaaaatctaggagaagagaagaaaaacaggcatttacaaggatttatattgttaaaatatatgaagaaagagttttctgtgaccatattattcaccatttcttagaaattatcttgagtcctttttactcatcggtttggcaaatatttttcagtatatactctgtgcttttactagctataataaaataaggtaagcatagcccctatttttcaagtaggaaggacagaaaccaaaagaataataggtatgtatcaggattgtcataaggcataaatgaratacaggcatcatctaaccttcacacacaactccca

SEQ ID NO: 23862 - DNA, 207 bp, Homo sapiens
aattatctatgacaacaaccaccgtctccaaatctgtattgattccttttattcattataagtctcatctacctgatgaggtaacttttttgaagacaggaattgtatgctgtgtaacactgctttgattcttccatagttcagtcatccttgctatcttgcgggggattggttctaggataccgcccccacaccataccagaatcg

SEQ ID NO: 23863 - DNA, 208 bp, Homo sapiens
ccacctcagcctcccaaaatcctggaattacaggcatgacccacagtgcccggtctatgctgctagttttgagcagggactggagcgagagaaggctctgcagcaagtccaggctgcattacatcacatgctggtctactgtgtggtgcttgagatccagcagatccggtaacgctcagtgtccatggcaaacatggcaaacaccagg

SEQ ID NO: 23864 - DNA, 334 bp, Homo sapiens
cactattccttgcatttgcataacgaaggccgggtgtggtggctcatgcctgtaatcccagcactttgggaaggccgaggtgggcggatcacctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaaaaaaaaaaaaaaaaaaaaaaaaa

SEQ ID NO: 23865 - DNA, 206 bp, Homo sapiens
cttgcttctcatgtaaataagactctctctagctgggaaagccggacaaactccagttgaccccttaatttacaagacactaagggctccttacccaacccccttccgcaaggagttgacctgtgtaagcagatcctcagcatttcaaaggagcccaattaattgataaggtattagcaccaacaatgtatgaagttcccaggatc

SEQ ID NO: 23866 - DNA, 381 bp, Homo sapiens
aaaaaggagaataactcagttttaggtaagcctcccctatatcctagaataacctgcctcttcggctgggaagcggagggaaccttctcttccttaaagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaacagggtcctcctaccgcagagtatcttgcagtccaactcccacgattgtcctgactggggatgccacttcaccagaaggagaaaccgacaaaaacctggccaacagagtcacagtcccacaaga

SEQ ID NO: 23867 - DNA, 192 bp, Homo sapiens
  misc_feature 129: n=a, g, c or t
gtacactgaaaaagaaacagagtttgccacctcagaaggaggcattagaagctaatgttacccaggatctgaagcttcctggcttcgtagaagaatcctgtgaacatacagaccaatttcaattgagtncacaaatgcatgagtctatcagagagtatttggtaaaagacaattttctacaaaggaggccgg

SEQ ID NO: 23868 - DNA, 174 bp, Homo sapiens
gatctttcctgctttctcttgtgggcacttagtgctataaagttccctctacacactgctttgaatgtgtcccagagattctggtatgttgtgtctttgttctcgttggtttcaaagaacatctttatttctgccttcatttcgttgtgtacccagtagttcaggagcaggagc

SEQ ID NO: 23869 - DNA, 261 bp, Homo sapiens
caatttcccctaattttaggtgaggagtgtacctgatacatatacactagcctcattatagtttgtatagataactttgtcttttaatctgagccatttgcagttttgagatacttattaacttctctttgctacttcttcctttgccatttgcatctttcatttcagaattatacaatgtccaggttttttctttctacagtataaagctctgaactcctgattaatctttcaatatgttgaataacatacacacactcc

SEQ ID NO: 23870 - DNA, 183 bp, Homo sapiens
tgaaactctaccatattctttatttttattttactttaagttctgggatacatgtgcagaacatgcaggtttgttacataggtatacatgtgccatggtgatctgttgcacctatcaacccatcatctaggttttaagccctgcatgcattagctatttgtcctaatgccctccctccacccg

SEQ ID NO: 23871 - DNA, 348 bp, Homo sapiens
  misc_feature 44: r=a or g
  misc_feature 46: r=a or g
aaacccatctagtcataaggataacatcaaacaaatcccacctrarggatgttctacaaaatacctggccatacttttcaaaactgtcaaagtcatcaaaaacaaggaaagaatgagaaaccgtcaaaaccaagaggagtctaaggagacatgagacatgacagctcagtgtaatgtagtgtcctgggtgggatcttgggacagaaaaaggccattaggtaaaaactaggggaattcaaataaggtatggactttcgttagtaatgtatcaaaattggttcattcattatggcaaatgccacctattagtggaagatgttaatagggaaaactgactaatgggtctgt

SEQ ID NO: 23872 - DNA, 92 bp, Homo sapiens
attattgttactattatttgctatattttaatattgttgtttaccaaatattctcctttaaacagactcgctttttaaactttttttttttt

SEQ ID NO: 23873 - DNA, 400 bp, Homo sapiens
  misc_feature 119: d=a or g or t
tgtaaaatagtttagtgcctagcagaaataactcttggtgtagaaatatactaatggtagggtagtctttcatgattgtgataagtatgaaagaagattgcctctttctgaagcctgtdttttttgtagttaacaaggccaggggagacttttgattattttttgcttgcatgcctacacatacctaaggaaaaagtaatcacagatcccagtgtcactttaattatgccattaatttaagtgttgattcaacagctatttactgttcacagtattttagtatttgtaaatttcttggtggtatgggtaacaataaatggatgtttttatctaaagtaggaaatcacataaatgaacaaagagatgcattgttagtagaatttttttttttttttttgga

SEQ ID NO: 23874 - DNA, 120 bp, Homo sapiens
agaactggaaaggaaattagagatgaaaatattggaaattcccacctattcactggagattggaataacgactctgtcagcctgaagggattattgtgaggctcacatatcataaaaaat

SEQ ID NO: 23875 - DNA, 259 bp, Homo sapiens
actgccagtgtgaaatcttcagagaagaatttctctttagttctttgcaagaaggtagagataaagagtcttgttatgtcgcccaggatggagtgtagtggtacaatctcggctcactgcagcctccgcctcttcctgggttcaagtgattctcctgcctcagccttctgagtagatgggactacagacactttttcaaaaatggcaatggtatcagaattcctcaagcaggcctggtttattgaaaatgaagagcagg

SEQ ID NO: 23876 - DNA, 386 bp, Homo sapiens
atttagaaattcaaagtaacagcctttaaccattaaccttgaggaaaatgtgaagtagcatctggagtctcttaagccccagccctgttgtcccctacagcatctccacccaggaagtccagttcctaactaatgggaatggatccttttcccattataaagggccgatgcttaacccttgaacccactactgttcttatgccccaagatctgcaccttacatcaggcacccgggaatgcttctcattgaaattttaccataccaaaaaatatgtaagggtgactcatcactcctaactttggactccttgctttgagatcggtatttttttctctctctttacatatagcaaaagctttccccagtagctgatgaatttagaact

SEQ ID NO: 23877 - DNA, 158 bp, Homo sapiens
aacatgttattatggctgggcacagtggctcacacctgtaatctcagcactttgggagaccaatgtgggaggactgcttgaggccaggagtttgagaccagcctgggcaacatagtgagatcctgtctgtaccaaaagaaaaaaaattagccaggcgc

SEQ ID NO: 23878 - DNA, 197 bp, Homo sapiens
cattatattttttcctctcagctactctttatactcacatcttattataaaatatttaggatacacaaaaggatttaacaggtaataaaacacgcctgtgtactcactacttgacgtaagaagtcagacattaacactacagtggaagtccccggtcgttcctctctccagtgtcatcccctcactcccacccaaag

SEQ ID NO: 23879 - DNA, 187 bp, Homo sapiens
aatactcctaaacaactgctaggaccacggaactcagaaacacagcaagcgatcatattggaaatatggcccaaagtgacttcctttacccagagaacccaaaaaggcgggaagaagtaaatcgtcttcaccagcagcttcttgattgcttatctgacagcttcgatgtcaccaataagctgacaaa

SEQ ID NO: 23880 - DNA, 199 bp, Homo sapiens
actcgggggagcggggctggctcaggacacaaatccaggagccattccttctgcctgggaggagggagtgatgaagaccagaggaatcccagaggagaagccatctgagatcgggaggaggagaaatggaacatcaggcggaggaaacagcccagacaatcgcactgggacgtgaaaacccttgggctgcatgcgggga

SEQ ID NO: 23881 - DNA, 423 bp, Homo sapiens
  misc_feature 329: y=c or t
  misc_feature 377: n=a, g, c or t
  misc_feature 421: r=a or g
acaactgtagcactgggactttcttcagcatctaccacctcagcttccactataagttcttctggggcttctgaacttgctttctcagtttccgcaacattctccttttcacctttaagaattagtcattaagcaaggtattaatttaaagatcgtgggaaggcaatgaaacactgcggtcgtttaaacacctaagacagaactacatgcactgatgtgtaacagtcttcaaggtagactctcaagtgaaacagcaaaaaaagaacaatgtatacagtctgctactattgttagggcaaaatgaggttggagcaggaggggggtaagtygtatgcctagataattgtatttgcaaaaactctccaggaggattccangaaactggttctattggttgcctcttggagggaaaatgggggarga

SEQ ID NO: 23882 - DNA, 288 bp, Homo sapiens
  misc_feature 280: w=a or t
gtaatgggatggctgggtcaaatggtatttctagttctagatccctgaggaatctagggatttctaacataacacactgacttccacaatggttgaactagtttacagtcccaccaacagtgtaaaagtgttcctatttctccacatcctctccagcacctgttgtttcctgaccttttaatgattgccattctaactggtgtgagatggtgtctcattgtggttttgatttgcaattctctgatggccagtgatgatgagcatttttttcatgtgtctwttggctgc

SEQ ID NO: 23883 - DNA, 203 bp, Homo sapiens
  misc_feature 142: s=g or c
cctaggcatctggtcaactcttctgtctagaacaagaagggctctctaccattgccactctgggtaggagattttaaaatgagcttccccaggatcattccattctgatttagaaaactcaagtctgggccaggtgcggtastcatgcctgtaatcacagcacttacttttatagaccagcctctgcctgtgggaaggaaggc

SEQ ID NO: 23884 - DNA, 332 bp, Homo sapiens
caagtctttcaatccatgaacatgggatgtctttcaatttatttaaaacttctttaaagtttttcaacaatgttttgtagggttccaagtataagttttacatttgttttgtcatatgtattcccaagtattttattcattttgatgccattgcaaatggaattattttctttttattttattttattattattatactttaagttttagggtacatgtgcacaatgtgctggttagttacatatgtatacatgtgccatgctggtgtgctgcacccattaactcgtcatttagcattaggtatatctcctaacactatccctcccggcctc

SEQ ID NO: 23885 - DNA, 222 bp, Homo sapiens
accttttatttggaaaacaaaagagcagggagccctattagggaagcaggaggaggaaagacttccaggcctcttgaattccatttatctgtaaaatggggctaattccacctatttaatgaggtaatgagtgtgtgtatgtgtatattcccttagtctgccagaaactaatattattttaggatagtcacaaacaatagctgtttaatttggaggagagga

SEQ ID NO: 23886 - DNA, 215 bp, Homo sapiens
aagacgtggggacgcaggcgggtcgtagagagcgttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtccc

SEQ ID NO: 23887 - DNA, 357 bp, Homo sapiens
atcttggtattgtcatctgttaattctttttccttaggttgagatgttcttggttcttcatatgatgagtgactttctgttgtattctagacattttgcatattatgttttaagactttggatattatttatataaatcttttatcaggtcttctctaacctgcgctgatcagtgtaaagggatgccttattattgccagatggaaaagatgtgagcttctttggcagaagaaagtagatgtctaagccacacacctggatttgattccttgctctttacccagaagacatttgatattgggaaagttgcttttctggtttccccacctgttaaactggcatgtaatcagggcgtta

SEQ ID NO: 23888 - DNA, 247 bp, Homo sapiens
  misc_feature 7: y=c or t
caggtgyggcggcgtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattaaatgtgacgaactgcccccccccc

SEQ ID NO: 23889 - DNA, 180 bp, Homo sapiens
aaaagcgggtcgaaacgtgacaaccgcggctcagatcaatgctgcgggtctggtagcagccccaagttcgggcctgcaggagtgaggagagaaaacatcttcagtcgtgctggtgaagcctgcaaaaaggtgatacttaatgtaccttctaaactagaggcagacaaaataattggcaat

SEQ ID NO: 23890 - DNA, 123 bp, Homo sapiens
atacaaaaattaggctgggcaccgtggcccacgcctgtagtccctgcactttggggggctgaggcgggcggatcacctgaggccaggagttcaggatcggcctgaccagcatggagaagcccc

SEQ ID NO: 23891 - DNA, 183 bp, Homo sapiens
  misc_feature 131: s=g or c
atttcctgctccctctccagcccggcccaggccagcctaccggcgactaggatgctttcgctttcgctctcgctttccaatactcgggactggggaaaccgggagaatagaagcaggtgtccccagcgcascaatcggcttccgaagtaggtgagttgctgcctgaagagaaaagacaaacga

SEQ ID NO: 23892 - DNA, 245 bp, Homo sapiens
  misc_feature 144: d=a or g or t
tctctctatctatctatatatataggaatttttaaaaaatacaccgaaagaatagaaacatatcaacactatacttaacacatgtactctgcattaggttttaattccatgaattcctattcattttttatttttatgcatgadagtttactgggtaatggaatttaccatccctgtttagattctgcattgatgacatatcctgttcaatgtcataacccctaattattaaccgtgttcacccc

SEQ ID NO: 23893 - DNA, 160 bp, Homo sapiens
  misc_feature 16: s=g or c
  misc_feature 46: s=g or c
  misc_feature 76: b=c or g or t
  misc_feature 82: s=g or c
  misc_feature 96: s=g or c
aattgggatcggagasgccgaggtgagggctggaggaggcacaaasaagtcgctgggtgcagaagggaggggagabggggasctgagaggcgagasgaggaggaagaggagagagggcagcagcgcgcggtgtctccggctgctcagtccgaccgcagct

SEQ ID NO: 23894 - DNA, 230 bp, Homo sapiens
caaaattagctgggtgtggtggtgcatgcctataattccaactactcgggaggccgaggcaggagaatcggttgaacctgggaggtggaggttgcagtgagctgagattgcgccattgcactctagcctcccgggttcaagcaattcttctgcctcagcctcccgagtagctgggactacaggtgcacaccaccaggcatggctaatttttgtatttttagcagagacgg

SEQ ID NO: 23895 - DNA, 334 bp, Homo sapiens
  misc_feature 98: r=a or g
gggcagcttttcaaaaatcacgtctttgtatttgcagctacagactgggtccaccagctaagaggttggtttttattagggttgtaaaatagatttaraatctgcttgttgttggctgagatttaaaagcagatttctactatttaaaaaagatagtttgaagatactcccctaaaaagtaaagattcttccatactcggctcggatgagttgttttccttgtttgagggattctaggtcacacacttctatgttttaattcccgtggtaattcaaaatgtttgagaagtgggttgcgactgtgtcgttttaaaattgtacattaagctgacgg

SEQ ID NO: 23896 - DNA, 177 bp, Homo sapiens
actaaaatttgcagtatagaaactctgaaaatgaagacgtgtctttaagaaaatccaacacagtattttcacaacttgaattagcagcagaatgcagcatgaaatgaacagactttaaaaccatggaaccgcgttggaatctgtgtgatcttaggcgaattactgatcaccccctct

SEQ ID NO: 23897 - DNA, 445 bp, Homo sapiens
  misc_feature 334: w=a or t
  misc_feature 343: d=a or g or t
  misc_feature 365: w=a or t
  misc_feature 366: y=c or t
  misc_feature 367: w=a or t
  misc_feature 371: r=a or g
  misc_feature 404: m=a or c
acaatggtaaagggactgtccttaaaagagacaagcccacaaaaacaagagaaaacaagagagaggataatggcaacaaaatattggcagcatgggaaatgacaaaacagacctgagaaaatgaaattcgaagccaggagggaagacagcctagaactaacctgacttacacggcaaaattcccccaacggcgaggtgtcttcagaaggaaggatgagggctaaaatggggagcggtttaaaaactgcttaagaagtaacacatatccagattcataatatacccagatctctaactccaaccagcagcaaatataaagacttattctccagawaaggataadaggacctctgagcgggactgcwywggcrcagatgagggctgagcccaccacactgaaaacmggattacctgagcacatgagcacagtcacacaggatgaccc

SEQ ID NO: 23898 - DNA, 150 bp, Homo sapiens
tattattattgagatggagtctccttctgtcatccaggctggagcacagtggtgtgatcttggctcattgcaacctctgcctcccaggttcaagcgattctcctgcctcagcctcccgagtagctgggattataggcgcacaccaccccg

SEQ ID NO: 23899 - DNA, 134 bp, Homo sapiens
atacatcaatgggaaataaggtggaattaaaccatttttggtttagcagaattaccaaaatgatctttattatatcatcacatttactatttgggggcattaggataaaattagcttagaataacctgccaaaa

SEQ ID NO: 23900 - DNA, 277 bp, Homo sapiens
acaatgtaattgtgatcttatgtaaagatttacctactgtacagctattaattgatggcaaagttattttggctttgtttacctatgttaagaagcctgagaagcaaaaaataattgactggtctgcagcacagcatgaagaattacaactgcatgcaattgccactttgtcatcagtggctcctttattaatagaagaatacatgtcatgccagggaaatgctcgagtccttgcatttctagaatggtgtgagagtgaagatttcgtgggggaaaa

SEQ ID NO: 23901 - DNA, 155 bp, Homo sapiens
  misc_feature 58: k=g or t
attattgttattatcattattattattattattattattattgagatggagtcttgckctgtcgcccaggctggagtgcagtggcatggtctcagctcactgcaacctcctcctcccgggttcaagcgattctcccacctcagcctcccgggaca

SEQ ID NO: 23902 - DNA, 134 bp, Homo sapiens
  misc_feature 59: r=a or g
tttcatctgagaggcaacataagctgggagggaagggctgcaaagagggggccaggacraaatgtgttacctggggggcccccattttgactccaccctgagctggggctgggccacaggagggcagagggaac

SEQ ID NO: 23903 - DNA, 254 bp, Homo sapiens
  misc_feature 62: s=g or c
attcaaggtatatggctgctcgggagttaaggcgcggaggcccgagaaaggataaacaagasaccgcctcatcagataagaacgtctccttcgatgtcacggatttcaagaggtagctggagaaactgacgtcaggagtgtcctgtgaatgaacatcgcccgaggcctagcacccacagaagaagggttctattttactctactttgcttgatgttatttattttctaacaaagtgatccgtagtccgcaaccc

SEQ ID NO: 23904 - DNA, 208 bp, Homo sapiens
gttaagatagaaggttaattaggctataactctcaagaggctggagttgtgatgctctgaactgttaacttggttgtggttacagaaaactgaaccttgtgagatgttccagtcctggagtgctgtgcatgcaaactcgacctatagcactccacttcatctcctgcccccagcccttataaatgttcactaacataaaaaggggaag

SEQ ID NO: 23905 - DNA, 256 bp, Homo sapiens
cgatgattaacagcaaaaacaatagccaacgccatagacatttcagctggttcattttacacaattctgactctgctcagtgggtgccaaaactgttgctcccagatcaattgcagacaagagcagagctttcactggaaatttcaaacaggtgggatcaacattctgaaggatttctttgaagaattttaacaataaatgaacatggttttaccagtacatcctgaagacaaagtacaatcagatcactggcatc

SEQ ID NO: 23906 - DNA, 202 bp, Homo sapiens
ctcagttgcaggtgaagaaggaatatttggattttctctatcaacattattaatttttttgattctatatcaacattattaacatttcccccatatacttttatttggatattaaaaaaataagggtataactttcaatctgacctactctgactggtacctggacaataaatgactcttttaagggagagctctccaccca

SEQ ID NO: 23907 - DNA, 317 bp, Homo sapiens
  misc_feature 61: k=g or t
  misc_feature 65: s=g or c
  misc_feature 233: w=a or t
  misc_feature 246: r=a or g
  misc_feature 287: w=a or t
  misc_feature 288: r=a or g
  misc_feature 293: v=a or c or g
  misc_feature 299: d=a or g or t
  misc_feature 316: k=g or t
acaaaaatctgatgcctccctgcaccgttctaacaatagaaatctcttgtagatatttccktatsggcatatgaatttacctcattttttgtaaatcactgatactattctattgtatatgtgtacttaatttgcttaaattatattttctactagtggatactttggttatttccagtcttttattatgaacactgctgtagtgaaaaggttatacacaagtatttgtacawatatgtgaatatrtctgtatgataaaggagatttttggatcaaaatgtatgtawrtttavagtttdgttaggtattgtatackt

SEQ ID NO: 23908 - DNA, 159 bp, Homo sapiens
ttgaagtgtctccttttacacgcatttattaccatttttattacagtccatatatatgtgaatatttatcactgattgtttttaactttttgttttgaaataatttcaaacttaaagaaaagttgcaggaatcatgcagagaactctcatacacccctt

SEQ ID NO: 23909 - DNA, 164 bp, Homo sapiens
  misc_feature 88: r=a or g
  misc_feature 89: r=a or g
  misc_feature 115: k=g or t
  misc_feature 129: r=a or g
attgatgtagtcagtgagaatcctggacagacacacttccatactattcagaagagtagctgggatgctttcatcagacattcacccrragtgaacttagtgatgtatttttttktatatgaagaagartttgaccccttctttcgctatgaaatacctgccct

SEQ ID NO: 23910 - DNA, 290 bp, Homo sapiens
cttattaaaattagttgttagaggctgggcatggtggttcaagcctgtaatctcagcactgtgggaggccaaggcggacagatcactcaaagtcagaagttcgagaccagcttggccaacatggcaaaaccctgtctctactaaaaatacaaaaattagttgggtgtggtggcacatgcctgtaatcccagccactcgggaggtgaaggcacaagaattggttgaacctgggaagcagaggttgcagtgagctgagattgcactgctgcactccagcataggcgtcagat

SEQ ID NO: 23911 - DNA, 310 bp, Homo sapiens
  misc_feature 143: y=c or t
  misc_feature 281: k=g or t
ttagtaactgaattttgaggacatttctctgtttagcattatgcaaactgatatgtaatctgaggttccaaagtcaatttttttcttttttttttgagatggagtcttactctgtcacccaggctggagtgcagtagcacgaycttggcttactgcaacctctacctcctaggttcaagcaattgtcctgtctcagcctcccgagtactgggactactgtcttgcgccaccatgcctggctaatttttgtatatttagtaaagatgggttttcgccatgtkggccaggctggtctcaaactcctagcccc

SEQ ID NO: 23912 - DNA, 353 bp, Homo sapiens
  misc_feature 52: k=g or t
  misc_feature 66: w=a or t
  misc_feature 351: k=g or t
tctttctctgcttgtcgatattgtctgtgtgattcagagaattggggcagtkacattgtgtctgtwgttgagattattaaaagattaaaacgtagttgtagaaatgaaaaattaaacagctgtgttttaaaaatgcaaaccaatatcttgttaataaaggaattcaagctatggggcagccacactcccctcctcccaggctggcataggtggccctgggctggcggcttaggaagcatggagcacacttagggtagtgcctgcctgggcaagagacacctgccgagcaaaaggaacgagaatctggggctcagagcctcgcagttgtgccaggattttcctatacatgtkca

SEQ ID NO: 23913 - DNA, 237 bp, Homo sapiens
tgactgaaatgattctttgaaatgcatattgatttattatgtattgactttttaaaaattgaggtataattttcacaaaattctccaattttcagtgtcaaattcagtgaattttgaaaacatatatacagttgtctgtctgccacagtgatcatgatacagaacactttctttaccctgaaaacttctcatttttccttttgcagtcaatcccctgctcctatccttggccccaat

SEQ ID NO: 23914 - DNA, 225 bp, Homo sapiens
  misc_feature 21: w=a or t
  misc_feature 168: d=a or g or t
  misc_feature 169: k=g or t
  misc_feature 175: k=g or t
  misc_feature 180: k=g or t
  misc_feature 185: d=a or g or t
  misc_feature 197: w=a or t
  misc_feature 208: w=a or t
  misc_feature 216: k=g or t
  misc_feature 220: r=a or g
cttttgtaattccatacaaawtgtaggattttttttctatttgtatgaagaatgtcattggtattttaatagggattgcattgactctgtagattgttttgaatagtatggtcatattaacaacattaattcttttgatccataagcagaggatgtcttttcatttgdktgtatkctctkcagtdtctttcatcagwgttttgtagtwttctttgkagargatcc

SEQ ID NO: 23915 - DNA, 117 bp, Homo sapiens
  misc_feature 19: k=g or t
  misc_feature 52: w=a or t
ggatctttttatctgaatkaacagtttaaactataaataaattagaataggwttaactacatccagttttctaggtcacttataagagctttttataccttgttttatgggcagcca

SEQ ID NO: 23916 - DNA, 351 bp, Homo sapiens
  misc_feature 20: k=g or t
  misc_feature 21: w=a or t
  misc_feature 41: y=c or t
  misc_feature 42: w=a or t
  misc_feature 49: y=c or t
  misc_feature 75: n=a, g, c or t
  misc_feature 260: h=a or c or t
  misc_feature 271: y=c or t
aagtagtaggccccaatcakwaacgctcccaccagtcactywctaaatyacctagagaggggttgtatggctgtnggtgatgtgctgttggtacacaattgtgcctgtgtctcaacactgctctgggatatacaactagaaatcacattggaataggaggccttcaagattttgtgctgaaatctgcaacactgtgtagcctgccatcctgcccaccatttataccactcaacttcgaagccactcctattgtgagagthgctgttgaacyaaaacatccaagtttgcaaagattcatatcagtgtatctgaacctattattccattcagagaaacaatcacaaaaccccc

SEQ ID NO: 23917 - DNA, 57 bp, Homo sapiens
gttttgctcagccagggcatttaaaaaaatactcatgctgctatttttttttttttt

SEQ ID NO: 23918 - DNA, 365 bp, Homo sapiens
  misc_feature 277: n=a, g, c or t
tatttattttagagatggagtcttgctgtgccacttgtgctggagtgcagtggcacaatcatagctcactgtaacatcaaactcctcagctccagagatcctcttgcctcagcctcccgagtagctgggagtatgggcatgccactacacctggctcatttaaaaatttttttgtagagacggggtcttgctatgttgcccaggctggccttgaactcctggcttcaaaggatcctcctgccttggcctcccaaggtgctgggattacacacgagtnactgcacttggccctaaatatagtttatttaaatgcaggtatatatgatttcatttttaataatgattatttttaacaactggctcac

SEQ ID NO: 23919 - DNA, 243 bp, Homo sapiens
  misc_feature 20: s=g or c
  misc_feature 197: k=g or t
  misc_feature 198: w=a or t
ataaccgaggccttgtctgsagagtaacacaccaggcccaaatccaccgccctcggcagccgccccacgcgggcccttcctcggcagacttcccaacctctacttgagccgcagaggaaagtgagaccccctaggctctcctgaagccagctctgggcccctccccaaggatgctttgggaaggagataaggaggtkwgatagaatctggcagagacggaagatgaaaaaaagaccaacgaaa

SEQ ID NO: 23920 - DNA, 253 bp, Homo sapiens
  misc_feature 20: y=c or t
  misc_feature 157: w=a or t
  misc_feature 220: w=a or t
catgaagttgtacaaccatyattacaattcatcttagaacattttcatcccctcaaaaagaaactccataccctttagctcttagtttcagtctcctcatttccctcagccctaagcaaccattaatctagtttctgtttctatagatttgcctatwctggtttcaaatggggaatatcacatttagtcttttatgactgactttttttattagtatgtwttcagggtgttctttcacattgtagcatgtaca

SEQ ID NO: 23921 - DNA, 321 bp, Homo sapiens
  misc_feature 20: s=g or c
cagaagtgatttggactatscattcatgacacgtaaatattttgttttggactccttccaattgtttcattagataattgaaacaaccttttggattttttagctttgcattttaaaaatgtcttaatggtttatttaactaaaggtggatttctggcactaatttatctttatttttcttggcttcttcaaggacagtaatagagtgtgaatgtttggattttactgtccatgactttatggtttgatcatttatagccagctcagccttgcatacagatttaagacagtttatgaacctaaactttttttcccccacct

SEQ ID NO: 23922 - DNA, 119 bp, Homo sapiens
  misc_feature 19: s=g or c
ctctttccgccatctttcsgcgccgccacaatggtgcgcatgaatgtcctggcagatgctctcaagagtatcaacaatgccgaaaagagaggcaaacgccaggtgcttattaggccgct

SEQ ID NO: 23923 - DNA, 80 bp, Homo sapiens
agatattatacatatgaatatctcttaatgttagtgggcagaactgggaacccttccctttttttttttttttttttttt

SEQ ID NO: 23924 - DNA, 463 bp, Homo sapiens
  misc_feature 19: r=a or g
  misc_feature 396: r=a or g
taatttccctcagatcttratttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaratcctaaaaagtatgtaatattataagtatcttttcaatacaggtttcattgctattattcatcagt

SEQ ID NO: 23925 - DNA, 394 bp, Homo sapiens
  misc_feature 370: w=a or t
ctatcgaggagcaatgagggggaagcttattgtccaaagtcctattgatcccaagaatattcccaaatatgaccttctctatcaagacatttagtacattaattgctgtcaaagatgaagaagaaggcacatcttgacacagtacctgaatccagctgtgctgtgtttctggagtcctttggaaacatgtgtcccagaggagaagaggtttgacttgcgtgtagaaaacccggcccctgaggaaaagaccccactggttctctgatgacctgggatgcctaactgtctactccctgcaagcctcagagcagccaagtcattggtgttcattttccccacagtgatttttgtaacttctctttctaatgtwtttctttatccctttaatacagaa

SEQ ID NO: 23926 - DNA, 164 bp, Homo sapiens
ggaatatataaagttgactcagacaaacttggacttactttccttccagtaattaaagagtagaactgataatactgattattcattaattggaggaaggaacattagtattgaaatgccgttaacattttaaaaaataataattattatcatagccttaccca

SEQ ID NO: 23927 - DNA, 232 bp, Homo sapiens
ttcattgtcagtcatgcttggaacagcatttccactagagaatccagcgttctggcagtagcaagagtacacatctggagcatgagggactctagcatgactcgtcagatgcacaccccaagagacaagaatgtgtagtttaatgaccggcgtggaccatacgaaattgagattctaactttcctgcaggagtgctcatgagcccagaatgtgattgggataaggccaaacc

SEQ ID NO: 23928 - DNA, 117 bp, Homo sapiens
caagataaagtttcgaggacatcaggccttttgaaatacaatgtcaaatgacacattgtacgttttcaaaaaatccgctagacatgtcataagttttaactgtaatgcccaggaaag

SEQ ID NO: 23929 - DNA, 403 bp, Homo sapiens
  misc_feature 117: m=a or c
  misc_feature 122: y=c or t
atatcagatttatagataggtgtgtagctgcaaatattgtgtctaatctttgtctccgtgaaatccatagtatttttgaatttctctatctccagcactaatgcccatcacacacamccttycctggctgaatttgataccccatggtagaagcctctatcctgctgtctgcgtcagtattttggagttcttcctgtgtctaatctgtgatactcattatctgtatatttaaatggtctttccagccaagtgtgcataacctttattctgcagtgggggattggccttacatcagttactttttctaccctggcaaatgggctaggcaacctagaaggaaacctgcaggcctctcttttccttgtagaccaaagcagatgtctccagtcgactgtctgcttca

SEQ ID NO: 23930 - DNA, 313 bp, Homo sapiens
  misc_feature 212: r=a or g
ggtccccaggacctagaaaggatctggcatcaacgaaggggctcaacacacatgtgtggaacaactgaaccactggattcacaaaacagctttccctgaaggatgcatgtgacccctgggtcagccagccagcatgggtgggagccagtaaggaggcagccaatttgcaattagggagcaattaataactacccaattggtacaaaagacarctgaggggctgggaggagaacaagggaatgaagctcagaaaggagcctcaggtctttcttggaaaatactgggagcgggcaatgaggaatccccggggtaa

SEQ ID NO: 23931 - DNA, 107 bp, Homo sapiens
ttcaacttaattggctattccaaagattttttttttcctatttttgacgattggagcccttaagatgcacgatggaattgtgttttgcgttttttggtaaaaggagc

SEQ ID NO: 23932 - DNA, 138 bp, Homo sapiens
accagatcccagaggctgaacagctcgactttctctgcacagcaggtccagcatcctttgaaacatgagttcttaccagcagaagcagacctttaccccaccacctcagcttcaacagcagcaggtgaaacaacccag

SEQ ID NO: 23933 - DNA, 203 bp, Homo sapiens
tttactcctatctctgattagatttctagttgtgcaattattagggcacatggcttacacatcttgagacttgttccatattgccaaaatgcttttctgatacttgcagtgtatcagatgcccattttgccatacccttgctagcctccagtattatttttagtaactctgccaatttctaggtgaaaaactgtacccccaaa

SEQ ID NO: 23934 - DNA, 124 bp, Homo sapiens
ttgagcatctctcatgtgcttgttggtcatttgtatatcttccttagagaaatgtctactctattcagatcttttgccattttaaattgggttatttatttatcattgagtagtaagagttttt

SEQ ID NO: 23935 - DNA, 231 bp, Homo sapiens
gtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacactg

SEQ ID NO: 23936 - DNA, 159 bp, Homo sapiens
aaaaaaggcagtggtagggtagagggtggcagtggagacagctggagagcactgaggacgcggacccacgggtactgtgtgagctgtgaagcccgcttgggagaccccactgccagccaggcatgcctggcgcggtggctcgcacctgtaatcccagct

SEQ ID NO: 23937 - DNA, 273 bp, Homo sapiens
ttacaaagtcaggaaacaacaggtgctggagaggatgtggagaaataggaacacttttacactgttggtgggattgtaaactagttcagccattgtggaagtcagtgtggcgattcctcagggatctagaactagaaataccatttgacccagccatcccattactgggtatatacccaaatgactataaatcatgctgctataaagacacatgcacacttatgtttattgcggcattattctcaatagcaaagacttggaaccaacccactg

SEQ ID NO: 23938 - DNA, 444 bp, Homo sapiens
ttcaaacaacaattggaattggataaatgctttcagctgggagcactttcctaatacctttgtaggtaatgggattctctatttgtgctgggtgacaaacggacagtgccctggacagactgcctaccctctgcagaatctaccaaaaagtagagttttcccatgagactgcttgtggtccatctaaaaatgaaaaaataatcagagaaaatgcgcaaagccttttctaactacagttatgaaatgatggcttaaagaggtatttagaaaataagagtggagtaatacagaaacaaaatctgaagaagaaagtttgcttaggagctgatgctctttgtctacaaacaagagggtaaggagctggatccaattgaattgaattgtttttgtttgcttgtttgttttcttccattcagtgcctttcaactgttttttactggatga

SEQ ID NO: 23939 - DNA, 122 bp, Homo sapiens
  misc_feature 16: n=a, g, c or t
  misc_feature 18: v=a or c or g
  misc_feature 42: n=a, g, c or t
  misc_feature 72: h=a or c or t
  misc_feature 89: s=g or c
cacattgacttttaanavatagattccctaggaattcaaganaaatacttattttctaaataaatcacagchagacagacacaattgtstcactacccccaatatcctaacacactaacaag

SEQ ID NO: 23940 - DNA, 143 bp, Homo sapiens
atataagttggtaatctgcagtgcacacccatttaaaaaaatggataccttccccaaactaatccatctctttttttttcttcccacagcgtttgctgccaattgatggggcaaatgatctcttttttcagccacctccacag

SEQ ID NO: 23941 - DNA, 119 bp, Homo sapiens
cagtagaaataatgtctctttttattttttttcccattaaaaaattttgttttaatagcaatggagatggggtctcactgtgttccctgagctggtctggtctcgagctcctggcttcg

SEQ ID NO: 23942 - DNA, 252 bp, Homo sapiens
cagagtctgattgaagtttctgaaattattaagtggatagataatagagagtaagtaaatgagagcatggagggcttgccaagtctttaatgctcacttaaacaaaactgcctgcaggttcaacaaacccatgcctgggttttgtgggtttacaaggtccgtctccagaaaagttgttttaggtgatggtcaccattttaattaaagggatatcaaactatatgtttagagagataataacaagcccacccg

SEQ ID NO: 23943 - DNA, 450 bp, Homo sapiens
tatgcataattcactttaaaaacatagaatatatggtctaatagttttttaaagcttttggactaaagtattccacaaatcttacctctttaggtcactgatggtcactccgattctgagtgccacattggtagactcctaaaatacagttgacaacttagccaattgcaactccagtgttgataattaaaatgaaatggtaaagcagcagactgtaaggtctttagagattttttttttaaggttcaggccgtagttcctcaaggaatctcttaagttttgcccaaagactggtacttcctttcagtagggcgctaatgtatacacattaatgataagttgataacattaaaaatgtagctgacttatcctattaaacctcctctgctatgttcacagattctgcatagtttttttttcagcctaatgaaatctaatatgcattacctc

SEQ ID NO: 23944 - DNA, 483 bp, Homo sapiens
  misc_feature 330: y=c or t
gtgacagaagtagtaggaagtgagctgttcagaggcaggagggtctattctttgccaaaggggggaccagaattcccccatgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgayttggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtat

SEQ ID NO: 23945 - DNA, 272 bp, Homo sapiens
  misc_feature 102: r=a or g
  misc_feature 135: s=g or c
  misc_feature 157: y=c or t
  misc_feature 226: m=a or c
  misc_feature 231: m=a or c
  misc_feature 248: k=g or t
  misc_feature 250: w=a or t
  misc_feature 256: w=a or t
  misc_feature 263: r=a or g
tgacatttattaagttcagtgcttagtgtatatttggattttatttattagtcacaagacctttgtgcaggtagtaggcatgattatctttttttttttgaratggagtcttgctctgtcgcccaggctggagtscaatggcgcggtctcggctcaytgcaacctccgggttcatgccattctcctgcctcagcctcccaaatagctgggactacaggcgcctgcmaccamacccggctaattttttkgwattttwagtagaracggggaag

SEQ ID NO: 23946 - DNA, 127 bp, Homo sapiens
  misc_feature 55: w=a or t
  misc_feature 61: w=a or t
gaatgatggagaaaaatggaccaaaggctaaaaatattgcagggcatcgggtgtwtctatwccacagagtattgttaatgtacaacacacacacacacacacacacacacacacacacacacacaca

SEQ ID NO: 23947 - DNA, 178 bp, Homo sapiens
  misc_feature 17: k=g or t
ctggctgcccccccttktggctgtctacaagagactgtttttatttttatgtatttagggggtacaagtgcagacttcttatatgaatatattgtatcgtgatgaaatctgggcttttagtgtacccaatagtgaacatggtacccaataggtaacttttcaaccctcacccgcccag

SEQ ID NO: 23948 - DNA, 398 bp, Homo sapiens
tgctggggccacacatgcttgccaggaccttccctctggtgaccagtccctgcaaaagcagctgctcccatgctcctcccagagccatttctccagtaggggaggcgaggtcacttgggaactgggggctctggggccaagatgtctttggcaccttcatttgagggtgggagcggaatagagagcttttcctgagatgctgggagctctctactaaccatttcattcagtgactctgaagtccccagagagggacgcatcccagagcaaggtccgggcccccttaacgtggacaccgctgtgatttgtttgcaggactccctggcactggggaaaacagaggaggaggcactgaagcacttccgagtgaagtttaacgaagccctccgtgagagcag

SEQ ID NO: 23949 - DNA, 360 bp, Homo sapiens
taagaactgccttgcactgaaagaacaataaaccctgcacattaatggctctggttctatacttcaagctacagacttacatgtacagtattctacatggtgatttttgttcagtgtatatgtaatctgacttccgtatcttactgagtattatagacatatttaggattcaaaatagactcaacagcgtttcatactatatagtaatgacaagtggaaacatgtatgccgcataaacgataaagttattaaggctacttttataatacagttgactcgaacaatgcaggggttaggtgtgctgatcccctgcgcagtcaaaaatccacgtgtaacttttgactccccaaaacctacctg

SEQ ID NO: 23950 - DNA, 145 bp, Homo sapiens
cttatttttcaagattgttttgtctatttgaagttccttacaatttaatgtgaattttaaaatcagcttgtccatttttgcaaaaaaggtagttgggattttgatagagattgtgttgagtctgtagatcaatttgggaggcgag

SEQ ID NO: 23951 - DNA, 110 bp, Homo sapiens
cttagtgattctcaatcttagctacatattagcctggcagagctttaaaaaattgatacctgggtcctattccataacaactaaatcaaaatcacccttttttttttttt

SEQ ID NO: 23952 - DNA, 107 bp, Homo sapiens
  misc_feature 67: s=g or c
agaagagcgcgtgcatcgggagcagacgtcagccagctgcaaggaggagcggcccggggctgcgtastccgctggaccccgattccgggcagagacccccccccctg

SEQ ID NO: 23953 - DNA, 120 bp, Homo sapiens
atccaaccccgggccgcggccaacttctctggactggaccagaagtttctagccggccagttgctacctccctttatctcctccttcccctctggcagcgaggaggctatttccagaccg

SEQ ID NO: 23954 - DNA, 439 bp, Homo sapiens
  misc_feature 136: s=g or c
  misc_feature 393: y=c or t
cttttttcttccctttctcccactaaacgggggtggacattaaatgttcctgcttggggaataggatggcctggagggaatgaccatgaagaccggcacttcacctccaggtcattggtctttgtccagctgcaasagatctttggagaactgtgcggctcccggctgtgctgaagggcagggagttctcccagctattcccggttttcatcttccatggcctactccttccacaccctggtgccaccctggcctgcaccggccatgtgggcttctgccttcactttcaacatctgactcccaagcccagcccacgcaagacagccccaaggccccatgcccaagactagggtggtgagattcacttcccatctactgcacgcctgcatgggycaggcaccccccagtgctaagaatacagagctgagtgtgtgagcaa

SEQ ID NO: 23955 - DNA, 180 bp, Homo sapiens
ccgtctagatctgaacctcgctgagggaatggtcagttttactcccattagatggcttggcccaaaggacctagcaaccacccagacaaaaatttcttcctaaaagctgcatgtgtctgtggtctctaagaggcaaaactaaaccctaaagaaaaagctaacccacccccacccccactg

SEQ ID NO: 23956 - DNA, 157 bp, Homo sapiens
  misc_feature 4: b=c or g or t
  misc_feature 89: y=c or t
  misc_feature 94: r=a or g
  misc_feature 107: y=c or t
  misc_feature 110: w=a or t
  misc_feature 153: m=a or c
gtcbataatccttcatttctctatcacagtgcactttatccgcctttgccatttaatcgaatttagactctctctctcttttttttttyctgaratggagttttgcyctwattgcccaggctggagtgcagtggcacgatctcagctcaccgmaacc

SEQ ID NO: 23957 - DNA, 353 bp, Homo sapiens
catttcctgatctcactcatcataatagaaaaagattcttagattcagacaagaaagatacaaaccttaggagaatttccacagtttatttccaaattttaggaaacttgatcctggaatgttccttcattcttcacctataatttgtaacaatgtgaagtcacacttgttccataaatcctgctcaaaccactctagtccctagtaatctctctgtccctccaaattcaaacaataaatgtagcccaaacctttcatttcccaaaccaaacagcatagatcttctaaactgacatttgtctatagtgaagaactagttcctcccctctccctcccaattcattgcagaacct

SEQ ID NO: 23958 - DNA, 322 bp, Homo sapiens
ttttggctttgtttgcctgcaccccattccttgaggacagggaaagtttctgtccccctgttgtgttgaggacactattaagttccctgccattacctggtgcttaacacatagtagatgctctattagtgttggaatggatgagctctagtgagtaagcgcctaagacaacacagaccctaaggtcttctgaacccaaccaagtgccctgtttttgctgctataccaggctgtccttcttcccactgccatcctcctggttctgttctctcagcccaagcaccgtgtgtagcctaatcatgtatatctattctcagagtac

SEQ ID NO: 23959 - DNA, 153 bp, Homo sapiens
gggctttggccttttgccctagggagcgagtgcggacgagtgggagcgagacggccctgagtggaagtgtctggctccccgtagaggcccttctgtacgccccgccgcccatgagctcgttctcacgcgaacagcgccgtcgttaggctggct

SEQ ID NO: 23960 - DNA, 161 bp, Homo sapiens
  misc_feature 127: r=a or g
gagcctgcatatatatgtaaatgtctcaatgataaaaaaaaaaatgtaaacatggattggcattaatttgcaagcagaatcttaatagcctgatgggttttttgtttgttttttcttctagaatgargttaaacgttcgttttcaccttacgacgggaacc

SEQ ID NO: 23961 - DNA, 189 bp, Homo sapiens
  misc_feature 59: r=a or g
aggatctccaggctgctgggccctgggagctgggggtgtttgcagtcctctgggttcargtgctggtgactgaagaggacacacgtccccttgctgccagccgtcttcctgtgtttcctgtgtctggtccctgaggggcgtctctcgttctgtgcagccacccagggatgatgtggtgttaagtacccc

SEQ ID NO: 23962 - DNA, 109 bp, Homo sapiens
  misc_feature 2: b=c or g or t
  misc_feature 7: w=a or t
abaacawctctcatgagacctgaagtgggcagctcccttccgcagcaggtcttcctgacgagtgtgcgagtccagctgagtccagggttttgatttttgtttttttttt

SEQ ID NO: 23963 - DNA, 215 bp, Homo sapiens
  misc_feature 7: n=a, g, c or t
  misc_feature 25: s=g or c
  misc_feature 37: r=a or g
ttctaangttttccatgatgtcttsagtcagttttartcggatattattctagaaatggatctattttcacaaaattctcaggacttttggcataaaattgttcatacagcctctttttatctttttcaagcctatagctcctgtagtgtggtctcccttcctgttcctggcattgttcactggcacttgtgcttcaatttctctcctccctgac

SEQ ID NO: 23964 - DNA, 236 bp, Homo sapiens
  misc_feature 2: s=g or c
  misc_feature 3: n=a, g, c or t
  misc_feature 8: v=a or c or g
  misc_feature 9: s=g or c
  misc_feature 141: s=g or c
asncagtvscctttactctcttctccctccagaccttcctctgacccttgctgaactggggtccctttgtgagtgtctcagtctagaggtacctccctccctggggggtctcagctcctggagtcgcaggcccttggggcscctctgtgagatctcaatgctgtctggggaccctaagagttttctcacctgttcagtctcatctaaccttccaatgtctgatgttcctgccagag

SEQ ID NO: 23965 - DNA, 271 bp, Homo sapiens
  misc_feature 8: y=c or t
catgaccycaagtaatctgcccgcctcagtctcccaaaatgctggcattacaggcatgagccaccgtgcctggcctactttcactgaatttctgtgatgaaacgggaaaaattaattttgttaaatctcaagtagaactatattgtcattatcacatctaaacagatatcatcaaatacctagtgttcagatgttctgggttgcctcataaattttgttttctatttgtttcatagtaatcataatctaaacaagatccacacagtgcgaa

SEQ ID NO: 23966 - DNA, 55 bp, Homo sapiens
  misc_feature 7: s=g or c
gcctggscgacagagtgagactctgtctcacaaaaaaaaaaaaaaaaaaaaaaaa

SEQ ID NO: 23967 - DNA, 88 bp, Homo sapiens
caatttaaatggtctaaacttagtaggcaactaaaacaatttttttggttttattttcattaaatggcactgggaaagtagggagaat

SEQ ID NO: 23968 - DNA, 256 bp, Homo sapiens
caccccgctatggcagagatagtcctctaggtcatggttgctctagtctacagatgcaaagactgagttatgcaaacacctggcacttactgaaagctgcagagactgacactcagcatatccctctacagccctagactttagagtctgaagagccaagttccctaactcacttgtatagtgcattttcatctctttgagctccagattttttctcaggaaatggaataacaatacatgttctatccaccccaca

SEQ ID NO: 23969 - DNA, 179 bp, Homo sapiens
cctcatctggaaaggtatggtatttccttggatgatatgatcactggctgggtgtagtttgcttcatatttctgttttgactttttctaacgtctattttggtgtaatttcaaagctgccttccagccagtcagaacatgtggcgttcttgttttcctagggccacatctcagggttga

SEQ ID NO: 23970 - DNA, 172 bp, Homo sapiens
  misc_feature 8: d=a or g or t
ttaaaatdacaaatcaaagaacttctctttagtgttgtagttgaaaaaaacttccccatgggtatgccattgtcatcataagttcagatttttaaaaactgagattatcttcttttttcattaatatcaatttcctttcagctttcctctactgacaaatcaccaggactag

SEQ ID NO: 23971 - DNA, 153 bp, Homo sapiens
tatggcttttctaatttttaattaattaatttatttttttgagacagagtcttgttctgtcgccaggctggagtgcagtggcacaatctcggctctcggctcactgcaacctctgcctcccaggttcaagcgattctcctgcctcagcctcat

SEQ ID NO: 23972 - DNA, 213 bp, Homo sapiens
taatagaaccttctaggattgtttgtattaattaagttgatatttgtaaaacccctacagtagtgcctggctcatactaagtactatgtaagtgttagctctcattattttaagctatctataaaagtattaaggctacattaagctataatttgaacacaccctaacttacatgccttaggtaaaggaaaatcacaagtttggggggattta

SEQ ID NO: 23973 - DNA, 339 bp, Homo sapiens
  misc_feature 7: m=a or c
  misc_feature 8: n=a, g, c or t
  misc_feature 9: v=a or c or g
gataacmnvaactcttcaaaagcagagatttgttcaatgaaaaataaaggagttgaaagaaaaatgagccaacaaatttccagattatgacaaaccattctggggtaggggttaggggatcctgggacagggagggcccagggtccagtcgcctttgtgaagaccagccaaggttaacatagggtaccacagctgggcaagataagaccagggtgaggcataaggtggagtcactcccctggtctcttcacatccccccgcttctttcatggggtagaaaggagacagaaggcagacaccccttgagagctgcacaagttacttaaatcagccacaccc

SEQ ID NO: 23974 - DNA, 342 bp, Homo sapiens
  misc_feature 225: r=a or g
  misc_feature 226: k=g or t
ccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattrktattctaacaatgattattagctcattcacttattttgataactaatgatcacagctattatactactttctcgttattttgtgtgcatgcctcatttccctgacttaaacctcac

SEQ ID NO: 23975 - DNA, 242 bp, Homo sapiens
  misc_feature 7: v=a or c or g
  misc_feature 190: v=a or c or g
agatctvtatgaaggaaatacaaagttaagtgaaccagatttaaaagaattttttaaaaaactgttgaataagagagtaaaagatgcccactgaagttaacaacatggaagtcattggtgaccttagccaatgccgtttcagggaagggaccctgatgggggaaggtgaggaactggagacaggcaagcvtttgaagcatggctgtgaagggaaggacaaaggacaataattggaggagggg

SEQ ID NO: 23976 - DNA, 112 bp, Homo sapiens
  misc_feature 57: n=a, g, c or t
gttctttgctgcccttggccttcacggtttattcacacaactcatgtcctgaaaggncttctctaaattggtgctgatgcctccttccagtctccttttatccacaccacat

SEQ ID NO: 23977 - DNA, 145 bp, Homo sapiens
agtgtgtgtgcatgtgtgtgtgtgtgagagagagagggagaggagcgagagggagagggagagagagaaagggagggaagcagagagtcaagtccaagggaatgagcgagagaggcagagacaggggaagaggcgtgcgagagac

SEQ ID NO: 23978 - DNA, 224 bp, Homo sapiens
  misc_feature 5: d=a or g or t
  misc_feature 7: h=a or c or t
  misc_feature 8: n=a, g, c or t
  misc_feature 9: b=c or g or t
  misc_feature 36: n=a, g, c or t
cagadahnbaagccaaatagcctggagttgtttgtnctacttgttccataacccctatgctcaagatactgaagctatctgtggtatttcatgtaacatttctaagaataagagctggcaaatgggaaacttggggtggagagagcatacttattgggctgtgaaggcatacggatgtacatgttttagagcttatctcagatttaaatagccaaaggaagact

SEQ ID NO: 23979 - DNA, 126 bp, Homo sapiens
atttggggggactgagacaggagaatcccttcaacccgggaggtggaggttgcagtaagtcaagatggcaccactgtgctccagcctgggggacagagcgagactccatctcaaaaaaaaaaagga

SEQ ID NO: 23980 - DNA, 122 bp, Homo sapiens
  misc_feature 83: r=a or g
catataacaacaatttggaataatgtgaaaaatggaggcacataatttgggtggaaaatggcgattaaaaatatatataagaraattattagccatgtgtaacatatttaaataatgaccaa

SEQ ID NO: 23981 - DNA, 147 bp, Homo sapiens
  misc_feature 7: k=g or t
  misc_feature 8: n=a, g, c or t
  misc_feature 9: n=a, g, c or t
gacttcknngcggcgccctcatggttgcgttacatggctacctagggatctgttcactgatttagagggtcccagagctctgggtcgggactgaggtgaaagagcggaaaaacgcgagaagcggtgttccttctacacagaggctga

SEQ ID NO: 23982 - DNA, 149 bp, Homo sapiens
ctgtttattttgcccataggttacatataattttcataaccactagttgaggtctgccaaacatgtaaatcagaactcataatgccttactttaagccaattattaccctatgtacctctacctcttgctatttattccttctaacgtc

SEQ ID NO: 23983 - DNA, 341 bp, Homo sapiens
tactctctccacccccagctccaggaacaacgcccaactggcctcctactcagctgacaggaatctggttggagttgttgtgtcccagccttcccaagcttccaggtgtcccagaaacccaggaaatcgagactcatgactcccagagaggatggcatctagaagactctgcagccagccatctatgcagcgccccagtggctttgaaatgcaacagaaaccatcacccccggaccgtgggctccatgccagtgggcaaagcacaggtgcgttcactgagttcccagcacatagctgtggcaggcacttggtgatatttttaaataaaagaatggaagaaa

SEQ ID NO: 23984 - DNA, 200 bp, Homo sapiens
  misc_feature 8: h=a or c or t
  misc_feature 9: n=a, g, c or t
  misc_feature 10: m=a or c
  misc_feature 49: w=a or t
  misc_feature 131: m=a or c
gctcagghnmtgtcagaatcaaggtagatgttgagattctacctcttgwtttagatgaatgatgataaactcaatttttagaatgaacagaatgattgacaagaaacggggaggagagagctccaggagcmtcctggcccctaagcaaacaccttcagcttttctcttcactgcaggagacatcacagttactgtgctct

SEQ ID NO: 23985 - DNA, 184 bp, Homo sapiens
  misc_feature 7: n=a, g, c or t
  misc_feature 8: n=a, g, c or t
  misc_feature 9: n=a, g, c or t
  misc_feature 48: h=a or c or t
  misc_feature 79: m=a or c
tagattnnngaagtgacactttgtgtgggcatgtgtgttttggtttthaggtgatgaacactttacatgatcttctgcmttccataatttctgaatgaggaatctgtagtagcttgaattttgcttcctctttatataatgtgtcacttttctccaattgctttcaaaattttgcggggtagag

SEQ ID NO: 23986 - DNA, 263 bp, Homo sapiens
  misc_feature 3: r=a or g
  misc_feature 7: b=c or g or t
  misc_feature 8: b=c or g or t
  misc_feature 9: m=a or c
  misc_feature 44: w=a or t
  misc_feature 132: w=a or t
  misc_feature 134: r=a or g
  misc_feature 180: r=a or g
aaraaabbmaaatttataataatgtcagatatttattgagtgcwccatatcttctaagtggtgtttttggcagttaaatgcagctgtaaacaagataaaaccaaatctctgtcctaaagaagcttgtatgcwartgggaggaaatgggcattacataaaatatttataaataaaaaataracaaccaactcttatagtaataaatactaggaaggctgggcgcggtggctcacacctacaatcccagcactttgggtggctct

SEQ ID NO: 23987 - DNA, 168 bp, Homo sapiens
ccaactcctgggcagatcacttgatgtcaggagtttaagaccagctggccaacatggtaaaatctaaagtctactgtctactaaaaatacaagaattagaccaggcgcggtggctcacgcctgtaatcccagcactttgggaggccaaggcaggtggatcacgaggag

SEQ ID NO: 23988 - DNA, 277 bp, Homo sapiens
  misc_feature 7: h=a or c or t
  misc_feature 8: y=c or t
ctgttahygagaataaaatttgttatttggaatccacatgcactcagaattgttgccacttgcagcgcatgtagtgtcacgtggatgtcattcatacctgttgcttctgctgcggtggctgtcactgtccctatgcagagctgtaccaagatctgcactcagaaaattttgaggaaaattgtttaatagggttggagtgatataacctttgttttcattattcatgtattctgtttttcatatcaagtaggttgatgatcctggagaagagagaact

SEQ ID NO: 23989 - DNA, 315 bp, Homo sapiens
  misc_feature 7: h=a or c or t
  misc_feature 8: n=a, g, c or t
  misc_feature 42: y=c or t
tgtatthnagaaggattctccaaacagggctcttcgtaatayctctctattagtcttttcccccataaactgctcttcagatggctcaatcttcatgtgttagtttgagggacttaggcctacagaaaacaaatgtacatttgtcaattccaaaattctaaaggcattgcactcatatgctctttctcatgctgtgcagtatgtatttcttgaaagatcgccaaagactgatttcaccctaatgctaagggcaggatttttatcccatagctgagaggggcaacacatgaataacagttaattctagtacccaga

SEQ ID NO: 23990 - DNA, 235 bp, Homo sapiens
  misc_feature 7: k=g or t
  misc_feature 8: m=a or c
  misc_feature 9: n=a, g, c or t
atattckmngaagaactctatagaaattaatttggggtcagctgaatccaagtttaaatgagcagtcccagccaagtttggttttcccctgtgactctaacttgtcctcgcttgctcaatgtccctccccgctcccgctttccctctgtagtagtcccggctgccctgggccatcgcttacctcagcactaaacagcctgaaggtgcttatcaaagctgccactccactccctca

SEQ ID NO: 23991 - DNA, 237 bp, Homo sapiens
  misc_feature 7: s=g or c
  misc_feature 8: s=g or c
aaagccssacttattttggaaacttgtagccagaaaaattagaatttaatttaagcagtagaaaataataaaaactgaaaaatgttaggcaacactagaatttaacaacaggtgtgctatggttttttaaatataattttctttttccagtttcccatttttattaaaagacaaatcatggtaggaatggtttgctttattatacttggcttaattatttgcatacagtgcagcacg

SEQ ID NO: 23992 - DNA, 181 bp, Homo sapiens
  misc_feature 7: b=c or g or t
gcttgabgcgtagggggtggcgctctccgttcggcggcgctcccatggcgcacattaccattaaccagtacctgcagcaggtgtacgaagccatcgacagcagagatggagcatcttgtgcagagttggtgtcttttaaacatcctcatgttgcaaacccacgacttcaaatggcctctcc

SEQ ID NO: 23993 - DNA, 207 bp, Homo sapiens
  misc_feature 7: n=a, g, c or t
  misc_feature 8: y=c or t
  misc_feature 93: h=a or c or t
aaaaatnytccaggaactgagggaagccacaggtattgacttggagaacatcgtttactacaaagatgacacacactatttcgttatgacaghcaaaaagcagagtttgctggacaaaggagtgatactacatgactacgccgacacagagctcctgctttcccgagaaaacgtggaccaggaggctctgctcagctatgccagagg

SEQ ID NO: 23994 - DNA, 295 bp, Homo sapiens
  misc_feature 7: n=a, g, c or t
  misc_feature 8: n=a, g, c or t
  misc_feature 9: h=a or c or t
  misc_feature 10: v=a or c or g
  misc_feature 19: d=a or g or t
  misc_feature 41: r=a or g
ggggtannhvgaaaggaadgctggtaagataaactcaagargcatcctttccattgtggctgaaccactaaataagtctgaactggcaagtgctttacgtaaatgtgctccagagtaaagaaaaagggacagtaattcattctacgttaagtaaaaaatctacacaggcacgcacatgcacttactaaatataaccagtgaaaaattgtttcaaggcttgttttgtctataagaggaggcgacaaacacccccattaacatataggaacttctttacacatgtcctcacggtcac

SEQ ID NO: 23995 - DNA, 207 bp, Homo sapiens
  misc_feature 7: y=c or t
  misc_feature 8: y=c or t
  misc_feature 130: m=a or c
  misc_feature 163: m=a or c
  misc_feature 165: m=a or c
cccaacyyagttatttattttagagatggagtctaacatggaatgggttaattttttaatgacttttttttttcctttgagacagaactctcctctcccactctagcaccaacagtcaagcccagtctgmacccccagttgaccttcacagcacctgcccctmamacctccacatcccagatacccacctgcccctcaaacctccac

SEQ ID NO: 23996 - DNA, 181 bp, Homo sapiens
  misc_feature 88: m=a or c
aaaccagtcaggcgtgaaattgttttttttttgagatggtgtctcgctctgtcacccaggctggagtgcagtggcgtgaccttggctmaccgcaacctctgcgtctctggttcaagcgattcttctgcctcagcctcccgagtagccgggactacaggcacgcaccatcacgcccagcgat

SEQ ID NO: 23997 - DNA, 210 bp, Homo sapiens
cctaagggttagcagcagtcctggccaagatagacagtgagggttccaggagtgtggggaaaggcggcaaagtgtgtgggctggaggatccagaggagtcgccgtattaatcagcacaggctcagctctgcacctgccgagtctcagtggcttttaccaacagaggtgtagttccacttacacggtatcagctgtgggattggagggctt

SEQ ID NO: 23998 - DNA, 149 bp, Homo sapiens
  misc_feature 10: m=a or c
tagtgtgaamctccaactttgtgctcaggattgctttgttttttgtggttctatacaaattttaggattttttttctatttctgtgaagaatgtcattgatattttgatggaatctgcagattgctttagatagtaagttgctcctttt

SEQ ID NO: 23999 - DNA, 142 bp, Homo sapiens
  misc_feature 15: r=a or g
cagggaatttttttraagttggagtttagttctaaattgactttacgtattactgcagttaattccttttttggctaaggatggtttgataaaccacaattggctgatattgaaaatgaaagaaacttaaaaggtgggaaaa

SEQ ID NO: 24000 - DNA, 129 bp, Homo sapiens
aaggaatcaaaataattttaaaagtgttgatcaaactgtcaatacactttctcttcttacacagaccctggtcttttttcactgaaattaactgttgtgaacctgatagtctccttgattctctgctaa

SEQ ID NO: 24001 - DNA, 88 bp, Homo sapiens
  misc_feature 7: n=a, g, c or t
  misc_feature 8: s=g or c
tctgacnstagaaacggcctaactgctttgctatgctgcttcttactgctatttaagtcactgtctggcggcaagtagccttgagtgc

SEQ ID NO: 24002 - DNA, 141 bp, Homo sapiens
  misc_feature 7: h=a or c or t
cttagghaaccttaggtagtaaggacctagctggcaagatggagggatgaagattctctggggacatgaaagctgggagcagtttcaaaaattccactgtgaagggacttggaataaatttcatggcaataaaggacccgc

SEQ ID NO: 24003 - DNA, 114 bp, Homo sapiens
  misc_feature 8: n=a, g, c or t
  misc_feature 9: n=a, g, c or t
  misc_feature 26: k=g or t
  misc_feature 27: k=g or t
agatggtnnaaagttcattaaaacakkcagtgtatcttgagaaatttaaggagtttagacttttaacatcttgtgccaagttctttaatttctcccttgagaaagtcagataag

SEQ ID NO: 24004 - DNA, 332 bp, Homo sapiens
gcagacttgtctccggccagtcgcgcgtgggtagaggccttaggcgggcgttgcgaagggttgtttgctagagttcggaccttgttacggcgcgaagttccctccttggggcgggggaaaggtaccgcacccgctacctagtgtgaatgaactgtggcgtgggctgctaagggcaggctgcggagtacccgggccgtggccatgaactcacccgtggaccctggcgctaggcaggcgttgaggaagaagccacccgagcggactcccgaggacttaaatactatttattcttatcttcatggaatggaaatattatcaaatctcaggaaacc

SEQ ID NO: 24005 - DNA, 376 bp, Homo sapiens
  misc_feature 156: k=g or t
  misc_feature 158: k=g or t
  misc_feature 195: r=a or g
  misc_feature 293: r=a or g
  misc_feature 329: r=a or g
  misc_feature 330: k=g or t
  misc_feature 332: w=a or t
  misc_feature 340: k=g or t
  misc_feature 342: k=g or t
  misc_feature 343: k=g or t
cagttagatgtgattgttaaattacagtcttgaaaaatgttatattctccccctgtgtttacaggcagaaattgatactaccttgagaagagtcacatggtattttcccaaaagagccaagataaagaaccttcaattctacataatgaggcacaktkctaatatgccttttgttctaagtggacaacatatgaragcagcagtgggatttttttttcagcttctataatccaggattatcctgaacatcagtgatatcaaagtgaatctggggtttgatctcacccagggcrtgcttggcatgttctcagcagaaaaaaccttctctrkawatctcttktkkacctgtttcctgtaaaatgggaaggaataatga

SEQ ID NO: 24006 - DNA, 148 bp, Homo sapiens
  misc_feature 18: k=g or t
  misc_feature 19: k=g or t
cttttattctattaattkktttttccttaaaatcacttttcttcttctctttttttagctgatgactactagctcccctcccctctccctggaactttctctttcactccaactttcttactacatccatcttttctgtggcgggcaa

SEQ ID NO: 24007 - DNA, 179 bp, Homo sapiens
  misc_feature 70: s=g or c
  misc_feature 156: m=a or c
  misc_feature 158: s=g or c
catacttggtggggcagggtccataggaccagtgccctggtctccctcaggagctgttccctagggctasgctggatccgtgggcatccaacctagtgctcatccatgaggaatatgcaccaaagccaaagcctggggaaacaggccctgggggcmasttgaagggaacctcttttttt

SEQ ID NO: 24008 - DNA, 175 bp, Homo sapiens
tgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccgtttctccgcatctaccaggcc

SEQ ID NO: 24009 - DNA, 95 bp, Homo sapiens
tttagagacaggatcttgccctgtcacccaggctatagtagagtggcacagtcatagctcactgcagcctcaaactcctgggctcaagggatcgc

SEQ ID NO: 24010 - DNA, 163 bp, Homo sapiens
  misc_feature 3: b=c or g or t
  misc_feature 4: y=c or t
  misc_feature 5: y=c or t
  misc_feature 6: m=a or c
cabyymgaaaaagaacactgaattaccattactcagaaacatttcaacagcacagccatgttaccaataaaatgctcaaaatttaacaagataaaaacctagtaatttcccaaagtaaatcaagttggtttagaaggaattaaagaatcaacttacacagaag

SEQ ID NO: 24011 - DNA, 151 bp, Homo sapiens
  misc_feature 4: v=a or c or g
  misc_feature 5: m=a or c
  misc_feature 6: m=a or c
  misc_feature 7: y=c or t
gtgvmmygagatcaattcagtctctcaaacatgttttatttaactcaaagtattttaagggcattaggttagtggccaacctttaaaaaatgaaattgtccagaaaggatctggcagttgggcccaaattccctcatggcagccatcagct

SEQ ID NO: 24012 - DNA, 57 bp, Homo sapiens
acccagcagcctgggagagtgcctgagaacatttaaccagaaggacaatgtgcaagt

SEQ ID NO: 24013 - DNA, 166 bp, Homo sapiens
caaaatgctaaagatcaaaatcaaaatgaaaatcttgaaagctaattgaaggaaaaagacaagcaaccaataaggctgctttttgcggtcaattgtaaggctgacaattaacttttcaatagaatctgtgtaaagcagaaaacagtagaataacaccaggacaact

SEQ ID NO: 24014 - DNA, 118 bp, Homo sapiens
aatgggatggctgggtcaaatggtatttctagttctagatccctgaggaatcgccacactgacttccacaatggttgaactagtttacagtcccaccaacagtgtaaaagtgttccgt

SEQ ID NO: 24015 - DNA, 324 bp, Homo sapiens
caataaggttagacatcttttcatgtgattattcaccattagtgtattctttcgtgaaatgcgagttcatacctttcgtacattatatacttaaaactttacattaaatacttttatgtcttaaattttttaaaattttaaaataacacatacaataacaagaacaatacagatctagagcttgggctcgaattccccataccacatcatttcttccactccacagtgacaccaacctcatcctgcttgagctctctgacccctcttattagggctacccctctctattttgcccatttttaattaaaatgttataggacactc

SEQ ID NO: 24016 - DNA, 185 bp, Homo sapiens
tagccaggtgcggtggctcatgcctgtaatcccaggactttgggcaaggcgagaggatcacctgaggtcaggagttcaagaccagcctggccaacatggcaaaaccccatctctactaaaaatacaaaaattagctgggtttggtggtggacacctgtagtcccagctacttgggaggccgccat

SEQ ID NO: 24017 - DNA, 317 bp, Homo sapiens
  misc_feature 234: h=a or c or t
  misc_feature 261: m=a or c
  misc_feature 283: h=a or c or t
  misc_feature 291: r=a or g
  misc_feature 307: n=a, g, c or t
cttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtagcccatactagagttcatggatatgttatactgaaccaggccagagcaaacagaahaagaaggttgagggcaatggacaaggmaggaataaagggagaagaggghaaacagaraacctgatgctggggncacagcatca

SEQ ID NO: 24018 - DNA, 133 bp, Homo sapiens
  misc_feature 105: k=g or t
tagggtttacattgtgttgcatcttataacttgtatagattgagctgattgaaataagattttgttccaagtattatctgatagaatacaagatgattcaaaatkatatagatatttaaagcttttctgctgt

SEQ ID NO: 24019 - DNA, 268 bp, Homo sapiens
  misc_feature 42: r=a or g
  misc_feature 43: s=g or c
catatatagcctttaacactatgcaactttgtactttgcgtrsaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccc

SEQ ID NO: 24020 - DNA, 188 bp, Homo sapiens
  misc_feature 11: r=a or g
  misc_feature 51: r=a or g
  misc_feature 64: m=a or c
  misc_feature 78: v=a or c or g
  misc_feature 173: r=a or g
tatagctctaragaaaaaataatggaggacagaaggaaagctgggagggaragactattttagmgaaaatggtcagavgactgttaagctgttacttgaaccacaaacggaagtgtagacattttatgtaaatgtgtaagttgatttttaggtatatataacagataatctarataatataaaggcct

SEQ ID NO: 24021 - DNA, 355 bp, Homo sapiens
  misc_feature 130: s=g or c
  misc_feature 295: y=c or t
gttgaccttggtggtggttccgtattctagagtctggcctgcccgtatcctgggccagaggcgatctggctcatgctaaccaaatcaccagggagtaatgcacttttattaatttacatgagaagcgaastgtcagttcaccatgttgccaggcagcttaatttcttctgtggaaaatgcacatgaaatgccagattatgaacagaaattagattggtccatgtggaattgaaacaaaaagagttggtgatcttattccttcagcaagcatattttgaacacttctctccatggygggcactgtgctaggtactggggtggcaaaggtgaaaacacacagcctctgtcttttaga

SEQ ID NO: 24022 - DNA, 217 bp, Homo sapiens
caaagcattcattctatcttcctggagttacagaaacacaaaatggtaacaggtgtgtcatatgcatccagagactacctcgaacttttctctctagaactcaagctccagacttgagatattagttaatagattgataaattgactcaggttaagtggtattatttcttagattatatagtgtcatcctacagagtaaccccattttacaggagcc

SEQ ID NO: 24023 - DNA, 121 bp, Homo sapiens
  misc_feature 69: r=a or g
ccagaagaaattagctttggttgacacaagaaaaattaacttcttatgtcccatgaactaaactctggraaaagagtatcagctagagttctgtaggatgcgttagaatatagaaagcaat

SEQ ID NO: 24024 - DNA, 381 bp, Homo sapiens
acaaattcagacatgtaaacaataatgaactcttcttactagaaaacctatcttaggttgttttaacttggaggttcattgatatctaagtttatgcttgaacaaagaattccaagttaggtcatcaagagatagggcttcctggaggacctgggagtcaggatgtggccgccaggtaaaacttgactataatatgtatgccttatgcctcctatactgtggagtctgtctttggcacttggcccagctcagcttggcctcagagaagtgggtatagtcaaggtgtgataggcctatgatccgttttcaacatcatttcctgaaccctatttcctaccacacatcattgtccagcttgctgtacattcatttcagggatgg

SEQ ID NO: 24025 - DNA, 346 bp, Homo sapiens
  misc_feature 70: b=c or g or t
  misc_feature 71: b=c or g or t
  misc_feature 149: r=a or g
tttcttgattgacccatctccctatcatcaaatgacttctagtctagaacacacttaaggtttataaacbbgtgtaataggatgcttttctagtgttactttggaggagctaattatacaacatcattgaaccattcaataaaagttargtaaaattagatcacagaagctagtagatgactgttgtattaatggtaacaatgattgttctgggtattagaagaaaatgagacccaggcaggatctaaatttgatctttgtatccttttaagaaatgaatatattattttgctgctagtagggattccacaagttttcttcattcagtattaaataaaggctgttc

SEQ ID NO: 24026 - DNA, 363 bp, Homo sapiens
  misc_feature 219: h=a or c or t
agcttcgcgtctccttctacggatatctgtggaccttatggaagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgaatahagacaagatagaactagacagcagcagcccagcctcgaaggatgaggcgtgcggcaccattcccagctaatttttgtatttttagtagagatggggtttcaccgtgttagccaggatggtctccatctccttacctcgcaatcc

SEQ ID NO: 24027 - DNA, 154 bp, Homo sapiens
ttgggtagtgaaaggttatattcaatcaattcagcagaggatcttgagcagccagagtgctgttgacactcaattacattaggaaaagagacacgatcaacataagattaaaatataagaaatatatcaaaatgagaacaatataggaggggct

SEQ ID NO: 24028 - DNA, 191 bp, Homo sapiens
  misc_feature 7: b=c or g or t
  misc_feature 8: y=c or t
aagaaabyagcaagtgaaagtgtttatttcctattttctcaaaacagttgtatttataactattaccttaaaaagcactggtttagaaaaagccataacttaaatagtgttataaaatatatatcaggtttaaacataaatttagcgaatatggtagaagggaaaaaagccttcatttttgacctcccccg

SEQ ID NO: 24029 - DNA, 158 bp, Homo sapiens
tataaaattaaaaacaatagaaaagtgcactgaatgagtcccaagagccctatccacaacatcttcctaacttttcatcttttgtaacccatttgctcaaagctcaattgaactcaagcacttcttttttcttttgccctacaggaaccgcagagttg

SEQ ID NO: 24030 - DNA, 163 bp, Homo sapiens
  misc_feature 8: v=a or c or g
  misc_feature 9: n=a, g, c or t
  misc_feature 10: n=a, g, c or t
  misc_feature 14: s=g or c
  misc_feature 48: r=a or g
ctacaggvnntgascaccatacccagctaatttaaaaataattatagrgcataagatcttgccatattgcccaggctggtcttgaactcctggcctcaagcaatccacctgccttggcctcccgaagtgttgagattacaggcatgaaccaccatgcccagcc

SEQ ID NO: 24031 - DNA, 158 bp, Homo sapiens
  misc_feature 7: n=a, g, c or t
  misc_feature 8: m=a or c
cttatcnmatttgcattttattaagcaatacgaggattctctccaccacatagaatctgcagttttgaagaggcaaagggtttggataggatcaatgagagaatgccacctcggaaagatgctgtacagcaagatggtttcaattctctgaacaccgc

SEQ ID NO: 24032 - DNA, 336 bp, Homo sapiens
  misc_feature 7: m=a or c
  misc_feature 8: n=a, g, c or t
  misc_feature 9: n=a, g, c or t
  misc_feature 112: n=a, g, c or t
tacttamnnattagacatttgatagttgggatatgttatagtactttgaaacaaattctgtaatagtattcagaattgagatgtttagcacacactgcgtcagttatgttanatggtggggatggggtgtggcaggcagtagtggaatgtagaatgctgctgtatgctgtgtaatgtaagcatctccgttcctagtggagaagttgcatcgtgttctcaagaagcacagagggagacatttggtaaagtaccaagtagttgaatgaaatacagtacatagcagataaaatttgtatatactaacaaatcagtagctatatttgatatcctgggttg

SEQ ID NO: 24033 - DNA, 295 bp, Homo sapiens
  misc_feature 36: w=a or t
  misc_feature 152: w=a or t
  misc_feature 153: y=c or t
  misc_feature 154: b=c or g or t
  misc_feature 212: m=a or c
  misc_feature 244: m=a or c
  misc_feature 249: w=a or t
  misc_feature 276: y=c or t
cttaattctatcatttctgtcatttataggtctgtwtcagttgatcaatttttcttctgaagtgggtcacattttcttccttcttggcatgtctagtaatttttgactaatgttggacgttttgatctttacattgtatcatactgattttwybttcttttgagatggggtcttgctctttcccccaggctggagtgaattggtgcaatctmggcccactgcaacctttacctcctaggctcamgcgawcctcccacctcagcttctcaagtagcyaggactacaactccatcct

SEQ ID NO: 24034 - DNA, 324 bp, Homo sapiens
  misc_feature 291: m=a or c
ttacgtggttgctttatagtgtcagtggtctgtgtacttcagcatgtttttgtagtggctggtaatgatctttcctttccatatttagttcttcctttaggaactcttgtaaggcaggtctggtgctaacgatttccctcagcatttgcttgtctgaaaaagctctcatttcttttttgtttatgaagcttggtttggccagatatgaaattctggattggaatttcttttctttaagaattttgaatattagcccccagtctcttctggcttgtagggtttccactgagmggactgctggcagtccaatgggcttccctttgt

SEQ ID NO: 24035 - DNA, 138 bp, Homo sapiens
  misc_feature 4: m=a or c
  misc_feature 16: m=a or c
  misc_feature 17: s=g or c
  misc_feature 119: m=a or c
ccamtatttgtgtgtmsctatgcaccttaatagaccatagctaattagatgaggaacggtagacccaattcaaccatacaggcatcaaccatatcagcatacaggcatccctctcccamcgtttccttcttgtcgccc

SEQ ID NO: 24036 - DNA, 212 bp, Homo sapiens
  misc_feature 58: s=g or c
  misc_feature 59: s=g or c
  misc_feature 99: d=a or g or t
  misc_feature 100: h=a or c or t
  misc_feature 135: v=a or c or g
  misc_feature 136: m=a or c
aagttttctatcttctaacccttggaggaaaatctgcgctccagcagctgggaccgasscatgagagcgttgaatcatgagtggcaccgttcgcaaaadhctggtgtctttgtacaaagacagtgccacaacacvmctcagtgaccatcgggagagcagcctcatgatgggcgatgctccatcagttttctcttgcgatcttttgcatagat

SEQ ID NO: 24037 - DNA, 101 bp, Homo sapiens
aatagaggtaatactaccagtctctttggttctgttgattaaatgagtgtgtgacactatcatttattaatcaatacatgtaaattctcttgcctaatttt

SEQ ID NO: 24038 - DNA, 257 bp, Homo sapiens
ttgcctttttttcaattgcttcctatctgtgcaggtgtatcttacaggaacatacagaaatggtatgctgagagaggagtttgaatgatcttctaggcattgttcactcttgacacttaagttgaagtattaaatattccaacctgtctttgataaggatataggacttactttagaagatacaacctgattattaaattggtcatttctagacattgattctacaagaagacctcagttaagtctcacaccaccca

SEQ ID NO: 24039 - DNA, 255 bp, Homo sapiens
  misc_feature 22: m=a or c
  misc_feature 66: w=a or t
  misc_feature 109: n=a, g, c or t
  misc_feature 110: w=a or t
  misc_feature 128: h=a or c or t
  misc_feature 218: w=a or t
  misc_feature 223: w=a or t
tagtatttctgcccaaagaagmgctgctttaacatttaaaatccaggatttttattggggactggwcatgtaggcattctgcctgtgtagctagccacagctaccaaanwtccaggctctcagaagghaagtgtttactgtatgtaatcacattgtttacaaacaatctcagcaagctggtatagcagaattccagaatcgtgtgaaattttcatggwtttawgaaatcattctctgagtcattaaaatgtatgc

SEQ ID NO: 24040 - DNA, 351 bp, Homo sapiens
  misc_feature 254: m=a or c
  misc_feature 320: m=a or c
gattgagaggtgagagataattgatggttattgattggtagataattgattgacaggttgataaatattgatagctagatgatagataaatagatcattggtagatatgtgatatattgataaagaaattcagaggcaaaaggagagagaaatgaaggggatatcggagggggaaaaatttttttaaaccgagagtgaaacaaggagacagaagaaaagaaagtggtgaaaagaggaaaagaactgagggagamattaaatgaaacaatgaagggagacagaggaagcataaaggcctctggctttggccatattctcamccctgtggtctcctctccctggacggctgac

SEQ ID NO: 24041 - DNA, 246 bp, Homo sapiens
taggaaaaaaagaagaagcttatgagtttgttcgtaaaggacttcgtaatgatgtcaagagtcatgtctgttggcatgtatatggactcttgcagcgttctgataaaaaatatgatgaagctataaaatgttaccgaaatgccctcaaattagataaagataacctgcaaattttgagggatctctcactgttgcagatccaaatgagagaccttgaaggttaccgagagacaagataccagctcc

SEQ ID NO: 24042 - DNA, 310 bp, Homo sapiens
  misc_feature 11: m=a or c
  misc_feature 96: r=a or g
  misc_feature 204: r=a or g
  misc_feature 206: w=a or t
  misc_feature 217: m=a or c
  misc_feature 218: k=g or t
  misc_feature 225: m=a or c
  misc_feature 241: w=a or t
  misc_feature 276: m=a or c
  misc_feature 306: s=g or c
ttagtaactgmattttgaggacatttctctgtttagcattatgcaaactgatatgtaatctgaggttccaaagtcaatttttttcttttttttttragatggagtcttactctgtcacccaggctggagtgcagtagcacgatcttggcttactgcaacctctacctcctaggttcaagcaattgtcctgtctcagcctcccgrgwactgggactamkgtcttgmgccaccatgcctggcwaatttttgtatatttagtaaagatgggttttcgcmatgttggccaggctggtctcaaactcctascccc

SEQ ID NO: 24043 - DNA, 314 bp, Homo sapiens
  misc_feature 162: m=a or c
aagtctatcaaaggtcttgtttattcggaacactttgtatactattatgggaagatatgggagggggaatcttttctcagttttgctggtttttaaaaatctagatcaatgagccaacatctttgaagaaaataatttatattatttttgccaccctcttgmaacaattattcttctgacttttaaaatggtgcaattctattgtgacataccatttttccttctggtaacttatagtagagatcatcaaaaactacttttatcactaagtcctgtgtctctaaatacaaaggatgatgaaactgtagctttaa

SEQ ID NO: 24044 - DNA, 171 bp, Homo sapiens
  misc_feature 140: w=a or t
  misc_feature 141: w=a or t
  misc_feature 150: w=a or t
agaattgccttttataggcaggttgatagttcacagctggaagggggctcactgcggctctgcaaggaaagatgcgctacccacccttttctctctttctctttctttttctctttttctttctttctttctttctttcwwtttgtttcwtcctttcttcctttctttctt

SEQ ID NO: 24045 - DNA, 193 bp, Homo sapiens
tcgtggtccaatctctgcatagaaatcaggaaatgaaccagaagattccgttttcaggttgaagccagacactgaggggcttgactaagctcctcttgcttacaataaaatggagcattttttaaattataaagagcaagattttgctttctgagattagcgtcgatccttcatcagtgttgatgcagccaaa

SEQ ID NO: 24046 - DNA, 295 bp, Homo sapiens
tttttcgaatcgtggcttttggccaggtgcgtggctcatgctgggattacaggcgtgggccactgcgcccggccctcttttatttcttatacaaagcccagttcctaacacataggaagtgattgataaacttgttgaaagaatgagggacagttttcctctctagctttcatgttgcttgtctgagaataaaggaatcagaacaagatgcctgaagttcctgccaactctaaaatactcttttccagtatgcattaagtaaatattagttaagtaaataagcaatacccaccaa

SEQ ID NO: 24047 - DNA, 245 bp, Homo sapiens
  misc_feature 40: y=c or t
acaatacactgtaatttccaaatgtgtttcccagcctagyacctctcttccaaactctggacttacatatccgcctgccctttcagcatctccatgtggctgtctgatagcatcttggaatctatcttgatttctccagctctgtcccctcattcactcaatttatcaacaagtcctatctgcccttcttccaaaactgatcttgaatccaattactccttttcatcaccactgcccccacctct

SEQ ID NO: 24048 - DNA, 327 bp, Homo sapiens
  misc_feature 13: m=a or c
  misc_feature 111: w=a or t
cacctgggaaggmaacaaattacgtactagagggcattgattggttaaaaacttgtgtatcccgggaaggacctgcggtacaggagtcagccatgtctgtgctgtgtggawccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccact

SEQ ID NO: 24049 - DNA, 314 bp, Homo sapiens
  misc_feature 147: w=a or t
  misc_feature 154: m=a or c
  misc_feature 172: w=a or t
  misc_feature 173: r=a or g
  misc_feature 175: m=a or c
  misc_feature 184: m=a or c
  misc_feature 188: v=a or c or g
  misc_feature 243: m=a or c
  misc_feature 244: m=a or c
agtccctctgtacatacagtccttcagatatttatttgcacccagaacagggcctagcgcagggtaggcacaaatgtttgttgaataaatgaatgactagggagctaccaccattgatattcagtaaatagttacataaggaaaggwcttagamtgtcaatattttgtctgwrgmaaacaatcmtaavtgtacccagtaaccaggttttctagaacacatttatttggaggctaaaggtacammtttgaccttgaacaacatgggtttggacttgtggttccatttatacacagattttttttcagtaaatata

SEQ ID NO: 24050 - DNA, 266 bp, Homo sapiens
  misc_feature 98: y=c or t
  misc_feature 113: m=a or c
  misc_feature 140: m=a or c
  misc_feature 230: m=a or c
  misc_feature 235: m=a or c
agcatttcttccttctgcgtatgggacaggaccctttctggaatgggggtcttatgacctacaatcaaacaagtatctaacatccaattaaaagaggyagtcatggctcaatmctcaagaaagaaacatgattatatggmgtatttgccttatgtggacacagtatgcattttggaaggaaaagtcagtcttctgggaaagtgtggaaaatccaaattggacagaactcmttgamaaaggcaagatttcagtcactggagctgtat

SEQ ID NO: 24051 - DNA, 183 bp, Homo sapiens
caaagacagttcactctggtgtgctgtaggattggaaagggagtggtaccagatgaaaatgaaaccctaaagaagactgctgggccatgagttgcttccttctcctccaccttaaccctctgattccagaattgcagtcattttcttctgccaaggaaatccattaaaaactgcagccacacc

SEQ ID NO: 24052 - DNA, 67 bp, Homo sapiens
atcgaaaattttggaatattaaaaatatatttttagaatagctaattcaaatgtttagttttttttt

SEQ ID NO: 24053 - DNA, 141 bp, Homo sapiens
ttcattttattttcttttagagaaaccaccttatctatttttagacatttcgaattcctaaaatgtgaaccgttgggtgatctgtcctttggccctaaaacggctggccgggctgtcccggcctgttctcatctgtaccgc

SEQ ID NO: 24054 - DNA, 304 bp, Homo sapiens
  misc_feature 131: m=a or c
  misc_feature 150: r=a or g
  misc_feature 190: m=a or c
  misc_feature 219: v=a or c or g
  misc_feature 258: r=a or g
  misc_feature 277: n=a, g, c or t
  misc_feature 278: s=g or c
gcctgcgtcggggagggggcggtgcgctaggtcaagctagggcgcgggagcagcggagtcctggttgagtgaccatccaaggaatatgtcctcgcgcgcggccgccgttttccttttcggaatgtgggtamagaatttaccgctaacagrcgacctccaggttcgctcttggacagcaagattgagagamaaaacttaacaaagcgctgtgcaaactgvaatcccaggcttagctcgcttgtgtcttgaacacggaartcacctagtcatcccacansatgtatgagtacagctaacccccaga

SEQ ID NO: 24055 - DNA, 248 bp, Homo sapiens
  misc_feature 167: m=a or c
  misc_feature 201: m=a or c
  misc_feature 209: m=a or c
  misc_feature 211: m=a or c
  misc_feature 233: m=a or c
ctttcttagggttttgtcttttgttcactcccattccctcttttgtcactgctgctgttaccattgtcagcagcaggattgcctgaagtccagcgggtattacacaatggcctcgttatggagatggagcatccaactgtggggaagatttccgtcccaggcccagmtgtgagatacagtaagttcaagatgtcagaggcmaggccgcmcmccctgctcgggcagcacacaamgcacatcctgaagga

SEQ ID NO: 24056 - DNA, 154 bp, Homo sapiens
catttgttaaattgaatctgagattcaaatatttcatttaatattttctgggttttgataatgggatattctgtaagataaagcaagtaatcctagagtgatttactttatgtttagccatccaccattttcctatttctctactccccccgcg

SEQ ID NO: 24057 - DNA, 131 bp, Homo sapiens
  misc_feature 10: r=a or g
  misc_feature 52: w=a or t
attaataagratattttaacaatatttagaacactaaaattccactactcawaataatttgtacttcttatagtagtttgagaacctacattttatgcttaatttagtatttacttctagtcttttttttt

SEQ ID NO: 24058 - DNA, 263 bp, Homo sapiens
  misc_feature 69: k=g or t
  misc_feature 88: r=a or g
  misc_feature 96: k=g or t
  misc_feature 188: r=a or g
  misc_feature 211: k=g or t
cggagattgttgctttttaatgtagtcttatgtatatttagattgggttcttcagtattcacttattakatgataatttggcagatgrcacatttkgttaccaatatttccaagctgaaagcgcgtttctgtaaaagacaggagctagatgttactagtagcttaaaagagctgttggaggagcctgraggaagtgactcataagggagakaagcagtgggggcagctgcaggaaccttcaaaacaaaacctgcagccctgtt

SEQ ID NO: 24059 - DNA, 206 bp, Homo sapiens
  misc_feature 84: s=g or c
  misc_feature 174: r=a or g
  misc_feature 190: m=a or c
  misc_feature 204: h=a or c or t
  misc_feature 205: m=a or c
tgaaaccccgtctctactaaaaatacaaaaattaggcaggcatggtggtgcatgcctgtaatcccagctactcgggaggctgasgcaggagaatcacttgaaccgggaaggcagaggttgcagtgagccaagatcatgccactgcactccagcctgggtgacaaagaagtgagrctgtctcgaaaaagamaaaaaaaaaatcchmc

SEQ ID NO: 24060 - DNA, 165 bp, Homo sapiens
  misc_feature 4: m=a or c
  misc_feature 9: m=a or c
  misc_feature 12: r=a or g
  misc_feature 17: k=g or t
  misc_feature 22: k=g or t
  misc_feature 23: d=a or g or t
  misc_feature 35: r=a or g
  misc_feature 47: m=a or c
  misc_feature 55: s=g or c
  misc_feature 59: m=a or c
  misc_feature 90: r=a or g
  misc_feature 99: s=g or c
  misc_feature 107: m=a or c
  misc_feature 124: d=a or g or t
  misc_feature 125: s=g or c
  misc_feature 132: m=a or c
  misc_feature 150: s=g or c
ccamcaggmccrgcaakcgctkdacccgagcccarctgataaccgamtcccccgsgtcmacgtcctcggtcacctctattaactcgcggrttcccgacstgcccagmgaatccggatctcctgdstatgtcmaccaagtcaaagtgcgastctccgacgccccca

SEQ ID NO: 24061 - DNA, 181 bp, Homo sapiens
  misc_feature 77: s=g or c
  misc_feature 109: m=a or c
  misc_feature 150: r=a or g
  misc_feature 158: r=a or g
  misc_feature 159: v=a or c or g
  misc_feature 170: m=a or c
  misc_feature 171: m=a or c
ataagggcattaataaccaaaagatagggtgggcgcagtggcttacgcctgtattcccagcactttgggaggctgasgtgggcagatcacgaggtcaggagttcgggamcagcctggccaacatggtggaaacctgtctctactaagatrcaaagcarvaccaaaatgammaccacacaaa

SEQ ID NO: 24062 - DNA, 349 bp, Homo sapiens
  misc_feature 73: y=c or t
  misc_feature 289: k=g or t
  misc_feature 290: k=g or t
  misc_feature 291: m=a or c
  misc_feature 317: n=a, g, c or t
ccattctcctgcctcagcctcccaagtagctgggactacagacgcccgccaccatgcctggttaatttttttytatttttagtagcgacggggcttcaccgtgttcgccaggatggtctcgatctcctgacctcgtgatccacccgcctcagcctcccacagtgctgggattgcaggcgtgagcactgtgccggccacccattttaaagtggacagttgagtggcactctgcacactcacattactgtgcagccatcactgccatccgcctccagaactctttccatckkmccaaactgaaattctgtactcattanacactaactccacattccctcttcccctcagc

SEQ ID NO: 24063 - DNA, 200 bp, Homo sapiens
  misc_feature 30: v=a or c or g
  misc_feature 31: y=c or t
  misc_feature 82: m=a or c
  misc_feature 104: s=g or c
  misc_feature 106: k=g or t
  misc_feature 107: k=g or t
  misc_feature 169: m=a or c
  misc_feature 170: m=a or c
  misc_feature 181: v=a or c or g
  misc_feature 200: r=a or g
acaaggagaagtcctacaaagccacggtcvycgaggggaagcagtacgacagcattttgagggtggaggccgtggatgccgmctgctcccctcagttcagccasakktgcagctacgaaatcatcactccagacgtgccctttactgttgacaaagatggttatataammaacacagagavattaaactacgggaatgtr

SEQ ID NO: 24064 - DNA, 150 bp, Homo sapiens
  misc_feature 37: v=a or c or g
  misc_feature 96: s=g or c
  misc_feature 97: m=a or c
  misc_feature 113: r=a or g
  misc_feature 126: v=a or c or g
acttttcacatgggtttttctccaagttaatacagavatatgtaaactgagagatgcaaatgtaatatttttaacagttcatgaagttgttattasmataactaaccataaarcttaattactttvatattatataattatagtagtggc

SEQ ID NO: 24065 - DNA, 348 bp, Homo sapiens
  misc_feature 122: r=a or g
  misc_feature 276: r=a or g
  misc_feature 316: r=a or g
tgtcattgaatagccagagagatagttgggaaatgagcagcatagcatgatgccagattgaagggagtcttaaagaggaaggagtcagcagtgaatagatactgcagagatcaagaaagagracttaaagatgtcttttggagataacaggagagttttgatgacttggtcaatagtagtttgttgtaatggtggcaagggaagccaggaggtagtgagacattgaatttagattgctttttaaagctttgagtagcagagagggtgaaagctagrgaatttagttttgaggaaggatttatcttggggttgaaaraaaatccttcctcacaacatggtgctacttct

SEQ ID NO: 24066 - DNA, 65 bp, Homo sapiens
  misc_feature 18: r=a or g
  misc_feature 40: s=g or c
taacattttttttttttragacagagtttcactcttgttscccaggcaggagtgcagtggtgtga

SEQ ID NO: 24067 - DNA, 264 bp, Homo sapiens
  misc_feature 90: r=a or g
  misc_feature 96: v=a or c or g
  misc_feature 100: d=a or g or t
  misc_feature 101: r=a or g
  misc_feature 122: k=g or t
  misc_feature 178: k=g or t
  misc_feature 222: r=a or g
aaaaaggaaagtaaagcagagttatggaataaccatggagtatggtggttattttaaatatgatggttaggaaatcccgccttatgagaraatgavattdractacagatctgaacattgakaaaggagcctgtcacattgacatttggaggaaagagtattccaggaagagggaatkagcaaggtggctggaatttcatgaatgaggagtgttagaaaatragattggaatcagtcaggggccagataatatacgccatggta

SEQ ID NO: 24068 - DNA, 219 bp, Homo sapiens
  misc_feature 172: k=g or t
ctgttgtcataggcttgagctgagtttatctgtttttcttcctgaagggtctagaaactccagcagagctggtatagtgttctaaatgatcacttggaagaccagaggggcaaagcctctaccatgtagctgcttctagccaagttgaattccagagtagctacatacagckgtgtgggaggccatgctctgcaaatggatatagttagctcaagaatt

SEQ ID NO: 24069 - DNA, 338 bp, Homo sapiens
  misc_feature 72: r=a or g
  misc_feature 73: r=a or g
  misc_feature 88: r=a or g
  misc_feature 96: v=a or c or g
  misc_feature 172: w=a or t
  misc_feature 253: r=a or g
  misc_feature 301: r=a or g
  misc_feature 306: v=a or c or g
ggatagagccagagattctttgaatagaaagtaaaactattaaacttacacagtagctttttaaaaatgtarrtgccagttttatgarataaatavataaatggttgtcaggatttaaacaatctttatttggagggccctaattcactaacttctcatgtttactctgcgwtctttcagagatgtctaaaataggaagatcgttagaaacagtggaagggtgccatgataacagcataagcagggcctataraatcacagaaatggggcaaccaaccatggaggtatcagtctagagagrcatavagcaatgtcatatattccatcattattcagta

SEQ ID NO: 24070 - DNA, 318 bp, Homo sapiens
  misc_feature 226: r=a or g
ctctcaaactctaaattctataactgcagggctaaattatctgactcccgtacatctttggttgactctggaaaatgccaccaatgaggcactccatttcatttttggttggattttacacatacagtgcgtgtgtgtgtgtgtgtgtcaccagataagggtctgtgaaaacagaagaagaattacagaaaccagtggtggggcgatgacactgttctagacccaratgtcaacctgtgtggtttcttcccaagagtgctctgcagtttcaaggcaggtcctgcagagttgttggtgcaggaagccttccccaccaac

SEQ ID NO: 24071 - DNA, 263 bp, Homo sapiens
  misc_feature 36: k=g or t
  misc_feature 43: k=g or t
  misc_feature 98: m=a or c
  misc_feature 116: v=a or c or g
  misc_feature 136: r=a or g
  misc_feature 194: r=a or g
  misc_feature 227: k=g or t
tggaaaatgagttggctatgtgtggatttctgtgtkctctatkttgcattatctcttaatacagagaacaactttatgagattgggaatcatgatcamctccattttacagtttgvaaaaagctgaggcacaaagrggttaagttacttgcccaaggttacaagactggtaagtagcagagttaaaatggagarcaaggcagtctaggtctaggagtccatgctttkaactccttcattaccaaccaactctggaagtctgta

SEQ ID NO: 24072 - DNA, 308 bp, Homo sapiens
  misc_feature 304: n=a, g, c or t
tcatctcactcctgggcatctacccaaagggaaccattgtataaaaaagacacctgggctggtgtcttgggaagccaaggtgggcagatcacctgaggtcgggagctcgagacgagcctgaccaacatggagaaacccggtctctactaaaaatacaaaattagccgggcgtggtggcgcatgcttgtaatcccagctactcaggaggctgaggtatgagaactgtttgaaccctggaggtgaggttgtggtgagccgagactgtgccattgcactccagcctgggaaacaagagtcaaactcnctca

SEQ ID NO: 24073 - DNA, 359 bp, Homo sapiens
  misc_feature 335: m=a or c
tgagcatataacagacttgcttcagtgattatgaattagtttagtttctattaaaaaaaattaacttaaggctggccacggtggttcatgcctataatcccagcacttggggaggccaaggcgggtggatcacctgaggtcaggagtttgagaccagcctggccaacacagtaaaaccccatctctactgaaaatacagaaattagccgggcgtggtgctgggcacctgtaatctcagctactcgggaggctgaagcaggagaaatgctggaacccaggaggcggaggtggcagtgagccgagattgtgccattgcactccatccagcccagggmgacaacagtgagactccatcatca

SEQ ID NO: 24074 - DNA, 207 bp, Homo sapiens
aagagcccagaagttgcaagctgggaataagcgagatctgaaagacccccaagaggagcttgtttgggagtgggggcagacggcgttttgcgcccaactgatggttctgtgaagggaaagaactgcacaacactcctgatattcaaatccactgtgagggaggggacctccataccctgatcatagcagaggcctttgaggacaaca

SEQ ID NO: 24075 - DNA, 139 bp, Homo sapiens
ttttttaaagaaagtttattgctttctttaacctgcattttttctaagttttttttcacataaaggtgctgtctttgtggcaaggcctaggcatgacaatcggaggactcgagggggatggaggactagtgatcggctg

SEQ ID NO: 24076 - DNA, 346 bp, Homo sapiens
  misc_feature 96: s=g or c
  misc_feature 99: s=g or c
  misc_feature 101: v=a or c or g
  misc_feature 116: s=g or c
  misc_feature 118: m=a or c
  misc_feature 263: s=g or c
  misc_feature 264: n=a, g, c or t
  misc_feature 278: r=a or g
  misc_feature 294: m=a or c
  misc_feature 298: n=a, g, c or t
  misc_feature 300: r=a or g
aggcactccctgggctaaacagcatcaccatgtctgttcgatacagctcaagcaagcactactcttcctcccgcagtggaggaggaggaggaggasgasgvtgtggaaggaggagsamggagtgtcatccctaagaatttctagcagcaaaggctcccttggtggaggatttagctcaggggggttcagtggtggctcttttagccgtgggagctctggtgggggctgctttgggggctcatcaggtggctatggaggattasnaggttttggtggargtagctttcgtggaamgctntrgagtagcagctttggtgggagtcatggaggcagcttggagggggca

SEQ ID NO: 24077 - DNA, 226 bp, Homo sapiens
ttttcattctagtaaggttgttcaaattctaatagtttatgcattttctgtttttttaatgtgcaaaagttatataacattaaagaaatatttaagaagaaaaataaattttcccagatcataccaccctaatagaattatttcattgttgtgtatgttcttagaatctttccattttcaggactcgtattcaatcagattgcactagtacactttcaccaggcgg

SEQ ID NO: 24078 - DNA, 229 bp, Homo sapiens
ttggtttactatatcattagtgctaatatagtgtggggcactcagatgttcagtaaatatacattcaacaaataagtgagtgattatactcaactcccccccacccaatgcccagcaccaagcctacccagcacatagtaggtactttaagtaatttgaatgaataattttaaataacttgaatgaataattctgtattgccccccactcgccgcctatacacacgcac

SEQ ID NO: 24079 - DNA, 300 bp, Homo sapiens
  misc_feature 100: r=a or g
gcttgagcccaggaggcgaggctgcagtgagccgagattgcacctctgcactccagcctgggtaacacagacttcctcctctcaaacaacaacaacaaaraagacaaggagtgaaacaggaagctccaaagcaggaaaggcaggaaggggagatgaccaaagatgaaggaggaaggagcaaaaggctggaaggggtgccgggaggaaggagggagcaatgctttggggagagatagcaggactgcagggtgagggaccatggacgaccaccttagagagccagattatagggtaggacgg

SEQ ID NO: 24080 - DNA, 155 bp, Homo sapiens
agggagttacctgccttctatcctcatggaagcaggaaaacttgccttcctgttggaagcaagtaaaactcaaaaacaggatgagttgtatagaaaaaataaactttacatctcgaccaaattttggaagatcagggatttctggagggggtgct

SEQ ID NO: 24081 - DNA, 241 bp, Homo sapiens
aaacgaaggcaggatacagggcaccagtgcagatgggtaggtagataatggaatgggaataattgaaagttctcttctgattgctttcatttttcccgggcaaaataatatgcacacttatctggtgagagtgaggctgttggaaataagaggccattggaaggtagcattgagtgtttgagaagaaaagaggtctgaaatagttttttggagctctgtgaataaactaggtgaaaggagc

SEQ ID NO: 24082 - DNA, 318 bp, Homo sapiens
  misc_feature 110: m=a or c
  misc_feature 264: y=c or t
  misc_feature 268: m=a or c
  misc_feature 301: k=g or t
ttactttgaagataggaatatctaaattatatctctagggagaaaatgttgtaaaaaattaaaagtacatccctgattgtaaaataaagttcaaaaaactgatttcagamagtctcaactaccaaatgttttcaatatattagttttgagatgctaggattatactgtgattcttatgtttatagtaaagtctggaaagcagaaggatagtttttttagcctggaaacttatttatgttgccttggtgagtcttctatcatttyttamaaatttagcttattgaactgtaaaatagctttkctagtatgagagatgga

SEQ ID NO: 24083 - DNA, 201 bp, Homo sapiens
  misc_feature 17: n=a, g, c or t
  misc_feature 32: s=g or c
  misc_feature 33: m=a or c
  misc_feature 85: r=a or g
tttatttatttattttnagatggggttatgasmctggctaatttttgtatttttggtagagacggggttttaccgtgttgtccargctggtctcgaactcctggactcaagtgatccacctgcttccacctcccaaagtcttgggattacaggcgtgagtcaccgtgcccggctgggaatcctctttttatcacagaaggc

SEQ ID NO: 24084 - DNA, 273 bp, Homo sapiens
  misc_feature 79: r=a or g
  misc_feature 89: r=a or g
  misc_feature 90: m=a or c
  misc_feature 93: k=g or t
  misc_feature 135: k=g or t
  misc_feature 179: n=a, g, c or t
  misc_feature 180: n=a, g, c or t
  misc_feature 225: m=a or c
caggaagtgaggtttatcatgagtagcatttattaagcatctgctagaatcaaagcactgcattagctactaaggtacraagtaagacrmagkttaataaggaagacagggcatctacccaagtcaacagttcaktgacatctgttatttgaaccacacaccaatgcaaccgaagtagnntgctgaaagggtgagaagaaggaatagattactatgcatttttgmgaggatgaagaaggcttcttggagaaggtttctgaaaagagatacgga

SEQ ID NO: 24085 - DNA, 166 bp, Homo sapiens
  misc_feature 95: r=a or g
gggaggcccgggggctgagcgcggcggctgggactgagccagggagaaagaggagaaaaatccagcgaacccaacgacctggctctgcaagagaraaacaacctgaataagccggtaattgtgaacaggccgctcgctgagaccttaacgtcccctaagcccccac

SEQ ID NO: 24086 - DNA, 116 bp, Homo sapiens
atgatgttcctctagacctatttcacatatggagcagctttttatgacctccagctttttgtaagtgcctcactaacagctcatggtgtaaggtgaccatctcctggaacccccct

SEQ ID NO: 24087 - DNA, 243 bp, Homo sapiens
  misc_feature 105: r=a or g
  misc_feature 117: s=g or c
ctaggaataaaaagaaattaaagaccctcgaggggctcaaagcctggacagggagataggctgttaagccatttaaaacctgggtgtgttgagtgctaggctggragacatgcatascaagaaggctggtctgtgggggtagataatgcctctgttgactcttaggatgaattagaggcacaagggtgagagcctggtgtgttcggcaaacaataatcagtgaggggttgacagcgagggaag

SEQ ID NO: 24088 - DNA, 366 bp, Homo sapiens
  misc_feature 115: w=a or t
  misc_feature 121: r=a or g
  misc_feature 167: b=c or g or t
  misc_feature 168: y=c or t
  misc_feature 174: v=a or c or g
  misc_feature 309: n=a, g, c or t
  misc_feature 334: s=g or c
cttttttgagacggaatctcgctctgtcacccaggctggaatgcaatggcacgatctcaactcactggcaacctccgccacccggcttcaagtgattcttctgcctgagtctgcwgagtarctgagatgacagatatccgccatcacactggctaatttttgtattbytagtavagatggggtttcaccatcttggccaggctggttttgaactgttgacctcacggtgatctgcctgcctcagtctcccatagtactgggattacaggtgtgagccactgcacccagcctgagtcccctttttaactnggagagtcccctttcctgggagtascagtcctcctccattccagacacaggtggttc

SEQ ID NO: 24089 - DNA, 269 bp, Homo sapiens
  misc_feature 100: s=g or c
  misc_feature 170: r=a or g
  misc_feature 208: m=a or c
ctaaaaatacaaaaagttagcccgtgtggcagcgggtgcctgtagtcccagctactcaggaggctgaggcaggagaatggcatgaacccgggaggcggasttgcggtgagtcgagatcgtgccactgcgctccagcctgggcgacggagctagactctgtctcaaaaacraacaaaatttcatagtttgatcccatgggaaatctgamaaaatgggaggctgctcagaagctcgtcataacaatatcccctcttatatagatagcctcc

SEQ ID NO: 24090 - DNA, 276 bp, Homo sapiens
atatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagccca

SEQ ID NO: 24091 - DNA, 373 bp, Homo sapiens
  misc_feature 78: k=g or t
  misc_feature 91: k=g or t
  misc_feature 95: r=a or g
  misc_feature 100: r=a or g
  misc_feature 102: r=a or g
  misc_feature 104: s=g or c
  misc_feature 124: w=a or t
  misc_feature 128: k=g or t
  misc_feature 177: w=a or t
  misc_feature 178: d=a or g or t
  misc_feature 179: w=a or t
  misc_feature 190: r=a or g
  misc_feature 274: r=a or g
  misc_feature 275: m=a or c
  misc_feature 321: r=a or g
  misc_feature 322: r=a or g
  misc_feature 323: m=a or c
  misc_feature 324: r=a or g
  misc_feature 340: r=a or g
  misc_feature 347: k=g or t
  misc_feature 369: w=a or t
gtgtcctctgcaaacagggacaatggaaaggctgttatatggaatgtctgtaaattctaatacttgaagtggacccakgagtggtaggtckcatrattararasattcagacaatcactatctwtgtktttccctctagtggtgcctgtggagaggtaaagctggctttcgagaggwdwacatgtaagaragtagccataaagatcatcagcaaaaggaagtttgctattggttcagcaagagaggcagacccagctctcaatgttgaaacagrmatagaaattttgaaaacctaaatcatccttgcatcatcaagattarrmrcttttttgaagcagargattatkatattgttttggaattgatggwaggg

SEQ ID NO: 24092 - DNA, 121 bp, Homo sapiens
aaaatttgggggtggaagaggcttctgcgttgttccttacccgcaacgatgaccatggctttgccttctttaaaattgaggcctccaactctgacgctgactggagaattgaaaccagaac

SEQ ID NO: 24093 - DNA, 144 bp, Homo sapiens
tctcattataaaaatagtcaacaaagtagaagggaatttcctcaatatgataaagggcatctatgaaaaatttacagctaacatcatacttaaaggtgcaagactgaatgctttctccttaagatgaggaacaagaccaagact

SEQ ID NO: 24094 - DNA, 58 bp, Homo sapiens
gaagacagactcaatacatgggttgtattcaatgaaaaaaataaagagttgtgtgcct

SEQ ID NO: 24095 - DNA, 73 bp, Homo sapiens
  misc_feature 15: h=a or c or t
  misc_feature 17: m=a or c
  misc_feature 40: s=g or c
  misc_feature 41: k=g or t
caaatcccttataahamgttacatagtataacctatggaskcatatcctcccgtatactttaaatcagcttta

SEQ ID NO: 24096 - DNA, 238 bp, Homo sapiens
  misc_feature 99: r=a or g
  misc_feature 100: m=a or c
  misc_feature 124: m=a or c
  misc_feature 127: m=a or c
agcgagactccgtctcaaacagaaaaaaaaagagaattttgaatctcctttcccaaagagtcatcttttctgctgtgtttaggacatttgatttgcatrmtccaataatctcctcgaaaccttmagmaaatggttttatcgtgactgtgattcacactttctagaacactttaccagcacccagggacatggacttgggtgttcttatttatggtgtgtatgtaaagagatagggggc

SEQ ID NO: 24097 - DNA, 358 bp, Homo sapiens
  misc_feature 89: r=a or g
  misc_feature 100: k=g or t
  misc_feature 103: r=a or g
  misc_feature 108: s=g or c
  misc_feature 111: k=g or t
  misc_feature 114: r=a or g
  misc_feature 210: r=a or g
  misc_feature 211: r=a or g
  misc_feature 275: m=a or c
  misc_feature 323: m=a or c
acccacgtaaggaagacataaatagaaaaataaagaagtagacatagtagacatagtaggcatagaaggacaacccaactggttctgargtaagtgaatkgaracaasatkggracttccctgcaaaccagggaatgtgggagtgatcatctgattggcctagcttgggttaggtgtcttcacatggcccaatcagctacagtcgtacarrccatattaggcaaattaaaacagcggctgaaagccatccctggctggtgggttgaggagatggmagccatcaggtgaaggggtgataggctgtataaccaccctgacaatamcaaatatgccccatccttccctgaaacctttcagt

SEQ ID NO: 24098 - DNA, 123 bp, Homo sapiens
  misc_feature 89: m=a or c
gtgtgaacaaaacagtgtgtgatctattcttggattcattttgatcagtatttattcaaacccagtctctctccaggacataaaactgmaatcagatatgttcctttttaagcccaaaccctc

SEQ ID NO: 24099 - DNA, 163 bp, Homo sapiens
gggtgaatacaccacaatttattcatcgtcttgtcgatggatacctgggctgtttccagttttgagcaatacctaacattgaaattgacttgtcagagggtaggtgtttgtttaattctgtaagaaactgccaagttttttcctttttttttttttttttttt

SEQ ID NO: 24100 - DNA, 348 bp, Homo sapiens
  misc_feature 276: m=a or c
  misc_feature 307: r=a or g
  misc_feature 329: r=a or g
ataagaaaacttctctgggtgcccacgtggtactgagcgcccttgggagggctctggagaagaccatcgccttccagggtagctccctccctcaaagggaaggaaactgatgtccagaaaagttatgactcgccccaaggggattgcctggcaggacgtgaaggggaagaggcccaccctggagtaaccctcactggagaatccagaggtgagatgagccttgtacctatctcagcagagggagtaggataatatttaaatattaagggtggggamaaggaatgaaggcaagaaataaaatgcccaraatgccccaaacgccatccggrccataaaagtgacggctga

SEQ ID NO: 24101 - DNA, 165 bp, Homo sapiens
tccaggtcttctgcccattttttaatcttgttcattttcttattgttgatttttaaagttttttgtgcattttgatgttaacagtcctttatcagatgtgtcttttgcaactattttccatcagtcaatggcttctcatcctgttgacgttgcctttcacgaagc

SEQ ID NO: 24102 - DNA, 298 bp, Homo sapiens
  misc_feature 91: k=g or t
  misc_feature 100: r=a or g
  misc_feature 213: k=g or t
  misc_feature 238: r=a or g
  misc_feature 239: r=a or g
  misc_feature 248: k=g or t
  misc_feature 250: w=a or t
  misc_feature 252: w=a or t
tatgttactatctctccatgccactactttgagttaaattaggctaatcattctggtgggcatctatatcaaatgttttatttgggatttkaaatctggratcttatgtattataaatgttattctataatataaagtaaggtattaaaataataaatcataattggaccctatcgtgctaaaatgacataattttcttaatttacagcagtkactcactggactttgatgttgaatrratccctttktwgwtgtttgtttcaaaaagctacagattataaactagaattaaggcccc

SEQ ID NO: 24103 - DNA, 111 bp, Homo sapiens
  misc_feature 84: k=g or t
  misc_feature 95: k=g or t
  misc_feature 105: m=a or c
ggtgacggggcaagactccgtctcaaaaaaaaagaaaaaaaaaaaggttagaactttcaaaaaggtaccccaatatcttactckgcttgcttctkggaatcagcmaccatc

SEQ ID NO: 24104 - DNA, 229 bp, Homo sapiens
  misc_feature 108: k=g or t
  misc_feature 202: r=a or g
ttatctgtaaaaacaaagataatttttcaactgtgaggatgaaatgccgcagcacatgcagagaacttaggcacctggcctctagcaagtgcctagtgagcattagckgctaagatgatggtgattctagcaggctgatcagatgagacagcactcagtaacttcgaaccaaagcagaccccacctttttttcccctctgcrttaagtcctcacctaatgtcatccaaa

SEQ ID NO: 24105 - DNA, 314 bp, Homo sapiens
  misc_feature 57: k=g or t
  misc_feature 58: r=a or g
aagtttttcatatttggttaatatctttgtggccaaatctttacatacattctcctkraaaatcatgtcactgaggcggaaggattacatgagcccaggagttcaagaccagcctggccaacatgacaagaccttggctcaacaaaaagattcaaaaattagctggcatggtggcacactcccgtagtcccagccacttgggaggctgaggcaagaggattgcttgagcccaggaggtcaaggttgcagtgagctgtgatcctaccatgcacttcagcctgggcaagagagcaagactctactgcacacacaca

SEQ ID NO: 24106 - DNA, 77 bp, Homo sapiens
acagaagaatagagaggctgttgcagccccgtgctttctcctgctgctggccgattgcttgctctgaactaaccctc

SEQ ID NO: 24107 - DNA, 205 bp, Homo sapiens
acttcatataccctttgcagtaatcattcagggaggaagaaaaacctggaacttgaatgaaggctgatctttgttttgtgcactgtggccctgccaggcatatagtgaaggtgaatgtcttctccctcagaaaaaaattggttccttgctgtcccagtaaggcatagcttttccagccctaactttaaaactcagtgaggaccat

SEQ ID NO: 24108 - DNA, 183 bp, Homo sapiens
  misc_feature 8: w=a or t
  misc_feature 81: k=g or t
  misc_feature 113: r=a or g
  misc_feature 123: d=a or g or t
ttgagaawtgagaatctagtgaaactgcagcgcgcaacattttgaagtgtatctcgggccacggcaagactgacttcagtkcctgctggactcattacttctttttagggggraatgtttgtdtctcaggctgtgactgtcaatgacgtccactggcccctgtgggccattgccaccctcaga

SEQ ID NO: 24109 - DNA, 294 bp, Homo sapiens
  misc_feature 26: m=a or c
  misc_feature 80: w=a or t
  misc_feature 81: w=a or t
  misc_feature 99: w=a or t
  misc_feature 128: w=a or t
  misc_feature 132: m=a or c
  misc_feature 133: r=a or g
  misc_feature 193: w=a or t
  misc_feature 219: w=a or t
  misc_feature 220: w=a or t
  misc_feature 256: y=c or t
  misc_feature 263: r=a or g
ttacatgttaatatcaagttgtaagmaaattattaaaagtaactaacatgtttaataaattttcaggatttttattaggwwcttttagcctagtcattwtttacaaatgtgatttaaaatacgttttwtcamratatgttggaataaaattcagacattacatgttaatatttattaagttgtgtatcattgwtattcatttcatatctcatttaaaawwttggttttagactgaaaatattcctgtggttagaaygacctgrtcgaaaagatctacttggatatctcaatggt

SEQ ID NO: 24110 - DNA, 258 bp, Homo sapiens
  misc_feature 8: s=g or c
ccagccasaacctgaaaaattcagagatggaaaatgaaaatgacaagattgttcccaaagtaacagccagtctacctgaagcagaggagctgatcgcgcctggaacggccgattcaattcgatattgtgcttcctgctacagaattccttgatcagaacagagggagcaggcgtaccaacccttttggtgaaactgaggatgaatcatttccagaagcagaagattctcttttgcagcagatgtttatagttcggtgc

SEQ ID NO: 24111 - DNA, 275 bp, Homo sapiens
ctaattttaaaatttttttagagacagggtcttactgtgttgcccagcctggtctcaaactcctggactcagatgatcctccctcttctgcctcccaaagtgagatatcacagttatagttttaggtactagcaaatcaatgcaaaactattaaaaatattgatccaagctgggcacagtggctcacacctgtaatcccaggctctttgggaggctgaggcaggtgatcacttggagcctaggagttcgagaccagccagggcaatatagcggga

SEQ ID NO: 24112 - DNA, 325 bp, Homo sapiens
  misc_feature 103: m=a or c
  misc_feature 293: h=a or c or t
  misc_feature 300: v=a or c or g
  misc_feature 301: m=a or c
caatcacaatgagaaattaccggccaggcgtggtgactcacgtctgtaatcccagcactttgggagggcaaggcaagagcttgagcttgagcctagacgttamagaccagcctgggcaacacagcaagacccatctctacaagaaatttaaaaactagccaggcgtggtggtgcgcgcctgtagtcccagctacttgggaggctgagccctggaggtcgaggctacagtgagctatgatcacaccattgcacttcagcctgggcgacacagcgagaccctgtctcaagacaghaaagaavmagagacaaattacccagaccccat

SEQ ID NO: 24113 - DNA, 215 bp, Homo sapiens
  misc_feature 150: r=a or g
attttttgttgttgctgcattgtgttaaagtaatgtcactctaaataactactaaccaaaatgtgtcttttttaggaatataaatactgttaagaacaaaagtaaattgacaccttatctgtaaaagtagactcttaaatttaaaaatgragacctaacataggtgtttttgttttaaatataggctgaatgtagtaacattagtagatggcctg

SEQ ID NO: 24114 - DNA, 302 bp, Homo sapiens
cattgacgtgtcactctccatccagtgtccttgatgtggcttttagagacttagcagaaaattcgacacaagcaggaacttgattttttaagaaaaaatattacattttgaggacattttgacaagtaggggaagagagggcttctgttgttttgttttgttttgttaactaaacctgaagtattaattccacaaagacactgtccctcaggaccactcaggtacagctctgccagggacagagtcctgctagtgggaggtctcaggtggggcggtgtgttctgtgccatgaggcagcgcct

SEQ ID NO: 24115 - DNA, 162 bp, Homo sapiens
ctcccaggttcaagcgattctcctgcctcagcctcctgagtagctgggattacaggtgtgtgccaccatgcccggctaatctttgcacttttagtagggacagggtttcaccatgttggtcaggctggtctcaaactcccgaccttgtgatccgcccgcctc

SEQ ID NO: 24116 - DNA, 169 bp, Homo sapiens
  misc_feature 155: r=a or g
  misc_feature 167: m=a or c
catctacttgggaggctgaggcggagggatcgcttgagcctgggaggtcaaggctgcagtgagctatgatcctataagtgcactgcagcctgggtgacagtgcaaaccctgccccgcctttcccctccaaaaaaaaaaccccaaaaaaacccccrcaaaaaaccaamaa

SEQ ID NO: 24117 - DNA, 207 bp, Homo sapiens
  misc_feature 6: m=a or c
  misc_feature 7: n=a, g, c or t
  misc_feature 8: m=a or c
  misc_feature 9: n=a, g, c or t
ttacamnmnattgcatagataaatcaacgaagatcttaagatttaaatgcaaagatataccattctcatggaccagaagactcaatattgttaagatattattccacctcgacttgatctatagattcaattcaatgtcaattaaaatcccagcaggctttttaaaaatagagattgataagatgattctgaaatttatgtggggag

SEQ ID NO: 24118 - DNA, 139 bp, Homo sapiens
  misc_feature 7: m=a or c
  misc_feature 8: n=a, g, c or t
  misc_feature 9: m=a or c
  misc_feature 10: w=a or t
  misc_feature 48: m=a or c
  misc_feature 58: r=a or g
  misc_feature 59: w=a or t
cccctgmnmwtttgacttagtatataggtgcagagacacccacttagmaagttaactrwttggaaaaacatttctctttagtttcaaaaaccatatataattaaatttgtaaggatatactgagtaccctaggccaaca

SEQ ID NO: 24119 - DNA, 135 bp, Homo sapiens
  misc_feature 7: y=c or t
  misc_feature 8: w=a or t
  misc_feature 120: r=a or g
caggtgywatgagtttattttaggcagaatatttttgggttatatattttttaatccattcagccagtttatgtcttttatgtggaatgtttaatcaatttacattcaacattattactratatgtgaggggcaa

SEQ ID NO: 24120 - DNA, 153 bp, Homo sapiens
  misc_feature 8: n=a, g, c or t
  misc_feature 9: m=a or c
  misc_feature 114: r=a or g
  misc_feature 118: n=a, g, c or t
  misc_feature 123: k=g or t
  misc_feature 125: s=g or c
ataacatnmttaaaatccagaattacctttgagatgtaagttaatactcagagaaattattaattatctgctaccacttgcatgatgaagtgttctagcctgattaaaagctgratanggackasaggagggctgtaacaatgggagggagac

SEQ ID NO: 24121 - DNA, 188 bp, Homo sapiens
  misc_feature 7: m=a or c
  misc_feature 8: n=a, g, c or t
  misc_feature 114: d=a or g or t
  misc_feature 115: n=a, g, c or t
atcgacmncatcaaattaaaaactgccataaagtgaggggaaatacatgcaaaaggatttttatctggaatatataatgttctctcaaaagtcaataatacaaaacaactcagdnatataggcaaaacacatgaacagacacttcaccacagacaatgtacacatataggcaaaacacatgaacaagg

SEQ ID NO: 24122 - DNA, 247 bp, Homo sapiens
  misc_feature 7: m=a or c
  misc_feature 8: n=a, g, c or t
tgtagcmnaataagattttcatttttcagtgctcaggctctgtagcatgtatgctgaatgcttttttccttagcacctttaacagtaaggtgttactgcattttacaaaacatcaattcaacatgtcttggatttagtttgtattcatagattttgttaaggatcaggcctgtgaacatgggcacagtgaggttaaataattcacgtggccacaacctggctttgaggttctgcttttggcggccaa

SEQ ID NO: 24123 - DNA, 98 bp, Homo sapiens
  misc_feature 27: r=a or g
aacacggtgatcttctaagcagttaartgactgactgttctggcaacaacgacttctccgtgactgaagggccctgttcatttcctgatcctgaaggc

SEQ ID NO: 24124 - DNA, 151 bp, Homo sapiens
agagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacgtggccc

SEQ ID NO: 24125 - DNA, 120 bp, Homo sapiens
ttaaaaaatgaggaaaagacttaaatagacatttctccaatgatacgcaaatggccaacaagcatataaaaaaatgctcaatatcattaatcattagagaagtaaaaatcgaaaccacat

SEQ ID NO: 24126 - DNA, 178 bp, Homo sapiens
  misc_feature 7: m=a or c
  misc_feature 8: m=a or c
  misc_feature 119: r=a or g
  misc_feature 120: r=a or g
aatgtammatgaatgcaggaaatatatcaccactaggcagatattacattaaacagtaatcattgtaggcaagatccactgacagatgttaaaatcagtggactaaagtttaataggarrcaggatacttgtaagcttcaaagtattgtccccaaactattggtttattaggtaaaaa

SEQ ID NO: 24127 - DNA, 151 bp, Homo sapiens
  misc_feature 7: n=a, g, c or t
  misc_feature 8: k=g or t
  misc_feature 9: h=a or c or t
  misc_feature 10: y=c or t
  misc_feature 136: m=a or c
tacatcnkhyatcccttttgtcctgttaatgtgtctactgttgagtttatttatttatttatttattttgaaacagagtcttgctctgttgcccaggctggagtacggagacataatctcggctcactgcaacctmtgcctcccgggttct

SEQ ID NO: 24128 - DNA, 122 bp, Homo sapiens
  misc_feature 16: w=a or t
  misc_feature 20: v=a or c or g
  misc_feature 33: k=g or t
  misc_feature 62: w=a or t
  misc_feature 65: m=a or c
cgaaatacgaacagawaacvagctgccgcaaakttttacagcttcttggttcttaaaaagcwgcmagctattgagctgacacaggaagaaccgtacagtgacatcatcgcaacacctgggcc

SEQ ID NO: 24129 - DNA, 124 bp, Homo sapiens
gtgaaaagaccctggcacccgcccgacacctgcgtgagccctaggatccaggtcctctctcacctctgacccagctccatgccagagcaggagccccggtcaattttggactctgcactccaca

SEQ ID NO: 24130 - DNA, 235 bp, Homo sapiens
  misc_feature 137: w=a or t
  misc_feature 142: r=a or g
  misc_feature 143: s=g or c
tagatttagttggtgagattgtggattagtttactttgataggatatgttattgtcaaaaaattttaacagctttattaaaatataattcatttctccaaaaagaaaccatgtattcattagcatttactttcccawttctrsccaatcttctttcccaccttggtctaggtggtagctaacctactttcttcctattctgggcacttcatataaatggaatcagccgggcccgg

SEQ ID NO: 24131 - DNA, 133 bp, Homo sapiens
tttggcccatgggtaatccagaagtatgttggtgtattagtccgtgcttgcattgttataaagaaatgcctgaggccaggcacggtggctcatgtctgtaatcctagcactttgagagactgaagtaggcagc

SEQ ID NO: 24132 - DNA, 139 bp, Homo sapiens
  misc_feature 7: s=g or c
cactctsacagcgccgaggtgcgccgagcaggagcagggaacaaaggagcggagaggggaggggagagagttgggcgagggagagcccccggccggctgccagaagatcccggcgggaggaagcccaagtgtcacttga

SEQ ID NO: 24133 - DNA, 129 bp, Homo sapiens
  misc_feature 8: n=a, g, c or t
  misc_feature 9: y=c or t
  misc_feature 44: r=a or g
  misc_feature 114: m=a or c
  misc_feature 120: s=g or c
  misc_feature 121: m=a or c
tacatgtnyacaatgtgcaggttagttacatatgtatccatgarccatgttggtgtgctgcacccattaactcatcatttagcattaggtatatctcctaatgctgtccctccmcccctsmccccacct

SEQ ID NO: 24134 - DNA, 235 bp, Homo sapiens
  misc_feature 7: h=a or c or t
  misc_feature 8: n=a, g, c or t
  misc_feature 18: r=a or g
  misc_feature 19: h=a or c or t
  misc_feature 32: r=a or g
  misc_feature 68: r=a or g
  misc_feature 91: s=g or c
  misc_feature 103: m=a or c
  misc_feature 104: w=a or t
  misc_feature 117: m=a or c
  misc_feature 120: s=g or c
  misc_feature 222: r=a or g
tgattthntaaaacttgrhgaatcatttaagratgcatacatatcctagagaacccaaacagtactgractatacagggtaaaaagttaasatcattctccamwtacctcctccagmcastctgcacaagggtaactgaccattgtgaacaaggaggcccagaaggtgggattcttcatgatctcttcctattcattcacaattatatatataggttattartacaccagtgaaa

SEQ ID NO: 24135 - DNA, 206 bp, Homo sapiens
  misc_feature 5: w=a or t
  misc_feature 7: n=a, g, c or t
  misc_feature 199: r=a or g
  misc_feature 204: w=a or t
tagawantcaggaaaaatacggtgaagcttccagaataaagattgaacccagtccattaaaagaaaatactctaaaatcttgccaaatacatgtaaatggaagtcacagtgatcatccagaaattaactgccacaaagttgtaagggatattctattagagcagtcactacagagccacaagaaactcaaactaactaraatgwgg

SEQ ID NO: 24136 - DNA, 310 bp, Homo sapiens
  misc_feature 8: h=a or c or t
  misc_feature 9: h=a or c or t
aagaatghhtggctgatgtaactctgcccctgaaatctacaagggtcatgcccaaattaatacaggttaacctttgtagaggtatatatgttggcattatttattgacatttatgcttcaagcatgtcttattttatgtaattttaagaaatactctatttaacttgtgaaatatacctaaaagcatactagttagctcttagactctcacttagggagggtaaagaaacatcactgatgtcaatatgaagatctataaacaaatcctttgtttagaacttttttctcttcgtgcacctcacaacacaat

SEQ ID NO: 24137 - DNA, 183 bp, Homo sapiens
  misc_feature 8: n=a, g, c or t
  misc_feature 9: n=a, g, c or t
  misc_feature 10: y=c or t
ataagtannyagataaacttcatcaccagaatgtagttgtttcatgtcttgctacattaaaggtaggcagagtttgaggtttgttttttctaatgataaatcaatacaaaatatttttaaaattttttttcattccataacgaggatctaagtaaggattttcagtggcaaatgagggagaga

SEQ ID NO: 24138 - DNA, 207 bp, Homo sapiens
cagtgatgtcttgagtatatttttgggaaacaacttgattttcttcattaatttgaaaggtttatatgaagaaacagaaaaattagagcaactcctacctaaaaagtttatagtattgtaaaagaagaatgattcggaatcattcccaaatatttttaaggcctaacaatctgcattcacccttctcagccttagtcccatccccag

SEQ ID NO: 24139 - DNA, 148 bp, Homo sapiens
gaactttcttctccttatctttttgtttgtttgtttttgttttgagacagtctcactctgttacccagtctggagtgcagtgacttgatcttacctcactgcaatctccgcctgccggttcaagcgattcttgtgcctcaggccccgg

SEQ ID NO: 24140 - DNA, 195 bp, Homo sapiens
  misc_feature 8: m=a or c
  misc_feature 140: k=g or t
caaactamatcactcgctcaattgaataattgagatcttctgttcatttgttccttggaccttaatcatttgcattttggagaaaattttttctgctttaaaagtctgtaatttcagtttttgtgtcggggagagggaakaactatttgtctgtagttgctttttgtgacaaagtgaatacccactgggccaaga

SEQ ID NO: 24141 - DNA, 151 bp, Homo sapiens
catagcataattcttgattcctggtggaaatcttttctgaggtgtgggggtgggcaaggtgtggattgctgtttacgatagtgccttcattagttttagttctgtctgttttcattcattattgactcaaaggtattagaacagaccgcca

SEQ ID NO: 24142 - DNA, 168 bp, Homo sapiens
acattttttctagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctaa

SEQ ID NO: 24143 - DNA, 127 bp, Homo sapiens
  misc_feature 127: w=a or t
cattggacaatttctccaaggaatttgtcagtttttctgataagcctgatggatcaaatagtggttgaggaaaaattgcagaaactgcaggaactagagaatagactcagtttacaagatggccaaw

SEQ ID NO: 24144 - DNA, 91 bp, Homo sapiens
gtaaaatctagagtggtcctgctccttcctgccaaggaggggaatcatccctctatccagtgtaaccatgctgtatatgctacccacctgc

SEQ ID NO: 24145 - DNA, 178 bp, Homo sapiens
  misc_feature 8: d=a or g or t
  misc_feature 22: m=a or c
  misc_feature 88: k=g or t
  misc_feature 90: v=a or c or g
  misc_feature 93: k=g or t
  misc_feature 110: k=g or t
  misc_feature 127: v=a or c or g
  misc_feature 133: r=a or g
cctcatcdattctgctattaamagattctgatgcgttcttcagtatgcctattgcatattttagctccaaaatttgctcaattctttktvatkatttcaatctctttgtkaaatttacctgacagavttatgrattccttctctatgttatcttgaatttctttgagtttccccatta

SEQ ID NO: 24146 - DNA, 123 bp, Homo sapiens
  misc_feature 11: r=a or g
  misc_feature 38: r=a or g
  misc_feature 60: r=a or g
  misc_feature 67: r=a or g
  misc_feature 99: r=a or g
ttgttaaaggrcataaaattaggaggaacaagttgtartgttttatggcactataggatractatarataacaataacatattttcaaatagctggaaragaagatattgaacacccccagag

SEQ ID NO: 24147 - DNA, 247 bp, Homo sapiens
  misc_feature 7: h=a or c or t
  misc_feature 8: h=a or c or t
gaggachhtgttcataattctttatcatttaccacagttcttcctgaacatatactatgtgtggggcactgtgctaaattctggggatacgaagagtttaaaatcacgcaatgctggttaagaaaggatgctattcttgaatgtggagttggttagtactgcctgccactctagattatctcttctcttttaatttttgaaattacttccttaatttggttgggcaggaattaaaatacagagaaca

SEQ ID NO: 24148 - DNA, 158 bp, Homo sapiens
  misc_feature 7: r=a or g
  misc_feature 111: k=g or t
tctaggraaatgtttgccattttatttcaagtgtttaaaatgtatatacatgtagagattatggaatattgttagctctttgttatatgttgtcattttttttcctccagkaaaccttccctgttaaagttttatttagttttttaaaaatggccgcc

SEQ ID NO: 24149 - DNA, 199 bp, Homo sapiens
  misc_feature 7: w=a or t
  misc_feature 8: n=a, g, c or t
  misc_feature 9: n=a, g, c or t
  misc_feature 114: m=a or c
  misc_feature 133: m=a or c
  misc_feature 199: k=g or t
catatcwnnagcagtcactggaatagatttttcataaatttcctgagcacccttgtggaacacaatataagaggcagccattttgctccctcttttacagatggcataaataamtttcctttggccacaaagmttcagagttaggagctatacaaagatctcctaggcaaggggcagtaatatgagctcaggtggcgak

SEQ ID NO: 24150 - DNA, 178 bp, Homo sapiens
  misc_feature 7: v=a or c or g
  misc_feature 8: n=a, g, c or t
ttggtcvngtctgagcacacagcctggagacacagactcggagagcaggtacccagccctgaggaaggcagctgttacccaagccctgcacctccatcttcccagagtctcgtgggaaacagatttcaaacgacaacagacagcaagactgagaaactacgaaagatcagcctggtta

SEQ ID NO: 24151 - DNA, 150 bp, Homo sapiens
catggtttctgattctgagtagtacttgaaacttcaaaaataacattatacgataaaacacatgttatttctttgttatcttaaaatagcaacaaattctatatacgtagaaagacctatgtagaaaaaaaatgaacattctagcctcta

SEQ ID NO: 24152 - DNA, 95 bp, Homo sapiens
  misc_feature 7: n=a, g, c or t
  misc_feature 8: s=g or c
gagtgtnsagccgagtcactactgcctgcctgcctgcctgctacggctcagcagcaggtacgtacccaaccatgggctcgcaggccctgcccccg

SEQ ID NO: 24153 - DNA, 211 bp, Homo sapiens
  misc_feature 3: n=a, g, c or t
  misc_feature 4: n=a, g, c or t
  misc_feature 7: n=a, g, c or t
tannatnataacagtttgtgagtgaatttatgtgctttatttttctcgaacttactgactttgaatacgttataaaattggagctgtgctcctaaggagtaacatggaactccatcataggtccacctccagcaaaaggctagcaggggtggtggggacactgaggctggcttgatttcccatcctgccccccatggttggtcgtgggaag

SEQ ID NO: 24154 - DNA, 158 bp, Homo sapiens
  misc_feature 7: v=a or c or g
  misc_feature 8: m=a or c
caaaagvmaccatgcaaagcaacgactactttgctacgaagaaagattcctttcctgcatctttcatagttctgttaaatatttttgtacatcgcttctttttcaaaactagttcttaggaacagactcgatgcaagtgtttctgttctgggaggtac

SEQ ID NO: 24155 - DNA, 114 bp, Homo sapiens
  misc_feature 7: n=a, g, c or t
  misc_feature 8: v=a or c or g
atagganvacttttaccatgttggtgggactgtaaactagttcaaccattgtaagtcagtgtggcgattcctcagggatctagaactagaaataccatttgacccagccatccc

SEQ ID NO: 24156 - DNA, 186 bp, Homo sapiens
  misc_feature 7: n=a, g, c or t
  misc_feature 8: n=a, g, c or t
tttgggnnggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactaccg

SEQ ID NO: 24157 - DNA, 210 bp, Homo sapiens
  misc_feature 7: n=a, g, c or t
  misc_feature 8: w=a or t
tctgganwactacagaaattaaaatctcttaggggtacttgtaaagtcattgagaaaaatatagatcttaaactgtcatttgccaatgacaaaattacttaaatcatttgaaaataaatgataggttagcctattttacttacctttaaaatacttgttacaatttttattctcaatgagagagtttttcattttcaatcagagggctac

SEQ ID NO: 24158 - DNA, 230 bp, Homo sapiens
  misc_feature 7: v=a or c or g
  misc_feature 8: s=g or c
  misc_feature 119: r=a or g
ctttgtvstgctcctgcaaatggtggaaatgtctccaggcctccagtgaccctgcgccttgtcatccctgccagtcagtgtggctcactgattgggaaggctggcaccaagatcaaggrgatccgagagactacgggtgcccaggtacaggtggcaggggacctgctccccaactccacagagcgagctgttacggtatctggggtgcctgatgccatcatcctgtgcgc

SEQ ID NO: 24159 - DNA, 145 bp, Homo sapiens
ttatagtgccaaaaatagttagagtgccttggtcctccctctgtaggcagcaaattgaaactaacatgggaccatgccatccttctagcataatggagaagtctgaactgaggagtatctttgatgaaagacatttaggaccctc

SEQ ID NO: 24160 - DNA, 133 bp, Homo sapiens
  misc_feature 7: h=a or c or t
  misc_feature 8: w=a or t
actcachwgtggccactgctcaccatgcacataacccagctcaaccgggagtgcctgctgcacctcttctccttcctagacaaggacagcaggaagagccttgccaggacctgctcccagctccacgacgaga

SEQ ID NO: 24161 - DNA, 203 bp, Homo sapiens
  misc_feature 7: n=a, g, c or t
  misc_feature 8: n=a, g, c or t
  misc_feature 9: d=a or g or t
  misc_feature 95: h=a or c or t
  misc_feature 99: s=g or c
  misc_feature 113: m=a or c
gaatccnndcccaagagctgaaccaggggccctttggggaaagggcctggggagtcccaaagcggcactgtccctgctcggttgcaggcagtgahcctstccccacacccgamtcagtgccagctgtgtcctgagtccaaggtggtacattaggtgcttaatgtttatcccttaacaagacaaacattaacagggtggtcgcc

SEQ ID NO: 24162 - DNA, 216 bp, Homo sapiens
  misc_feature 102: r=a or g
  misc_feature 115: r=a or g
  misc_feature 116: k=g or t
agggtttgactgtgatatatcttggtgtggatttctttgggcttatcctattttggcttcactgagcttcttgaatctgtaggtttatgtcttttgctaagraaattttcagccrktatttctttgagtactttttcagccccatcctcctctttctctccttctggaactctgatgacatggatgttagagcatttgttataatcccacaggcgc

SEQ ID NO: 24163 - DNA, 396 bp, Homo sapiens
  misc_feature 389: v=a or c or g
  misc_feature 390: m=a or c
  misc_feature 391: n=a, g, c or t
taattccatcaacatgtatttcacacctacaacctgcaggactttgtggaaattcaaagaaaatttaacagaaatctggtctccaaaaccttacagcataataagaaagtcagatatgtgaataagagtgaactttgcaaccacacgaggcacaactgagtgttacagcaaaagtcaaaacaagcaaaggacaaagagggtgactagggtcaataataattgtacattgaaaaaataactaaaagagtataactggattctttgtaacagaaaggatgaatggttgaaggtatggataccccattttccatgatgtcatattacacattgcatgcccgttatcaaaacacctcatgtaccccataaatatgtatatacctactatgtavmntacct

SEQ ID NO: 24164 - DNA, 144 bp, Homo sapiens
atttcacccttggcttggcagccggtgtcttgcctctccgcgagcccacactgcctctctcacctcattttccatcacttgccatcaagtctccacagtgagggtggctttctgcctgaccctgtggatgccctgcccattttt

SEQ ID NO: 24165 - DNA, 169 bp, Homo sapiens
  misc_feature 123: k=g or t
  misc_feature 143: k=g or t
  misc_feature 154: k=g or t
cgtaattatatgtcctgcatgtaggaatcatttctaattcctgtgggtcacttaatgaatctcatcaattttacaggtctcaagaaagcaccaacctgtgagccaaaggagccatcttaatgkctttaggtcattaattttakacatagcatgktctttactacaaggc

SEQ ID NO: 24166 - DNA, 210 bp, Homo sapiens
atggagtttcaccatgttggccaggctagtctcgaactcctgacctgaggtgatctgcccgcctctgcctcccaaagtgctgagattacaggcttgagccaccgtgcctgtccttgcccatgtagttatatgtcttttcttttatttttgagacaaggtcttgctctgtcgcccaggctggagtgcatggtgtgatctcggctcactgca

SEQ ID NO: 24167 - DNA, 201 bp, Homo sapiens
  misc_feature 61: k=g or t
aagcactgttcagtgaacatgctgataggtcctttaggtaggcaaaaggaattcacgaagkcacagcgttcaaagatttaggggggaaaaactactacattcaaagggaacaagatttcatgagtttgtcctagagttcagcagtaaaataggccctagtttcagtgccattcctgaaagtactttcaaaggaggcctccg

SEQ ID NO: 24168 - DNA, 297 bp, Homo sapiens
tacgatagcctactgggctgtgttgattcctgggatggtgctgggccagcatccgtgtcctcctgtctccactggacactggtgtcctcctgcagggctctgggcatacctgtctgtaggaaccatgttatggatggtggctgggttcacaggttttcttaaactagaatcacaattgtgtaaaatattctgctagaaacaaacccttcttgagatgacactgaaattctgtctggcttcataacagtcatcagcattcaacatagcttagtgcagtctctctcttgtccccaccga

SEQ ID NO: 24169 - DNA, 192 bp, Homo sapiens
  misc_feature 126: k=g or t
ctctctctgagctgagatcacagctcacctgtgggtactccccaactcttagagctaaagggagaacgaaaggaccaactgccatgaagggacagtgaccataagcttgatggaatgaccttccgkaagataaacatgggaagcacaagtgagaacacctggaaatgttacacgttctagtcaaagacccga

SEQ ID NO: 24170 - DNA, 285 bp, Homo sapiens
atttttgattggtaggctattaattattgactcaatttcagagtctgttatttatctattcagagattccccttcttcctcgtttagtcttgggagggtgtatgtgtccaggaatttacccatttcttcttgagtttctagtttatttgcatagaggtttatagtattctctgatggtagtttgtatttctgtgggatcggtggtgatatcccctttatcattttttattgtgtctatttgatttttctgtcttttcttctttattagtcttgctagaggcctcg

SEQ ID NO: 24171 - DNA, 172 bp, Homo sapiens
agaccatcctgaccaacatggtgaaaccccgtctctactaaaaataaaaaaattgccaggcgcggtggctcacccctgtactcccagcactttgggaagccacggcgggaggatcacctaaggtcggaagttctagaccagcctggccaacatggtgaaattctgccggtag

SEQ ID NO: 24172 - DNA, 324 bp, Homo sapiens
attttgctgcagtgatatttaccggaccggttgtttaattaactgccttggcaacagctggaggcacacagggcttctcctcaaatgcagagcagctgaggaagcagggagcagtgtcaatcgaagagcaatgacatttttcagtgatccctgacctgtaatggactcagtgacatttcctgctaatccatgggtttctatgctctgaggtttcatctgtggggaacagtattgacttacttacaaagagataatgatcataccctatggtcactcaccatagtctggcggtacatggacttctcagccccaccccaaccaaag

SEQ ID NO: 24173 - DNA, 252 bp, Homo sapiens
taatattatttttctgtgcatatgtcaattgtgaactaatggagcaggtgaactgggagtctgtccattctaggcgaggccagggcaggcgacaaggaagcaaaagctgccgctacgctattcaaggcccctggtgggcagctgatctcaaagatctttattggctgtgcctctacttctcctgaaaccctacacctccctagggaaggcctgacctctcaggggcttccatggctggtccccacccccacc

SEQ ID NO: 24174 - DNA, 407 bp, Homo sapiens
  misc_feature 21: w=a or t
  misc_feature 77: s=g or c
  misc_feature 89: w=a or t
  misc_feature 99: m=a or c
  misc_feature 129: r=a or g
  misc_feature 143: w=a or t
  misc_feature 144: m=a or c
  misc_feature 147: s=g or c
  misc_feature 348: r=a or g
  misc_feature 349: n=a, g, c or t
  misc_feature 359: n=a, g, c or t
tctaatgtcagaatgcaaggwacaaaaaacacagaattttatttttgctaaataatttctattttttaaactaagasataaatatattwaatgaaatamaagaatttctacttttacactaagaaataratatctttaatgawmgasaaaattcttcaaaagaaagagaagctttcccttcatattcttaagaacaggtaactaagatccaattattaacgtgctttgaaaattcacgcattttttaaaattagaaactcaccttggtttttctacccatgtagttttctgcaaaccaatcagaatccatggctttaaaatttgccaaaatctgaccctggaagagarnataatcgatnagaacctcgttattcatgttcctctacgctttcttataggaatggttt

SEQ ID NO: 24175 - DNA, 333 bp, Homo sapiens
ctaatatgacatatcattatgagatgcagaagagacactaggaattgctctccctttacatgcagaggaaaggccatgtgaggacacagcaagaaggcagccatctgcaggccagggagagacttgctagaaaccaactctgatggcaccttgattatagacgtctagcttctagaactgtgagaaaattaatttctgttgtttcagctacccagtctgtggtattttttgttatggcagcccaaagcagactaatacattcacgcatgacaggtctgatgatatccccccacaagattgctataatagttctacagatatcaagggcccgtg

SEQ ID NO: 24176 - DNA, 106 bp, Homo sapiens
tcatctgaagtcaaatgtggaagaggagctacaaaacaaaacaaaaagcgacatcaaaatgaaaaaaaaaagagagagagagaaagagaattacctttcttacaaa

SEQ ID NO: 24177 - DNA, 385 bp, Homo sapiens
  misc_feature 73: w=a or t
  misc_feature 77: n=a, g, c or t
  misc_feature 361: n=a, g, c or t
  misc_feature 362: n=a, g, c or t
  misc_feature 363: n=a, g, c or t
  misc_feature 364: n=a, g, c or t
aaatatggtacactctttaatcagattagtttgcaggttcctggaaaagtagattaattttgatatagaagawaganaatcaagtccaaagcaatttcatgagaacagcatcactgcagggttagacagagctcctaaaggaatctcatacggccaaagaatcccagggagtaaggtcctaatgacaaaccatacgtccgtaacaattttaccaaagaatagcccaccctcttgcttcccatagcatttctcagcaaatctaacttttgctagaacttgctaccaaatctaggaaactttcctatttgattattcagtgtgtctctccatcacaattatatcatcagttaataattctgannnnttttttctaaaagacagccac

SEQ ID NO: 24178 - DNA, 269 bp, Homo sapiens
  misc_feature 27: m=a or c
  misc_feature 75: r=a or g
  misc_feature 242: s=g or c
cacgcagggtggccttgtcctcgttgmaagctagccgtcctgctcgctcggcttggtatgctcggggcaaggtcrccgttgtccaacggagaggcccatcgtatccaggggcaatctgccagaacagcaggggcaggatcatgaacatacacgtactccttaacgattcgagattgagtcgagcaccccaggagggataggctggctagcccaatcagcattaagccttgagagcatcttcsagttcctttcgttctttcttagcctta

SEQ ID NO: 24179 - DNA, 337 bp, Homo sapiens
ctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgaa

SEQ ID NO: 24180 - DNA, 60 bp, Homo sapiens
  misc_feature 2: r=a or g
artcggctcggaattggacttgggaggcgcggtgaggagtcaggcttaaaacttgttgga

SEQ ID NO: 24181 - DNA, 88 bp, Homo sapiens
atgactggaagataggcattcatgctataggtcccatttgccagaaatgttagtttccaatatcctagttacctgtctcttgataact

SEQ ID NO: 24182 - DNA, 394 bp, Homo sapiens
  misc_feature 204: v=a or c or g
catatttaaagaaatatagttccattattttcaggtacacactaccagcaggtaaggtgaggaagtataatttagacagtttctcaagggaattgccttaaagaaattctgagtcacttgtaattaacaaatcaatttgaggataaatgggcatttctgaagtgcttgaaggtatttaaaagattttgttctcctctgaatatvagcaactgcctataatttggtttatagcatggctttctttatcgctttccagcaacggcttcaacttgacctaatgaccacagcaggacgctaaccatgagcttcatttcagccacaaattgcgctgacatcaaggcactttctcccagagttcctttaaaaccttgaggtctacattttccttggctat

SEQ ID NO: 24183 - DNA, 239 bp, Homo sapiens
atttttgtatttttagtagagacggggtttcgccgtgttggccaggctggtctcgaattcctggcctcaagtcatctgcccacttcggcctcccaaagtgctgggatggcaggcgtgcggatcacaaggtcaagagatcgagaccatcctggccaacatggtggaatcccgtctctactaaaaatataaaaattagctgggcgtagtggtgcgtgcctgtagtcccagttactcggacc

SEQ ID NO: 24184 - DNA, 220 bp, Homo sapiens
acttttgggtttaagtaatcctcccgccttggcctcccaaagtgctgggattacaggcttgagccactgtacccagctggaatctcatgtttaatattccagacctgtcacaaacactaagaggtgtagcctcttagactgtacaaggctaacggcagccagagagctctcactggaagtgaattaatctctaggatggcctagagggatgagggaaccc

SEQ ID NO: 24185 - DNA, 113 bp, Homo sapiens
tgatcacaccccacttcctgccaccactcccagcatccacctgggataggtcactctgacatacacacaaacacaaacacacaaacacacacacacacacacacacacaccaa

SEQ ID NO: 24186 - DNA, 83 bp, Homo sapiens
ttctgttttatttagccctgccatgcaccacattaattttatgaacataaatgatatttaacttttctttttttttttttttt

SEQ ID NO: 24187 - DNA, 216 bp, Homo sapiens
aggtcatttgtgttggtctccatcagttggtatatcttatcatcacatgaaatggaggctcatgttggtcttaaaatgttgagattttactactcaagacacctagaataaattggggttgatgtcataatgatccctgttacattataactaggcctttactaccaattcctttgaccctgcagcctgtaatagggtacgctatcctgacccctc

SEQ ID NO: 24188 - DNA, 130 bp, Homo sapiens
acagacgtcatacagcccttgaggaatagtttctgcctggtgagattgaatgatagttctcattcacaaaaccctggattctaagcagggacacacagaaattactttcgcaggtaaatcagcccacccc

SEQ ID NO: 24189 - DNA, 134 bp, Homo sapiens
  misc_feature 128: s=g or c
  misc_feature 130: n=a, g, c or t
agtccctggacagctacgacgccatgaatatcttgcccaagaagagctggcacgtccggaacaaggacaatgtcgcccgcgtgcggcgtgacgaggcccaggcccgggaggaggagaaggagcgtgasgnagga

SEQ ID NO: 24190 - DNA, 262 bp, Homo sapiens
tcgcacccggccgaaaattgtgttttgagtggcctaaacccctagatcccagggaaactttggccttagggaaaagcagatggtgccagaagtaatgccagcagaaagctcacctcacctcctttagactgctcagtgaggcaggaaagcggagaactttcttgtaacactcagcagcctgaagggcctcactccccatgaaacctaaagaaaattgaagacttgaaggctccaggagtcacctaatgcagcagtcccccta

SEQ ID NO: 24191 - DNA, 456 bp, Homo sapiens
  misc_feature 312: s=g or c
tttcattcttttctgtcattcggccaggattgagttaaatatatgttctttttcattgtaccccccaaatcattgagaaggacgttttgtccgcattttcctaacataaatctttctctccagatggaagattgaagtctcattgtgctaaggaggaaggaagtggggggggggtgcatttagaaatctgctatatcaagaaagacattaaaaattgataaaggtaggactacctgtttttatattctcccacatagcatgtgtttaaatgaatttgcctataatttgtttcaaacgctgacattttactcstaagctatataattgtgcttgatttttccagagtaaaattcgtattctgtgacgagactaatatgttcacctactataaaaattactgcctgtggtaacagcgagaataaaaatctcctttgtgtacataatagctggcagaga

SEQ ID NO: 24192 - DNA, 168 bp, Homo sapiens
tattatcacatcattaatgtgtggaggcaggcgtttgtctggggtaacgaatgattctatgaagtttagtgttagctttctatcatttccacttgaaagaatcccaaacatgttcttggtttatctcacaactacagtcataagccccttctctttatcccgccacag

SEQ ID NO: 24193 - DNA, 393 bp, Homo sapiens
  misc_feature 326: r=a or g
tctaaatttttaattgttgtcttttttcccctcttctattttgcagttctttgtgccatgaaggaggacagtgaaaaagttccgagcttgttaactgattatattctgaaaggtgagttttataatggtataggtgcgatggctgggaggtttggattagtcagtaaatacatcgccttgctaatacattagacagtaacttcccaatgcacaactttcattaatcttattatgcagggtgaggattagctacatgactgacttctaccaacattatatatcatggttttatataatttaagttttattggaggttctgggttggraaataatctccacagttaaactataaacatcaagagaggtagtagaagaaaattagtgagatggccg

SEQ ID NO: 24194 - DNA, 260 bp, Homo sapiens
ttgatataaaataaggagtaagaggctgtgctttggctcaacagcaagttctcactgctaaaaagcctctgattctgccctgtctgtgtactttcctgtatcgggggagggagagactgtgcaggtgtttaaattgggacttgaaagctttagatttgtgttgtccagaaaggtagccactgaccacatgtggctatggagcacttgaaattcagctagtctgggttaagatgtgctgtcaatgtgaaatacacccacgt

SEQ ID NO: 24195 - DNA, 239 bp, Homo sapiens
tgtctcaaaataataataataataattcacttttggaaactgttccctactagatttcaaacaacttgggaatgaaatcctatttgagttcatccatgtgtatttccaacaagttcagtgtcttacttataaatagtacttgaaggaatgaatacaactttttctttatgtagttattttacacttgatttaaaggaactttaaaaagacgcagttatacctagagacagacgccctcg

SEQ ID NO: 24196 - DNA, 148 bp, Homo sapiens
tcagagtgatagcctagatgtattgaaggcatctcttattctgccaaatcggaaagtcagttctctaaagcccgggttagccagaccatagggttttattctggctgcagaataactggctggtgtggctttgcaaaggggggccctg

SEQ ID NO: 24197 - DNA, 246 bp, Homo sapiens
aaaagagttgggtgttgtggtctaagccatatctgctttatgggggaccttatacccaataatgctgtaattcttccagactctgagaagtaccaccttgaccgccttcaaaaaaatccaggagaattttctgatttactagccagagactctttttccctacccttattttctctcaaagatacagagtctttctctctgttctaagccacctaaagctgggagaagaaagacacaagcaccccg

SEQ ID NO: 24198 - DNA, 148 bp, Homo sapiens
  misc_feature 87: k=g or t
  misc_feature 88: b=c or g or t
tcagattaggaccatttttaaaaaagagccttgttgtgatatgattggcataccaatgtgtacatttaaagcacacaatttgatgtkbgacctatgtatgaggataaaactatcacaatcaagaaaacgaacatattcatcaccccag

SEQ ID NO: 24199 - DNA, 141 bp, Homo sapiens
ataataatttaatattgcattataggcaatgggataaggatgagaatgtgaagtttagacagagctgcagtcatttctcagctctgccatatactagcctcatgccctttgacaagtcacataacctcttaaagccccatg

SEQ ID NO: 24200 - DNA, 158 bp, Homo sapiens
tcttgtgtcattaatattatgtttctgaacttattttagactataaaacagtaaacatgtagaatagtaaatgtcacctccttttgaatttttctaaagtaactggctgtgttcataggttagtttaaattcagccagttactctagcaaaaccactg

SEQ ID NO: 24201 - DNA, 101 bp, Homo sapiens
tatgaaaacagttttcataagacaaaattttgtcttatgaaaatagctttcataatacaaaatacagatagacaccttgaaatggtctccagaacaccaag

SEQ ID NO: 24202 - DNA, 299 bp, Homo sapiens
  misc_feature 209: s=g or c
tttttttttctcttgagatggagtcttactctgtcgcccaggctggactgcagtggtgcgatctcggctcactgcaacctccacctcacaggttcaagcgattctcgtggctcagcctccctagtagctgggattacaggcacacaccaccatacctggctaatttttgtatttttggtagagatggggtttcaccaagttggctagastagtcttgaactcctgacctcaggtgatccacccgccttggcctcccaaagtgctgggattacaggtgtgagccactatacccgaccagc

SEQ ID NO: 24203 - DNA, 243 bp, Homo sapiens
agcaaacaagcaacagaaaggataaagataaaactgaaaaaggggctcaagtatgctatattctagatattaaaaaataaaaataataaaactagtggtttcatgacagacaggggagactattttaacatatatgagacaaaggattaatacctagtaaaatatgcctaattaaacattggttactatgtggaccaagatgttttcactgatcagttctccgaaacatttaaggaagagtcg

SEQ ID NO: 24204 - DNA, 268 bp, Homo sapiens
ttcaggcttgtgtctttagttgcgtggctgcgcaggcctgccatatgatttaagccatctcttttcattaaatgtttctcttcctgtgagacttactaaagcaacttagtggcaaaaagtaatgttgtacttataattctgtacagaaatgacaatgagctgaatatatggttttacaaagtagacatccacttgcaaaatgtttggatgtaatgttaaagcgcaatgtgcaaaatttaaaataaagaatatttattaatacgcacga

SEQ ID NO: 24205 - DNA, 307 bp, Homo sapiens
gaaatgccaaggaaattgattatatttggcatggctctgaagtaaaaaaaattcccatccctacctcataagtcctgcctttacctccctcttcctccctacatggagtttcttaactgaaggctcaactttagttttcaggccaatttggagccaagacaatgtctggctccaaatggtatttaaatagcttcaacccctccgttgtgggagttcagagtatatttccagacagatgacctcctggactctcatggtgcccacggagcctcagctctccccactctctactttgtgccctgacatg

SEQ ID NO: 24206 - DNA, 268 bp, Homo sapiens
ttttatttccagttatggattcaactaaatgactgccttgggagcacataattactttgctacctttttccccctttgctgttgtggctcgagtttggttctcacctgagaagatgcattgagcatatgttgttacccagccctggcttaatggtgtcctgtggggtaggggtgggaggacgaggggcacggggccagagcatgtgaatggatcatggttggacagctgtgacctgccagcactgcgggtaagcaaaactacaaaccg

SEQ ID NO: 24207 - DNA, 127 bp, Homo sapiens
agatactgcctgacccgttcccgggagcgtgtctgggtttgggggcgggagacaggctgagccgcctgggcgcctggcctgtacggggcgggggaggccatggcctcggctgagttgcaggggaacg

SEQ ID NO: 24208 - DNA, 187 bp, Homo sapiens
taataaacatacatagtttggggtataatacatgataatttcatacattcatataatttataaagatcaagtcagtgaacttgggatatccatcaccttagaaccattcaaattctctattttgaaatgtagagtagatggttgtaaactatagtcaccctgctgatgtgtctaacgctaggtctag

SEQ ID NO: 24209 - DNA, 104 bp, Homo sapiens
tgaggtcatggtttcacagctggatttgcctccttcccaccccacagttgccccccaatggggcctcggctggctcacaggatgagggttcaagaagaaggcca

SEQ ID NO: 24210 - DNA, 213 bp, Homo sapiens
  misc_feature 7: n=a, g, c or t
  misc_feature 8: n=a, g, c or t
ttatganntttgatatgttaagtgtattaaatgcattttcaacttaaaacattttcaatttacaacagggttacatcctgatacgcatatcatataaacctatcggacataaccctattggaagtcaaggagcacctgtattatgttccagagttatgaagtttaccctattctctaagccagaaccccgccaccaccccccactccccccta

SEQ ID NO: 24211 - DNA, 263 bp, Homo sapiens
  misc_feature 79: h=a or c or t
cttcttctcgctcccttagctctgggtgtcgggcaccggtgctatgaaacccacgtagtcgaacaccgtgatgcttcthctgcagggcgtgtgatgaggaggcgagcttggctttggaagtgctgggaacctgaggaattgccaaggacccagagcccagccctgaccaccagagtgcccaaaacacaatgaacaaattgaattttcataacaacagagtcatgcaagaccgccgcagtgtgtgcattttccttcccaacgag

SEQ ID NO: 24212 - DNA, 136 bp, Homo sapiens
  misc_feature 8: y=c or t
  misc_feature 9: d=a or g or t
  misc_feature 10: y=c or t
  misc_feature 20: r=a or g
  misc_feature 123: r=a or g
  misc_feature 132: r=a or g
ttctttcydytttaaaaaaraattttttaattttttgtaaaaataaagatggggtctcactatgttacccaagctgaccttgaacacctgggctcaagagatcctcccacctcaacctcccaraagtactgrcact

SEQ ID NO: 24213 - DNA, 82 bp, Homo sapiens
  misc_feature 7: n=a, g, c or t
agacaancataagagaataccgcagaccaaatggcttagaaattaatttaattttaaatcaatgaggttaaaaacacaggat

SEQ ID NO: 24214 - DNA, 177 bp, Homo sapiens
agaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggcc

SEQ ID NO: 24215 - DNA, 164 bp, Homo sapiens
  misc_feature 7: n=a, g, c or t
  misc_feature 8: n=a, g, c or t
  misc_feature 141: n=a, g, c or t
agttctnncgtcggtcggtggccgagatcccgggcacgctggctctggtccaccttctccaatccctgcctgctgggagaggacgatctcttgagaaaggaaagacttctgtgctcccgagaacttcctatcaggcttgcnttctaatgatactgaccgccccc

SEQ ID NO: 24216 - DNA, 102 bp, Homo sapiens
  misc_feature 8: v=a or c or g
catcgaavgctttaccttgtgggggtcagaatattcgtggaactggaatgccatagatgaggggcccaagagggacattgtcaaggaacttaaggtagcctg

SEQ ID NO: 24217 - DNA, 199 bp, Homo sapiens
  misc_feature 110: w=a or t
  misc_feature 111: w=a or t
  misc_feature 181: s=g or c
ttatttcgcatactatttttgtgttcagaacacctaaaatcttctcctagcaattttgaagtacacaatatattgtattcagtatagtgaccatggtgtactacagatcwwttaaacttattcctcctgtctaactaaaactttgtgtcctttgaccaatatctctctcttttcactccasccccaggacccccagccc

SEQ ID NO: 24218 - DNA, 151 bp, Homo sapiens
  misc_feature 7: n=a, g, c or t
  misc_feature 8: n=a, g, c or t
  misc_feature 9: y=c or t
  misc_feature 48: k=g or t
  misc_feature 49: r=a or g
  misc_feature 57: m=a or c
  misc_feature 58: w=a or t
taaaagnnyagagagtacggaaaacatgagccgcttttccaagctttkrgttgagtmwggaagagccctggtgtacccccacccacttgagggatcccacagtgctttcagcaggagttcaatgtgggtattcctttaccctcccgacagc

SEQ ID NO: 24219 - DNA, 183 bp, Homo sapiens
  misc_feature 183: r=a or g
cttttaaaatttactttcgacctgtaatcccaggactttgggaggccgaggcaggtggatcacttgggttaggagtttgagaccagcctggtcaacatggtgaaaccccgtctctactaaaaaatacaaaaattagctgggtgtggtggtgtgcacctggaatctcagctattcgggaggcar

SEQ ID NO: 24220 - DNA, 172 bp, Homo sapiens
  misc_feature 81: m=a or c
  misc_feature 82: m=a or c
tctcaatactgtcctttataataattttttcatgatccaggatttgtgtgttggattttgttgtaaggtctctttaatttmmtttgatctggaatagctcctcagttgtattttgtctttcatgacatttacattttttgagagtacaggtcatttgttttatagaatggca

SEQ ID NO: 24221 - DNA, 232 bp, Homo sapiens
  misc_feature 190: k=g or t
  misc_feature 192: r=a or g
  misc_feature 200: w=a or t
ctgtaagaaatgcatacttcaagtcttattatggacttgctgattcagaacctggaggtgggactcagcaatctgctttaacaagtcctttggatgatctgatatacagaaaagtttgagaaccactggtctagggattgctggaggagatggtaagcagtagatggattctggtgtatgttttgaaggkargggatgawaggacttttgtatatgggagctgaggaaaacg

SEQ ID NO: 24222 - DNA, 142 bp, Homo sapiens
  misc_feature 96: k=g or t
gagggggtggggaagagttcgttgtttgtttacacgatgtgagcggaaaaagagaccaataaagtttattctggaaacaaaaggaaaaaaaaacakgggcgacggagaaaggagtcgggggcgggggcgtgtggcggaggga

SEQ ID NO: 24223 - DNA, 232 bp, Homo sapiens
tttatatctttaattgcaaggataaaagaaggggtgcatctcaaaggccatgataaatataaaggatagaaaagttacgttgatggtgtgcccctcgatatctagaagatagcatagtccatgcattctcagaaagatcctatccatgtggtatgtagagatgtgggtttctttttttctacttttttatgtgcttctttttagaaacttatacacacacacacaccacact

SEQ ID NO: 24224 - DNA, 209 bp, Homo sapiens
  misc_feature 150: v=a or c or g
  misc_feature 152: w=a or t
attccgtctttctcctcctttatgacttagctcaaataacactttcccagtgaggactcccctgaccggctgtttaaattccatctcctggtgcttgagatcctctttacgaagtctctccttccctctgcccaccacacccttggccavtwatcactccctgaacatttgttgtagttactgataatctcattgtccatctcccccac

SEQ ID NO: 24225 - DNA, 128 bp, Homo sapiens
  misc_feature 108: s=g or c
caggctggagtgtagtggcacgatctaggctcactgcaacctccacctcctaggcttaagtgattctctcatctcagcctcccaaagtgctgggattacaggcgtgascaccatgccccacctgaagc

SEQ ID NO: 24226 - DNA, 148 bp, Homo sapiens
  misc_feature 7: h=a or c or t
  misc_feature 8: n=a, g, c or t
cttttahnctattaatttttttttccttaaaatcacttttcttcttctctttttttagctgatgactactagctcccctcccctctccctggaactttctctttcactccaactttcttactacatccatcttttctgtggcgggcaa

SEQ ID NO: 24227 - DNA, 233 bp, Homo sapiens
  misc_feature 126: m=a or c
  misc_feature 131: m=a or c
  misc_feature 137: m=a or c
  misc_feature 138: s=g or c
tctcccccgggccactaaccatcctggcccgggctgcctgtctgacctccgtgcctagtcgtggctctccatcttgtctcctccccgtgtccccaatgtcttcagtggggggccccctcttgggtmccctmctctgmsatcacctgaagacccccacgccaaacactgaatgtcacctgtgcctgccgcctcggtccaccttgcggcccgtgtttgactcaactcagctccat

SEQ ID NO: 24228 - DNA, 149 bp, Homo sapiens
  misc_feature 127: r=a or g
  misc_feature 129: n=a, g, c or t
  misc_feature 135: m=a or c
caatctctgtatctttaacctccttgttaagtttgtctcttccagaatcaaagctataaaactacaaatggttctccaaatggagccccagatgcagtccatgactaagatctactgcggacctctrgnaccggmctgctagccccgca

SEQ ID NO: 24229 - DNA, 198 bp, Homo sapiens
  misc_feature 6: h=a or c or t
  misc_feature 7: n=a, g, c or t
  misc_feature 8: s=g or c
  misc_feature 9: n=a, g, c or t
  misc_feature 29: s=g or c
  misc_feature 36: w=a or t
aagcthnsnacatggattgggtgcggtastcatgcwtgtaatcccagcactttgggaggccacggcaggcggatcacgacgtcaggagatcgagactatcctggctaacatgatgaaaccctgtctgtactaaaaatacaaaaaattagctgggcatggtggcgggcacctgtagtcccagctactccagaggccgag

SEQ ID NO: 24230 - DNA, 189 bp, Homo sapiens
  misc_feature 6: m=a or c
  misc_feature 7: n=a, g, c or t
  misc_feature 8: n=a, g, c or t
atcgamnnattggattctaaggattctcacccattctcttctagtagctttttcagtaattcgcacgccctgcaatgcacccatctaaagtgtataattcaagggctattcatatattcacaaacatgtaaaaaacgatcaccacagtcattttgagaacattttcatcggctcaaacagaaacccctc

SEQ ID NO: 24231 - DNA, 222 bp, Homo sapiens
  misc_feature 8: b=c or g or t
  misc_feature 93: s=g or c
  misc_feature 127: s=g or c
  misc_feature 128: r=a or g
  misc_feature 146: r=a or g
cagtgtgbaaaatgtatatcacgctggtcttcatgtaggtgttgcaagtttcgttcattttatacacatccattagcaccacacatgaatgcsatcctcttcaagaagtaagcagatagggctgggsrcggtggctcatgcctgtratcccagcacttcgggaggctgaggcgggcggatcatgaggtcaggagattgagaccattctggctaacacggcac

SEQ ID NO: 24232 - DNA, 232 bp, Homo sapiens
  misc_feature 7: v=a or c or g
  misc_feature 8: n=a, g, c or t
tgatggvntcaaggtaaatatatttttgccaaagttctggccttccaaaactcacccccttatttaaatgtgtgctatgacccactatgaccacagcatctgcattttctaaaaaattccatgcaggtgttttggggagaggtattttttaagcaatgaaaattcaactgagtacaaagccccctcttggggggttggggaagtctcttttttgaaacacttcagaactgca

SEQ ID NO: 24233 - DNA, 132 bp, Homo sapiens
  misc_feature 123: n=a, g, c or t
  misc_feature 131: r=a or g
actattacagaatcactatttataaattaaattattataatgcttcagagtgttaaatagtgatatcccaaagctatctcttgggatgaacacattgaactaatagtagtgtaagatatctcnaagccccrt

SEQ ID NO: 24234 - DNA, 268 bp, Homo sapiens
  misc_feature 7: n=a, g, c or t
  misc_feature 8: n=a, g, c or t
ctggagnntgggggaaaacatcgattgctgggccccacctcagagtttctgattcagtaggtctggcatggcatcccatgatttgtatttctagcaagttcccaggtgctgctgctactgctggtctgagggaccactcttttgagagtcacttatctagaaaggttttccctgggccttgggaaaccttcccagctgcccttcccctctgagaggtctcctgtcagtccctgcctagctataggagagaggacctctacccagcgct

SEQ ID NO: 24235 - DNA, 242 bp, Homo sapiens
  misc_feature 127: m=a or c
atcccttacttttaaaatcagaacttgttcacatggtggttgcttgtggcaaaacggagttcaaattttgctctcctattgctataattctgctagcaatctgttgaggtgaaacttgggatctgamtcttcagcaagcagcaaatgacctagtaactcagggacaactatttttgaactttaagtgccactttaatgcagttagtttgataaaaccatgtgggtttttttttcagggcacc

SEQ ID NO: 24236 - DNA, 173 bp, Homo sapiens
  misc_feature 7: s=g or c
  misc_feature 8: h=a or c or t
  misc_feature 9: y=c or t
aggtatshyagattaagctattgaggctaagcatggtggctcatgactgtaatcccagcagtttgggagactgaggcaggaggatcgcttgagccctggagttctcgaccagcctgggccacatagtgagactgcatctctaccaaaaaatgaacaaaattagccgggtgtgg

SEQ ID NO: 24237 - DNA, 78 bp, Homo sapiens
gcgtcttccattccagagcaggtggcagcagagagttgacactgcctccctctcacactgtacacacacacaccctgc

SEQ ID NO: 24238 - DNA, 269 bp, Homo sapiens
  misc_feature 7: m=a or c
aggcggmcgcgcgggatctcgagctgggatcgccctcctgggcttcggtgcgatcggcggcgggaggttccctgggaaccaggtggtcgaagggctgagctgtgtggccagacaagaggtccctgccctcccccagtgagccctgctgttcccgtgggagccatgaagctgaacgagaggagtgtagcccactatgcactcagcgactccccagcggaccacatgggcttcctgcgcacctgggggggcccagggaccccaccgaccca

SEQ ID NO: 24239 - DNA, 136 bp, Homo sapiens
  misc_feature 7: m=a or c
  misc_feature 8: s=g or c
agataamsatttgacttgcatgaagagaagcaattttggggaagggtttgaattgttttctttaaagatgtaatgtccctttcagagacagctgatacttcatttaaaaaaatcacaaaaatttgaacactggctg

SEQ ID NO: 24240 - DNA, 278 bp, Homo sapiens
  misc_feature 7: m=a or c
  misc_feature 8: n=a, g, c or t
  misc_feature 12: r=a or g
ttacaamnagaraaatgaggcataaagaccaactttctcagtaactgatcaatagtaagcgaaattaaaaatccaggtggtctggcatcagagcctatgccctttactattaggatctcaagcaaaatgtgttttaaatgtcagttctcctgcaggcagctagcagtacactccagctcccaagagcgagtataccctactgcagttctcattccttatgaggagcagggctaataggtcctggctgttgggcattgtgtttgttataaggtggagtc

SEQ ID NO: 24241 - DNA, 233 bp, Homo sapiens
  misc_feature 6: w=a or t
  misc_feature 7: k=g or t
  misc_feature 8: h=a or c or t
  misc_feature 9: n=a, g, c or t
  misc_feature 137: w=a or t
  misc_feature 138: d=a or g or t
tctctwkhntgtaacttcaaaacttttaagagcagtgaagttggtcagggacatgtggccacttattattacctaaagaaaacatttgttccctgttcattttattttaggggccagatctaacattgtagtgtctwdcaccagatagacttctactgtttcatcaaactcccttcttaactagacctagactttctactccaatcaggctaatctacttactgaatgtgaca

SEQ ID NO: 24242 - DNA, 165 bp, Homo sapiens
  misc_feature 7: n=a, g, c or t
  misc_feature 8: s=g or c
  misc_feature 89: r=a or g
  misc_feature 90: s=g or c
  misc_feature 93: n=a, g, c or t
  misc_feature 98: k=g or t
attggtnstcgcggttggcggttacaggtaggagagaaggcacctcggcgcttctctgaggagaagggaaggctccaggctgcagcgcrsgtnctgakctgccgcgacccagcctccggtcccacgtcggagctcagaagcttagggtgccaggccccccgctaa

SEQ ID NO: 24243 - DNA, 138 bp, Homo sapiens
cataatgggggtaaagttaagttgagatagttttcatccataactgaacatccaaaatcttgatcagttaagaaatttcacatagcccacttacatttacaaactgaagagtaatcaatctactcaaagcatgggggt

SEQ ID NO: 24244 - DNA, 171 bp, Homo sapiens
ctttatacatgatactttttgtagtttcttttaatttttgaaagatgaactgcttccttttaataaattaatatctatttatacttttctcttgatttgggtcaagatgtttgatcatgagtgctttgagtggtatgtggaataggagaatataaaaacaaatctgccaag

SEQ ID NO: 24245 - DNA, 392 bp, Homo sapiens
  misc_feature 359: r=a or g
catgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagarcaagtttcagaattttccctccactatacgact

SEQ ID NO: 24246 - DNA, 222 bp, Homo sapiens
tttataaatgttactcaggttaaaagtatttaagaatacagttaactaattgtaaatatgctgttaaccaaaagagctttccctccctcactttttcctttgtaaacactcatgactgcttctctgtctcgagtcatctctgcattaactccccttcgtggtcactagagggctctctgatgccttctaaaagaacaactgcttttttacaatgccccaccg

SEQ ID NO: 24247 - DNA, 145 bp, Homo sapiens
tttctcataaccagaaatctcagattttctgcaagaatctaaaaactattttattttattttttaagactgagtttcactcttgtcgcctaggctagagtagaatggtgccatcttggctcactgcaacttctgcctcccggttc

SEQ ID NO: 24248 - DNA, 143 bp, Homo sapiens
gtcgggaaatggcggccgcggccgggctggggcttcagcgggaggcagcagaggggaagtggtcagcgtggcgaatgacggaagaaactcgcattgtctactggatcaaggacagacagctcaccaaccgtgacagcacccga

SEQ ID NO: 24249 - DNA, 342 bp, Homo sapiens
attgtttcaattctaggaaatgagaaggaaacgtgtagattggtggtggtgtgatttgttgaatatgtgttacatatgggctgactagttcttttttatttgtcttatttgacaggagtgtgaaaccaagattgcacaagagatagccagtctttcaaaagaggatgtttccaaagaagagaacacgggatcagctagtctagcctgtttttacaaactggtaaactatgggccagggaaggtagatttggacgctgattattgctggactagagctctaaactgttgatccaatttgtgtccctaatgcctaagacaatgactggtacatggtgtatgtat

SEQ ID NO: 24250 - DNA, 174 bp, Homo sapiens
aactcggggctgctgggtagtccaggagggcgcggtaaggctggggtgtcctggtgagaactggagaggatctacccgggtccctgcctggccagtggggaaacaccggtcccccaggcaccttcacctaaccagagcggggatttccaccgcccctcatgccgccctttggag

SEQ ID NO: 24251 - DNA, 169 bp, Homo sapiens
cagtcctctatgtcatctaatgttactttgactgaaactaacatgtgagtggaactaacttttggaaaagtatgcaaaactgttttgggtctgagtgtggtgactcttgcctataatcccagccctacagaagaccaaccttggcaacatggtgagaccccaccgccac

SEQ ID NO: 24252 - DNA, 251 bp, Homo sapiens
agaaataatgaactcctccaaggcaagaaatctgttttgaagcttctctgcgttcacacacagcagcctggtttcctggaagggcattttccacattgtgcgttatggatgatcatcccaggcatcagggtatgcacagatgtggaaacaggaactgatgtgtccattacaccactaggacagaggccagaacaatgaagaaaccaaatacttggaagagggtagagataatgaatggagtccaagggccc

SEQ ID NO: 24253 - DNA, 118 bp, Homo sapiens
agggagggcgggcggcgcgagtgggcgcgggcccggtgggccaggctccagggagcagtgtcagggccagggagacgatggtctccgtgactatggccacttccatcccaggacaccg

SEQ ID NO: 24254 - DNA, 143 bp, Homo sapiens
cagtgttgctgggggcggggaacgggggtggggaggttcttagttgcgaaggagccaagctcctgatggacttgcgttgggatgtgggggacacctgtggcatggtaaggctccctgagtcccttactccaggtcagatgcct

SEQ ID NO: 24255 - DNA, 183 bp, Homo sapiens
catttctgtttgcagctttctctgaagtcttcacttgaagagatgctgtcagttctgttctaagttgcttgttgaactttctttcctttaaccacaataatgttcatgctgtcttgggtgggagaggttttattttggtggccaccccaaattctcagtacattttaatttcttttttttttt

SEQ ID NO: 24256 - DNA, 197 bp, Homo sapiens
  misc_feature 66: y=c or t
  misc_feature 142: w=a or t
  misc_feature 170: h=a or c or t
cagtaatttgtcttttggttttgtgtaagcattttgctcttaacttggatgtagctgtgggggatytctgttaaaaaagtgagattgttcgatggagactaggaagagaaagtgtactcctatctgaagtcactcatctgtwttcttcccattccttcttggcgaatgthaagaactgaacatttggcgtggacact

SEQ ID NO: 24257 - DNA, 258 bp, Homo sapiens
agatttaagcagtattctttttgttttccaaaatacacatcagaaaaatacctttcagtacgaataaattatgtttgatagatgtagactacaaaaaaaaatttttttctagttcatcttgtaaacattaagtcagagtttaaggccatgtgatacggaaacagctcaatattagaaattgtactgagattaaatatctggctctgcatctaactaattgtaaattcctaagcgtgttattcatccttcctggcctct

SEQ ID NO: 24258 - DNA, 403 bp, Homo sapiens
  misc_feature 45: k=g or t
  misc_feature 75: s=g or c
  misc_feature 150: k=g or t
  misc_feature 214: d=a or g or t
  misc_feature 229: n=a, g, c or t
tagacagggtctcactgtgttcccaaggctagtatcaaacttctkgccccaagtgattcttccacttggcctccsaaactgctgggattacacctgtgagccactgcacctggctgatcttttgaaattttttaccaagacttatgtgtkctaacagaacgcaccaggtgcaaataagaatattgtgtatccacttgcttttgactggagagtdctgtacatgtctgtntagcccatttggtttgtgatatggtgtagatgccctccaaatcgcatgttgaaatgtaatctccactgttggattggggcctaatgagagctgtttgcatcatggagacaaatcccctcatgaatgacttggcacaatcatagagttctcactctactaattcacatgagagct

SEQ ID NO: 24259 - DNA, 241 bp, Homo sapiens
  misc_feature 13: s=g or c
  misc_feature 41: w=a or t
  misc_feature 44: b=c or g or t
  misc_feature 45: b=c or g or t
  misc_feature 138: b=c or g or t
aggcgctgcgcasccaggcgtgtcgcgcgcttgggaacccwcgbbgctcccgcagcgcagttaacgtggacaagctggggcaacctggacgagctggggcaacctgatctcggctgtcgaagtgggtgtcctcaagabaaggtgacttggtcctcgcggacgccaggtgttgccccttagatacctgccacctcccagcctccgtttcctctctgggaaacagactcctcatcacctccga

SEQ ID NO: 24260 - DNA, 220 bp, Homo sapiens
  misc_feature 143: m=a or c
tatgattaaaaaaagagtacagtgactgtggggctcagaggaggcacttcacgcagcttggacattggggatcactttcttcttggaggaggggacattgttgctctgtggtaaagaaggctctttgtgaatgccaggccggmaacttttgatattatccagagggcaatttttatcaagagctttggaaagattttaggcaggaaagggacatgatcag

SEQ ID NO: 24261 - DNA, 289 bp, Homo sapiens
  misc_feature 43: k=g or t
  misc_feature 45: k=g or t
  misc_feature 107: w=a or t
  misc_feature 108: k=g or t
  misc_feature 109: k=g or t
acaggtttgagtctcctgcttgtataggtgacttgtgcccatkgktacattaaaggaacatgctgcccagggcctgggcggacagctcagtgggcaggatgtgtgcwkkgtctcagccccatgtgcctgcttgctgggcagttagtatagggcaaagcctgcctgcggcgaccctggctgctaggccattctctaggaacagctgcgactcataaagaccaagaagcataaataaactttcaaaaatttatttggctctttcgttaaaaactgtgcaaattaaaaaaaa

SEQ ID NO: 24262 - DNA, 224 bp, Homo sapiens
  misc_feature 143: w=a or t
  misc_feature 183: k=g or t
gttggatcccctgtgcccttatcctgtttgttcctctttcttggtttattttccctctttggtagacctcatcttctagtaggtaggtcttgagagtagatagctgggaagtaaacattttatgaaactttgcaaaatgtgtwtatttgctttcgtatttggttcactgtttggccgagtgtkgaactctagacttgaaaacattgttggttgctggccgtagc

SEQ ID NO: 24263 - DNA, 248 bp, Homo sapiens
ctagtgagttctgtaccttcagatgatttcttcttgctcgctaactttttttcttttaggttaagatatccctttagcatttcttgtaggacaggtctggtgttaatgaaatccctcagtttttttttgtcggaaaaagttcttattttcccatcaagtttaaaggccgtttttgcctgagacattattctaaagtaaaagtcttttttttcttcagcttttaatatgtcatgccagtctccctgccg

SEQ ID NO: 24264 - DNA, 187 bp, Homo sapiens
tatttttagtagagatagggttttaccgtgttagccaggatggtctcgatctcctgacctcctgatctgcccaccttggcctcccaaagtgctgggattacagacttgagccacggtgcctggcctggatatttttatataaacactcttataaacagttttaagctttttttttttttttttcccc

SEQ ID NO: 24265 - DNA, 382 bp, Homo sapiens
  misc_feature 7: n=a, g, c or t
ttttaantgtgcacaacttccaaaggccggtttggtgctgaattggaaaggattctagttcgcaaaacctggaaaatgaccattactcttgttttctttctttcgttctttttctttaaacagttgtattgaggtataatattgccatgttttcttaacctagctttttggaagaaagtttgggtcaatgttaagccagaatttcttaacttctagggctttttgatatgatcttgcataagtttctcaaactctcacttttttattactcccagataaatcttttcagtagaaatttgggaaatttttgcattttaaaaactcgtacttgctgatgcagttttttttctttcttttctttctttctttttttttttttttt

SEQ ID NO: 24266 - DNA, 346 bp, Homo sapiens
  misc_feature 285: s=g or c
  misc_feature 286: s=g or c
gcctcctgagcagctgggtctgcgggcacttgccaccatgccctgcttttttttgggtagagacggggtctcgctttgttgcctagactggtctcgaactccgtgctcatgtgatcttcccaccttggcctcccaagtgctgggattataggtgtgagcccactaccaccctattatgattcactgtgagaccccaagttttgggaagggttgttttatacagtaatagataatagaaacctaacaaactgaagatacatacactatggcttagcaattccattsstaggtgtgcaccctagagaaactctcatacacacctatcaggaaatgtacactagacaag

SEQ ID NO: 24267 - DNA, 105 bp, Homo sapiens
aacaaacaaaaaaactttaaaggaaccaaataatgcctgcatgtttaaaagtatatataaaatgctccgaaatgataagaagtaggtcttctccctcaaccccag

SEQ ID NO: 24268 - DNA, 200 bp, Homo sapiens
atttccatattttgatttgcatcttgggagttgcttggaatttgggatcctcttctgtctcttgagttgaaatcagaggctgcttgccgggcaaggtggctcacgcctgtaatcccagcactttgggaggcccaggcagacagatcaccagatgtcgggagttagaaaccagcctggccaacatggcaaaaccccgtctg

SEQ ID NO: 24269 - DNA, 218 bp, Homo sapiens
tcttggtatagagagcatttgtgatgctattaattccctgaggccacatatccagctggatggactggacacctgctcccagcctccttgcggataaagactgagaataaaataaatgagtatttctcccactttttaaatctcagttcaagacttcagatattagatgcatttgggacatgttttagtcattcatgttccacgtctgaacgggtggc

SEQ ID NO: 24270 - DNA, 445 bp, Homo sapiens
attattacccgcaactgtctgtctttctgtctgtcccacccaggctgcaggaggagattcagttgaaggaagaagcagagaacaatttggctgccttccgagcggacgtggatgcagctactctagctcgcattgacctggagcgcagaattgaatctctcaacgaggagatcgcgttccttaagaaagtgcatgaagaggagatccgtgagttgcaggctcagcttcaggaacagcaggtccaggtggagatggacatgtctaagccagacctcactgccgccctcagggacatccgggctcagtatagaccatcgcggctaagaacatttctgaagctgaggagtggtacaagtcgaaggtgtcagacctgacccaggcagccaacaagaacaacgacgccctgcgccaggccaagcaggagatgatggaataccgacaccag

SEQ ID NO: 24271 - DNA, 268 bp, Homo sapiens
cttaaacatttaatttgtcatctctcttaccaatgcattacttaaaataatttaaaagtagagactgtgttaataatattcccagaattgacttttttccttggggatcagggcttcagattggttgaaaaaggaataaagtttttatatgttgtgacttcatgttgctttgagctaccagtcgggcttacctgtcatcactgagcatgtgcatctcttctgtcctgggtaccctggggcaggggtgtggcgtgtggtgaggaggacg

SEQ ID NO: 24272 - DNA, 109 bp, Homo sapiens
aaattttagagattaagagaagaaagctttccatctctaaaaatatgtactagaagagatgagaaatggatttgaaggctaatttgaaacaacaatcagcatgacacac

SEQ ID NO: 24273 - DNA, 228 bp, Homo sapiens
acagaagcgcacagatagggaagatatttaggaggctggtaagattcaggattagatgaggcagagagagggtcagaaatggttcccatatttctgatttgcagaatgtggatggacagtgggtccattcactgagataaagaaacttggaaaaagacttggttgggagagatgagtttgcctttggccatgatggattagaaatgcctttgaaacatccggggggac

SEQ ID NO: 24274 - DNA, 182 bp, Homo sapiens
ttttactgatttgtaacatcctttgatgtttttctctttttataattttcaagaaaatctctgaatatctgcattttgatatttctcttcaatatgtactctccattttttatagcactttaaaaaacttgatttcaagataatttcagacttaaaaaaagttaaaaaaaatagtacaaggt

SEQ ID NO: 24275 - DNA, 130 bp, Homo sapiens
tttatgcaatggaataccaggcactaatccagaatctgggatctaggagcaaggctgacaaccaacagataaataaacagggggattatagactgtgataactgctatggagaaaacagatgcagagggt

SEQ ID NO: 24276 - DNA, 218 bp, Homo sapiens
atttattatacacttgatagtagtatatacctgaaaatagatgctttaattatttttttatcttcttttctttattccttagcttctctctggtattacatgaggccagttgatttattatgccatcctcattgggtagagggatatgtcagattatttaacttgtttctcaatatttcatattttagaatataaaattataaatgtaagggccaaat

SEQ ID NO: 24277 - DNA, 269 bp, Homo sapiens
gttcttaatatgagatttaaaatcttaaaatgtttcttattttcagcacttacatcatttggtacacagggtcaaatagggcaaataattttgtctttgtataatagatttgatatttaaagtcactggaaatatcaaatctattatacaaagacaaaatggccttaaaatggtggatcaagcaatatggtctaaaaagatgtccaatggtacaagacgcattcctgtgtcccctgaacaggcacgctcctacaataagcagatgcaac

SEQ ID NO: 24278 - DNA, 227 bp, Homo sapiens
agtctcactctgtcatccaggctggagtgcagtggcgtgatctcagctcactgcaacctccgcctcccgggttcaagcaattctcctgcctcagcctcccaaatgtctgggattacaggcatgtgccaccacgcccggctaatttttctgtatttttagtagagatgggggttttaccatattggccagcctggtcttgaactcctgaccttgtgatccacccgcta

SEQ ID NO: 24279 - DNA, 418 bp, Homo sapiens
  misc_feature 388: n=a, g, c or t
  misc_feature 389: y=c or t
  misc_feature 405: r=a or g
tcccctccattagtataggaaagctacgacaatcattagtatagaaatcatttactttgagggtatttaaattactgttgagaaacaccttttttgttgctgatgttaacttatggtaagttcctaggatagaatttttccccttactgcagtgtggtttttcagctgaattattttatatactgacatttctgcgaaacaccctttgtgttggccatgttagatttaccaggaaggaaaaatagaatattttgctaagtgtttaaatagaaacaatgttttaaatatcagttatatctaactgagagaacaatagatttcttcttaggaaaccttcctcactgaagagtgtgctatgcattgttaaatctcggatgggagaatatgnyctaatagttaattaaragcaccttgtttc

SEQ ID NO: 24280 - DNA, 366 bp, Homo sapiens
tggcaaacacgtatccattgcattcatttctttccccttgttttggtctggttttctggaatgaaagaagcctcttgttttacaaacctctttgcatttctaatgtggtttctttcagatttttattagatatgttacttaaaagggaattaagggtttggacagattgtggcacacaaacacacacaaaaacatgtctgttttcacatccctagctgtggttttaaaattgtgttaaggaaatggatcatttgggttagtaggggaattttatctggtcctgtatgtttgcttttattcttcgagtgctaatgggcctgtgcaacagttggctggtaaatggctgattaaaaagcaaagcagaaa

SEQ ID NO: 24281 - DNA, 420 bp, Homo sapiens
  misc_feature 275: d=a or g or t
atgaaatgctgtattatttgaagcaaatgtgtttcagaaagctagcagcttttcaaactatagattttgtttgggtaatgcatactgctctttggaggtttgttgtttatttggttgaggattttacattgtttccttggttccaatggcaattagaaccatatttggtaaatgtgtgataaataatggagaggttttgattattttgtttgtctagtattctatcattattatcctttgaattctgtaattttgatgaccagaattcctagcadctcatttacactagaaagggcagagttttggtgccaggtacgggggtttgggctggtgattcccccttggatgggtggggctgggcacaaagtgtgagaactgtcttcccccagacattgtccagatgcacatcgagaccctgga

SEQ ID NO: 24282 - DNA, 114 bp, Homo sapiens
cagaatctacaatgaactcaaacaaatttacaagaaaaaaacaaccccatcaaaaagtgggcaaaggatatgaacagacacttctcaaaagaagacatttatgcagccaaagcg

SEQ ID NO: 24283 - DNA, 196 bp, Homo sapiens
taaaaagataccatgggccgggcgcagtggctcacgcctgtaatcccagcactttgggaggccgaggcaggcggatcacctgaggttgagagttcgagacagcctgaccaacatggagaaaccctgtctctgctaaaaatacaaaattagccaggcgtggtggcacatgcctgtagtcccagctactcaggaggat

SEQ ID NO: 24284 - DNA, 190 bp, Homo sapiens
caactcattatctttgtatcataatctagtccctttcttcttttccagtctcatcttagatcctaggttaagttccttagtttagatatggtgaaagattgaaaatcacaggactggaggagtgctatgggatcttagatcctagaaggagaattagtgtgttcatcaatctctagttaacaacccccag

SEQ ID NO: 24285 - DNA, 256 bp, Homo sapiens
atttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgat

SEQ ID NO: 24286 - DNA, 300 bp, Homo sapiens
ttttacccagggctacttagaaaattttagaaaaatactgcctaaagcattgtttcaaagtatcgatcgcttgaacaaaaccgctaccctagatgatcttgggcagggtaggggaatctgtatttttaacaagtgtctcaaatgatgcttggacacactgaagtttggaaaccacaggcatgtgaataaggttactttaaccagcatgcaagattctccaagatatctgatcccaggctattgcttcagtttcacctctctctctataccctgcccagtccctattccctaaccccatat

SEQ ID NO: 24287 - DNA, 425 bp, Homo sapiens
  misc_feature 145: k=g or t
  misc_feature 296: k=g or t
  misc_feature 382: v=a or c or g
tatcaaagattattccctcatattttagggcaaatcaagtgtggctaaattttaaaataaattaaaattttatttattcagtcataggagctacatttcaagtatttaacagccatgtgtagctagtggctacagtattggactkggcagatatggaaagttttcattatcacagaatgttcttcaggacaacactgttttagaagattgtgtcttttaattaatgagattgagtttagcttgttcaaaaataactcatttgccatttcaggattaattgaatttattagggtgtktatgtaggttttatgtatgggttttagttatttgaatatgtcataagtttttttacttgtttatatataggttcaacacggataavagctaggaacgtaaacagcttcatttttttgacagcagactta

SEQ ID NO: 24288 - DNA, 313 bp, Homo sapiens
ctcctagcagccaatgtgaatgcgacaagttcccgatccaggcgtcccgctctccccggccccactcgccaggtcctaccacgatgcctgactcgtttgcggctttgggaccggttgtaggtggcttgaccgtcactagtagacgtttctgagtgtgtcgcggtcaccatggggaggttccctgctcaagctctcttctcttgtctgctgccatgtgagacgtgcctttgaccttctgccatgattgtgaggcctccccagccacgtgaaactgatgacacaacaggaaggctctcacaagatgccaacaccc

SEQ ID NO: 24289 - DNA, 167 bp, Homo sapiens
ccgcttcatctcctgggctttcctggtggacttcctgcctcaactctggctgaaactcagtctagacatatctaataaaagacggaaaaagaggaaagaggtgagaaagaaggaatattgaggaaagatcataatatagaagaaaagaaagaaaacatacaacaccc

SEQ ID NO: 24290 - DNA, 436 bp, Homo sapiens
  misc_feature 395: n=a, g, c or t
  misc_feature 404: r=a or g
ttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaanaagattacrattgagtaattgctcaattgagtgtaggggca

SEQ ID NO: 24291 - DNA, 250 bp, Homo sapiens
  misc_feature 236: s=g or c
aggaagagagaagttgttctgcagccatcagcctggaagtggtaagtgctggggggttgtggggggccataacaggaaggacagagtgtttccagactccatactatcagccacttgtgatgctggggaagttcctctacacaagttcccctggtgccacgatctgcttcacgagtctgggcatgtcctgactcctctgtgtaccccagtgtgtccatcttagcatgaggcgttasatttccccagcatg

SEQ ID NO: 24292 - DNA, 307 bp, Homo sapiens
caaaccagattttccttagagccatcaattgtagatgcaagcaggtgatttttttaaataaaaatcataataatatgttagtagcattttagcaaatgaaaatcaaatcattatgttggttgttagaaagctactttaggaatgaagcagtacattataaataattctagggatctgacagttacttgtgtctagtagtgcttttgtttagatgcttgcttttatgtgtggtaaaaataataatagaaaaataactcaccatatagtccaccatgcagccgaatctcttgtttgttttgcctgctag

SEQ ID NO: 24293 - DNA, 403 bp, Homo sapiens
taatgtagttatgtatcagcttttcctgtccttttaatttcagtttttcagactccttatctttaaggtaaatgtttcatataatcacaatgtaattgggttttactattttagatatctgataatttttggattgctaaaaaaattttgaaaattattccattttccccaccctgctaacttattcgttatgcattctgtattattcctgtacctgttcccgtagagcagcggtccccaatcttttccgcaccagggaccagtttaatggaagacaatttttttcatggatcgggggcaggggaatggttttgggatgaaactgttccagctcaggtcatcaggcattgttagattctcataaagagcctgcaacctagatccctggaatgtgcagcccacg

SEQ ID NO: 24294 - DNA, 108 bp, Homo sapiens
tttttaaattcaacctgacattctctattattatactttttgttttttatatgtctcctggagattttgtttttgttttttggttttttttttttttttttttttttt

SEQ ID NO: 24295 - DNA, 148 bp, Homo sapiens
gaagacgatttcaacaaatggacgtacttgagggcttgaatgtcttggtgacaatatctggcaaaaaggataagttacgtgtctactatttgtcctggttaagaaataaaatacttcacaatgatccagaagttgagaagaagcagga

SEQ ID NO: 24296 - DNA, 142 bp, Homo sapiens
aattgtgttcgcagccgccgccgcgccgccgtcgctctccaacgccagcgccgcctctcgctcgccgagctccagccgaagagaaggggggtaagtaaggaggtctctgtaccatggctcgtacaaagcagactgcacctcg

SEQ ID NO: 24297 - DNA, 317 bp, Homo sapiens
cctgaaggagacttatctgacatatacattttctttttaagaaatattataggccgggttcggtggctcacacctgtaatcccagcactttgggaggccaaggcgggtggatcactaggtcaggatatcgagaccatcctggctaacatgttgaaaccccgtctctagtaaaaatacaaaaaaatagccgggtgtggtggtgggcgcctgtagtcctagctactcaggaggctgaggcagaagaatggtgtgaacccgggaggtggagcttgaagtgagcagagatcggcgccactgcactccagcctgggcggcag

SEQ ID NO: 24298 - DNA, 466 bp, Homo sapiens
ctagggtttcttttcatgacaaattcgagttcgagctttggcgtggatttgtggagatcttactgtagcctcaccttcagaagcatatcatcagagatgtttcaatagcatttgcttgtattttccttgctctgaaggtgaggttagtacctgtctcctttgaggacccagagttcaagtcgtctttcagccagtccttttctttgtatgtcaagtatcaagtggccatacaccaggatccacccgatgaatgtgggaagactgaggtattgttaactgttgttttctgtgttgataaggttgtctgggaagaagtataatatataccattttcttgtcaggtggagctgatgaccctttcagtgtgtattactgaacttctgtgaacactcacatgactcatacatgtgagcattttaaatccttagaaaaaaggattgcaaattcaggatgcgttcttagtgtt

SEQ ID NO: 24299 - DNA, 261 bp, Homo sapiens
tgagcagttctgtggtaaccactgtgctaactacttggcttgtgtctccgcttcatcaaagccacacccaagactaggaggtggttcttactatttccattttacagaggacaaaactggagcacggagatacgtggcttacagtcacatagcatgagggcagagctggcactataacccagtctctgacccttaacctctctaagcttttcacctgcgccttatcatgcagaaatagaggttcaaaaagatgaggctata

SEQ ID NO: 24300 - DNA, 211 bp, Homo sapiens
  misc_feature 15: r=a or g
  misc_feature 31: r=a or g
  misc_feature 42: s=g or c
  misc_feature 47: y=c or t
  misc_feature 49: r=a or g
  misc_feature 127: s=g or c
  misc_feature 151: s=g or c
aaaaaaatgagcagrtgcgggatgtgcgcaragtcggagaasagtcyarggcgcccggagtggctccaggaacgacggaaacccctcaaggcttttgggggcgacttcaatccaacaggacccactsgagccatccacactttccccagcstcctccaaaacagcacactttccggctgaagaaaagaagaatggtattcatgcagtaccc

SEQ ID NO: 24301 - DNA, 377 bp, Homo sapiens
  misc_feature 111: y=c or t
ctgttatagcctaagttctggagtggccagttcctatcagactgtgcagacttgcgcttctctgcaccttatcccttagcacccaaacatttaatttcactggtgggaggyagaccttgaagacaatgaagagaatgccgatactcagactgcagctggaccggcaagctggctgtgtacaggaaaattggaagcacacagtggactgtgcctcctaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagt

SEQ ID NO: 24302 - DNA, 374 bp, Homo sapiens
attttaaaacatgattagatggtagtgaagtgttatgagtgaggaggtataattgatgtcatgaggaagtgagtactgaatggttctatgatttaaggtaaagcagcagttgtagtaagtgtattttacaaatacacatgtaaatagaggtttacctggaaatatgtacgttctaaaaggtcaattttttaattttatttttttgctggttatcctggccaagtgtcttcagaactcatccaagttacgagacgaaataaactaaaatcacctcattaatttttttcccttagttacaaccaaatgaatttatgtaatctctgaatgaactacatccctattccagccgctgatgaatatgttctccagcacca

SEQ ID NO: 24303 - DNA, 411 bp, Homo sapiens
  misc_feature 274: r=a or g
  misc_feature 275: r=a or g
cgcttttgcataatataagaagcccatgatttcacatgtacagtaattcatagaaagtgatagtcatcttgcttagacaccttagttctcaaatctagcctgctaaatatagtaccttctcagacccatataaggtgtcataaaaaaagaaaaaataaaggtcaaagtttccccacccacaaatttggttataaaaacagcaaagcagggtttttctgaacttgaatcagtaaatttttaatttaaatagtatcctgttttgacaaagtgctarrccacagaggtctgagaaagacactcttaagcctttgtcaataccagctggcatctctcaacaggaaaccttggatgacttttgttgtcattttgtgatgcactgacaaggaatgcgtgcccttatttgttgcatca

SEQ ID NO: 24304 - DNA, 147 bp, Homo sapiens
  misc_feature 19: r=a or g
tttcaaaatgcatttatartctattaacttctacacctgtttagtgaacacaacaaagacctggttggtccaggccaccatcatctctcacctgaatgactgcagtagtctcctgattctctttgttcccaccctaggcccccaata

SEQ ID NO: 24305 - DNA, 86 bp, Homo sapiens
attccccttttcatcttttctgcgggcattggtgatatcctggaagaaattatccgacagatgaaagtgttccaccccaacatcat

SEQ ID NO: 24306 - DNA, 104 bp, Homo sapiens
  misc_feature 21: b=c or g or t
  misc_feature 53: w=a or t
gttcgacacaggcttggggcbgacgggggagacggagccccaggagtgttgawgcctggaaatcccctccccttccccctcccccctttacagtatcccccaac

SEQ ID NO: 24307 - DNA, 237 bp, Homo sapiens
cacataaaccaagctagtttctcaaattagcaacagaaaccagatgaaactcctcaaatgagtgttgcaaaataaggagctggtactatagttttatttggggagaaattgttaagtttgggttaactgctcagcctatgcctgatactacccttccatctatggtatcagctgtggcacctgacactccaatgtatcagctgatggttttggtttacaataaattaactaagcaag

SEQ ID NO: 24308 - DNA, 282 bp, Homo sapiens
gaataccaagtgctgctgggcatcaaaacccacctggagaaggaaatcaccacgtaccgacggctcctggagggagagagtgaagggacacgggaagaatcaaagtcgagcatgaaagtgtctgcaactccaaagatcaaggccataacccaggagaccatcaacggaagattagttctttgtcaagtgaatgaaatccaaaagcacgcatgagaccaatgaaagtttccgcctgttgtaaaatctattttcccccaaggaaagtccttgcacagacgcccg

SEQ ID NO: 24309 - DNA, 196 bp, Homo sapiens
acactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggaaggtggc

SEQ ID NO: 24310 - DNA, 149 bp, Homo sapiens
ctgatttgagatcttcttttttattttatttttatttatttattcatttttgagatggagtctcactctgtctcccaggctggagtgctctgtctcccatgctggagtgcagcgacgcaatctcagctcactgtaagctccgcctcccg

SEQ ID NO: 24311 - DNA, 201 bp, Homo sapiens
taatttacatgatcatcagataattcggcttaatatgtcttattctattcagtatgctctttaagttaactgtgaccgaagaacatgtcaactaagaaagctaaacgtttcacattgataataaatctgagattaattgttcttttggctttcacttaaactccatggagtttaactgggaaaaaaatatgccaccaaaag

SEQ ID NO: 24312 - DNA, 148 bp, Homo sapiens
attgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcgtcg

SEQ ID NO: 24313 - DNA, 447 bp, Homo sapiens
  misc_feature 7: k=g or t
  misc_feature 8: b=c or g or t
  misc_feature 350: w=a or t
  misc_feature 405: r=a or g
acccagkbgtattagtctaagttctccagagaaatagaaccaataagagatacaactatagatatagatttactataaggaattggcttgcatgattacggagactgaaaattcaaagatctgcaataggcaagttggagacccaagaccaaaagcaacaggagactgatgttccagtttgaaaacagacagagaaggagaattttttctgctgcagccttttattttattaggccttctcaacagatttgatgaagcctgcccacactaatgagggcaatctgctttactcagtccaccaattcaaatgtcagtatcatctagaaataccctcacagatacaccaagawataatatttcaccaaatatctgggcactcgtagcccagtcaagtggacacataarattaaccatcactctcactaaacattgctaactcatcaacta

SEQ ID NO: 24314 - DNA, 390 bp, Homo sapiens
taactgatggggaggcaggctttgtctacagccacatctcctgcaatcacacatttgattgtctacattcttcccttagtctgatcatcctccagtgctgttcaaccatgactggcagagcctcctgggcatctcttgttgggctttataattcttgctttagaaaagctaacatgcaaaacaaagtagttaatgaggcattaacaattatggatataataaagttaatgtaaatagcacattcctcaagatgaaaaaattaaaaactggtttaagatcttgtgctatcaagattttgtttaactgtccttcagcccagaatagcaagtataacattagcgaaaggtaatttttctggtcagtataatccctaattaagctaccaccctg

SEQ ID NO: 24315 - DNA, 458 bp, Homo sapiens
tctccacctcccgggtagctggaattacaggcgcccgccaccacgcctggctaatttttgtattttcagtagagacgggggtttcaccatgttggtcaggctggtctcgaactcctgacctcaggtgatccacccgcctcagtctcccagagtgctgggattacaggcataagccaccgcacctggcctttttttcctctttaaatgtcacttttggccccaatgttcattacagtgttattcacaatagccaaaaggtggaaacaatccaagtgtctatcaacagatgaatggataaacaaaatgtggtatgtacatacaataggatatagtgttcatcctttaagagaaatgatgttccaatacatgctacaacatggacgatccttgagaacatgctagctgaaataagccactcacaaagagacagtgtatgattctacttatatgaatatcta

SEQ ID NO: 24316 - DNA, 142 bp, Homo sapiens
catctcagcatgcacagtagctgggatgatagctgtgtgccaccatgcctggctagtttttatgttttctatagagatggaatctcactatgttgcccaagctgatctcaaacttctggggtcaagtcatgctcccaccacg

SEQ ID NO: 24317 - DNA, 96 bp, Homo sapiens
  misc_feature 88: k=g or t
tttttaaattcaacctgacattctctattattatactttttgttttttatatgtctcctggagattttgtttttgttttttggttttktttttttt

SEQ ID NO: 24318 - DNA, 165 bp, Homo sapiens
ttcatttcttttagatatatacctagtaatgggattgctggttcatatggcagttccattttaagtttttaggaacttctgtactgttttccatagtggttttactaatttacattcccaccaacagtatacaagggttcccctttctccacatcctcgccagca

SEQ ID NO: 24319 - DNA, 220 bp, Homo sapiens
atgatgcaagctattgccagttccaagaacgcttaaccttaacaggtctttgaagctaaattcaagaaaaatagattaatgtctgtgatgttgtattatgaggcttccctttgaagacaactaaaatagaacttttcttacctgcctcttctgggaccagacactctggataagtgaaaatcattgctcaagctctctgcctccatatccttggccccag

SEQ ID NO: 24320 - DNA, 462 bp, Homo sapiens
  misc_feature 173: s=g or c
  misc_feature 174: r=a or g
agttgccacttgtcctaaattcaaaatatctggcaacactgggcattcaaactggcaggaattgtctggagttgaatagcagctgtctcctttagacagggcttgtgttctctggttgcctaaggtccccactactcccctattgtgtcccacacaacgaggctgagggtcasrtaccatttatcatcacacttgggctattcttcttttacccctcccttttcaatcaatgatattactcacccagactcctgagtttgtgacccctttttcagtttaatttagcaaataattgttggagtggttgcctattgtatgccctgcgtggaaggagaggcaaagggtactcaaggatcttatttatgatctagttagttgtgagtgttgttgttttttaatagacacagggtcttgctaggtttgttggccaggttggtcttgaactcttggcctcaagcaatc

SEQ ID NO: 24321 - DNA, 420 bp, Homo sapiens
  misc_feature 268: r=a or g
gggtttttgagtatttatattgagtaagataaggcagtgagaggattaagcagatgacacagatgatgttgtgtggtaatcatttatctacatagtcatccatctatcccttcaataaacattcatggagacttgttatggtatttaatattttgggaattcaaatattgtgaagacattctataaggtaatttatatttaccatgtataatgttagaaacattgtgctttggaattcaggggaaggagagcattttccttgattgarataggctcacaggctgggcactgtggctcatgcctgtaatccaagcattttgggaggtcgagcaggcaggttgcttgagcccaggcatctagtaaaggactgggcagtgtggtgttttgggaagcgtatgggatatgttatgaggtcagagt

SEQ ID NO: 24322 - DNA, 100 bp, Homo sapiens
aaataagctgctatattctttttccatcacttccctctccaaggctacagcgagctgggagctcttccccacgcagaatgcctgctttccccagtgcttg

SEQ ID NO: 24323 - DNA, 459 bp, Homo sapiens
tgttgacatttgtactgatggatcatgggtgggtagaaataaacttctggcactttagcacaaatcttggttgtggcaccaaaatagtaggagttattatattctttactgctctgcacatgaatacatgtctttttactattctaggtattaaaactggaagtgtacgtaaagcacttctgctgtgtattctggctcctgcgaacttgaactattttctgtcctgtgagagctctgcaaatttttgtgcaactgcttttttatattttcccctcagtagtggagttctaccccatgtgcacacataacagtatttaattaaaaaaattttttttgagacagagtcttgctctgttgcccaggctggagttcattggtgtgatctcggcttattgcaacctttgcctctggggttcaagcagtttccctgcctcagcttcccacgtagcttggagtaca

SEQ ID NO: 24324 - DNA, 280 bp, Homo sapiens
  misc_feature 67: w=a or t
  misc_feature 73: w=a or t
catttaaaaaattaacttcttccttcttttcaatgttcacccctttttattactcccttaaattctwacttgwggtttcttttcttttaaggaattactcaaacatttatgtgtcccactcctgtgactttggttagaaatgcacctgggccaggttctactggtggtgggaggagagcttgctgatggtttagggatttctaattcagcttcttgtcgccattgcaatacccagctggttctaagcatttgaaatacaggttacaaatcagccagcatg

SEQ ID NO: 24325 - DNA, 183 bp, Homo sapiens
atgtgatttgggttaatctaggtgttaatagaggggaactgtttgcttagttagaggacagtttatgaattttgtgcacttcttttgtgtgttttgaatatttagattgttagaaacatagagtatattaaaggccctgattttgccctgtcatataagagaaaaaattcaaagaggtgaaag

SEQ ID NO: 24326 - DNA, 423 bp, Homo sapiens
  misc_feature 14: r=a or g
  misc_feature 47: y=c or t
  misc_feature 78: k=g or t
  misc_feature 79: k=g or t
  misc_feature 231: n=a, g, c or t
  misc_feature 283: y=c or t
  misc_feature 401: k=g or t
attgtacatgtgtragaaaaaaattctccaagaccagaataacataycatcagaaaggagtaggaacaatcgtggctkkagctcaaggctaggaatagttcatctgcccaccagacatagtggaaagatttcattatatacaacacattgggaagaaacctctagagtgttatcttagtattggaattaaattagcctttgattggccgggtgtggtggctcatgcctgtnatcctagaactttgggaggtcaaggcgagtggatcacctgagggcaggagtycgagaccagcctggccaacatggtgaaaccctgtctctactaaaagtacaaaaattagctgggcgtgatggtgagtgcctgtaatctcagctactcaggaggctgaggcacgagaatkgcttcaacctgggaggtggtga

SEQ ID NO: 24327 - DNA, 256 bp, Homo sapiens
  misc_feature 43: d=a or g or t
  misc_feature 221: m=a or c
  misc_feature 223: w=a or t
agaccatcctggctaacacagtgaaaccccatctctactaaadataacaaaaaaaaattagccgggcatggtggcaggcacctgtagtcccagctactcgggaggctgaggcaggagaatggtgtgaacccaggaggcagagcttgcagtgagccaagatcgcgccactgcactccagcctgggtgacagagcaagactccgtctcaaaaaaaaaagaaamcwtgtttaacatcactaatgatcagggagatgcaa

SEQ ID NO: 24328 - DNA, 183 bp, Homo sapiens
  misc_feature 10: s=g or c
  misc_feature 11: k=g or t
  misc_feature 120: n=a, g, c or t
cactgaacaskgtctcatccagctgtgggacactcatatgagcttggtcataggatggctcatcttcccccacttactgggtttccataatgccattctcttgggctgttagataaaatnattaacaacccatccctccatcatcatcaaagcaatttatttgcacaaactccactgtcacct

SEQ ID NO: 24329 - DNA, 163 bp, Homo sapiens
  misc_feature 127: s=g or c
cagctaatttttgtattttcagtagagacagggttcctccatgttgtccagactggtttcgaactcctgacctcaggtgatccacctgcctcagcctcccaaagtgctgggattacagggcgtggascaccgtgcccggccttgagccaccatgcccagccct

SEQ ID NO: 24330 - DNA, 419 bp, Homo sapiens
  misc_feature 79: k=g or t
  misc_feature 119: r=a or g
  misc_feature 307: w=a or t
  misc_feature 320: k=g or t
  misc_feature 350: k=g or t
gtggctcctcgggcaaaatctgtacggtcaaagaaacctataaagtacctggaagagtcagatgaagatgatctgtttkaaaatgtgaggcgattattttaagtaattatcttaccaarccccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgtwttgagtctgcttkcttttgtctttaaaacctgatttttaagtkcttctgaactgtagaaatagctatctgatcacttcagcgtaaagcagtgtgtttattaaccatccacag

SEQ ID NO: 24331 - DNA, 241 bp, Homo sapiens
  misc_feature 218: k=g or t
agaagtccaaatctgtgaggatgcaagtaacaagaggaacaggaaatagcattactatcacccatagacatttcccaggatgtttcagaaaactggcatgacttgtaacaaccagtgataattaattactaaacactactgctcactgaaaagttgtaagttttggggaagagaaattttctttctccagcaagtctccttctctgaatacgacagtkatcaaacccatcacacccctagc

SEQ ID NO: 24332 - DNA, 181 bp, Homo sapiens
  misc_feature 52: b=c or g or t
tttaacaacacagaaacattactgatttgaaggaatctacttagggcaagtbgaaagtaaaaactggaaatactgatacctggaatcaaaggttaaggtcaacaggagctccttggaaagaagtgattacaaatcagtcctcattataaatatcgccgttttatgtgtgttcatgaccctt

SEQ ID NO: 24333 - DNA, 71 bp, Homo sapiens
  misc_feature 7: b=c or g or t
ttattcbtcatcttaggggtaaagcatctatctttcacctttaagtatgatactagccatggttgtgtttt

SEQ ID NO: 24334 - DNA, 222 bp, Homo sapiens
gattatttaacattttgtctttgctatctgtttaggtaggtggagagttttcaaacactgttatcggccagatgaagaaatttggaaggattgccatatgtggagccatctctacatataacagaaccggcccacttcccccaggtaatgagcacatgcacacgatcccatatgtcacaaggctggacaaggagaaaattcacagatatgccataggccaat

SEQ ID NO: 24335 - DNA, 220 bp, Homo sapiens
caatgtatcgttcttaaccccacctcctgtaagggctttgctatgcttcagctggttgtctcagcagctgaagtgctgcccacctgtgtgagttgggtccaggaaaccatgtctgcccttctgataagggaagatgaatctagagctgggtgaagatctaaattttaaccaaacccctgggcccaggaaaataacaattgaaaatgtacaaggcagtgtc

SEQ ID NO: 24336 - DNA, 433 bp, Homo sapiens
  misc_feature 368: m=a or c
  misc_feature 379: m=a or c
  misc_feature 397: r=a or g
caagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggmatttgttaaamctttcttgaagttttaarataacctgagtagactgacatctttgccgtagtctc

SEQ ID NO: 24337 - DNA, 282 bp, Homo sapiens
cataagcgtttttgttacgtgctaggcctctcaaaatggatttgtagaaaatgacacagaatcacagttcatgccctagtttacggtgctctttttgacccgtgttttggaagagtgatagttatcctactgtaaatagctttcctattacaaatagtagttaacatgtcgtgtataaatttctggttttccacaaatatctatgaccacaaatcgagaaagtaatgagttgtgaccaatagttaatatattttctaaatttaaatgtactaccgccacact

SEQ ID NO: 24338 - DNA, 396 bp, Homo sapiens
  misc_feature 58: s=g or c
  misc_feature 109: v=a or c or g
  misc_feature 137: k=g or t
  misc_feature 158: n=a, g, c or t
  misc_feature 162: s=g or c
  misc_feature 163: d=a or g or t
  misc_feature 166: m=a or c
  misc_feature 189: s=g or c
  misc_feature 190: m=a or c
  misc_feature 247: d=a or g or t
  misc_feature 384: r=a or g
tatggtatacattttatatatatatacgtgtgtgtgtgtatatatatatatataaaasagactttatgagaatgagattttaagaagtggaaggatgagagaataagavagctgaagccaggcgcggtggctcgagkctgtaatcccagcactttggngcgsdcgmggcgggcggatcacaaggtcggsmgattgggaccatcctggctagcacggtgaagccccgtctctactgaaaatacaagadattagctggacgtggtggcgggcgcctgtggtcccagctgctcgggaggctgaggcaggagaatggcgtgaacctgggaggcggacttgcggtgagctgagatcgcgccactgcactccagcctgggtgacagagcragacctgtctca

SEQ ID NO: 24339 - DNA, 289 bp, Homo sapiens
agatggagtctcgctctgtcgcccaggctggagtgcagtagtgaaatctcagctcactgcaagctctgcctcccaggttcacaccatcctcctccctcagcctcccgagtagctgggaccacagtcgcccgccaccgcgcctggctaattttttgtatttttagtagagatggggtttcaccgtgttagctaagatggtcttgatctcctgacctcatgatccacccactcaccctcccatccatccatccatccatccatccatccatccatcctttcagccacaccc

SEQ ID NO: 24340 - DNA, 330 bp, Homo sapiens
  misc_feature 64: s=g or c
acctagcacactgccaaacatggcagacactttaaaaatccacacaaagaaaggccaggcgtgstggctcacacctgtaatcccagaactttgggaggccaaagcagttctcctggatcacctgaggtcaggagtttgagaccagtctggccaatatggcgaaacctcttctctactaaaaatataaaaattttctgggtgtggtggtgtgcacctataatcccagctactcgggaggctgaggtaggagaatcgtttgaacctgggaggcagagcttgcagtaagccgagatcatgccactgcattccagccagggagacagagcgaga

SEQ ID NO: 24341 - DNA, 154 bp, Homo sapiens
  misc_feature 20: n=a, g, c or t
atgcaccagatttgtatgtnaggctccttgggaacagctttcatttaatgccctgtagctaggccctcagggtacaaagaacctgcctagcctctgaccaagtatatataacggttaataataatgaccattgtaataatattaacacgactag

SEQ ID NO: 24342 - DNA, 259 bp, Homo sapiens
  misc_feature 230: n=a, g, c or t
aattggggaaaccctcgcgtctactaggggtgatacagatggtgattttaaagagcaaaactagacttctatgtgagaagtgctggaaaatgatttaggacgtgtaaagttagatggaaagactgtaaatgtttaatatgaatatagtgttcttttgaagtaaggccagctgttgaacggttaaactgtgcatttctcattttgatgtgtcatgtatgttaatgtatganatgattaaataaaatcaaaactggtacct

SEQ ID NO: 24343 - DNA, 67 bp, Homo sapiens
taaatctagcttgagtctctcctttaaaaagcctttgctattttaatcttatttgttacactttttt

SEQ ID NO: 24344 - DNA, 416 bp, Homo sapiens
  misc_feature 346: k=g or t
  misc_feature 347: r=a or g
  misc_feature 348: n=a, g, c or t
tgatgattgtatctgctttactaagttaaaagcgtggaggaagtgactgcagaaacttggttttagcacagctgaggcagaggacttgcgtacaggaggaaagccatgatgagcacagggccctggcagatggaggatgggtctttggaaagctgggtcatggcccaacaaatgtcagggcacatgcgtccagtcatagtaagtagactttttctagaaaattctgtccaatggtagaacataagtcctgtgaataagaaacaaaagcaccaccacggtgactacggtgcaaggatcagagatggcgctgtctccttttaaagttacagatggtgcctggcctcgkrncccttcagggcagcgtttaacggcagccctctcttagagcaaacaaagagtcttcctttgcatacaat

SEQ ID NO: 24345 - DNA, 258 bp, Homo sapiens
agtgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctggtctggggcttggatgttgcactgccccactgcctgtcccttctggtaaaataaagaactcttaatgccctt

SEQ ID NO: 24346 - DNA, 439 bp, Homo sapiens
  misc_feature 19: k=g or t
  misc_feature 20: b=c or g or t
  misc_feature 181: y=c or t
  misc_feature 383: w=a or t
cattttaatgatgttgatkbttgtaatcagtgagcataggatgtttttccatttatttgtgtcatctccgattttctttcagcagtgttttgtaattctccttgtagtgatcttttacgtccttgattagctatattcctagatattttatttttgtggctattgtaaattggagtgtgtycttgttttggctcttaggttaaatgtcactgctgacttttgtacattgattttgtaccctgaaactttattgtagttgcctatcagctctaggagccttatggtatagtctttagggttttttaggtatagaatcatgtagtccatgaagagagagagctcatcttcttttcctatttggatggcttttatttcttgctgtwgcctgattgctctggctaggacttccagtactacattgaatagaagtgctaagaga

SEQ ID NO: 24347 - DNA, 137 bp, Homo sapiens
aatctttgtagaggtaatacttgaaaccatggcactgaataaaggttaaaataagagacagtgcagagagagaacggggtttgagtctttttgaagactatatgtgaagaggtggagaaagaaagtagtgagcaggt

SEQ ID NO: 24348 - DNA, 123 bp, Homo sapiens
aaagaggggcgcccgacagggacctcacaagcccccaagcaggggcaacaggtgttttggagattagagaccctagccttgttcctcaggctcctcttaaagaatctgacccctgagggtgct

SEQ ID NO: 24349 - DNA, 138 bp, Homo sapiens
ccagatgtgtgcaattaagttgatactgcatgagatcccaatcagcagcatgtgggcttcacgcctgctcattaatgtttctctttgctttctacaacttgatgtctggaagtcactttctgggaaacctgacccggc

SEQ ID NO: 24350 - DNA, 361 bp, Homo sapiens
actttgaggggaggtggaaactaaaacagaggcggtggaagaagttgcacaaggctagagagatcactgctggagggaaaagcatgatgggctctcgggttttgagaactggcaagttgttggaggcagctggagcggggcctgggtcgccggcactggctgtctttgcgtttgggcgtggccagtcactcctcttccaggttccagcctgaactgtctgcccctgatctgcggcgatttatcgatggtccaaaccgggctgtggccctgcttccggagctacgggaggtcgtctcctctatcagctacatcgctcgacagctgcaggaacaggaggaccacgatgcgctgaaggaggacg

SEQ ID NO: 24351 - DNA, 242 bp, Homo sapiens
gaagttactatattgcataatgcggctatgaagagttggttttaggctttgtcagggtgggcctatcttggttttgcctttattcctaggacataggctttagtcctggggagtaatcattactccttctgtagtctcagtagaaagctttaggtgttctccagagtcctctaacttggtgagaactaaaccctaagcaccatctgctcaacacaagacaacacctttttagccttccagcc

SEQ ID NO: 24352 - DNA, 173 bp, Homo sapiens
acaaaaattagccggacacggtggcacgtgcctgtaatcccagctacttgggaggctgagacagcagaatcgcttgaacccaggaggcggaggttgcagtaagccgagatcatgccgctgcattccagtctgggtgacaaagcaagactctggctcaggaaaaaaaaacaact

SEQ ID NO: 24353 - DNA, 211 bp, Homo sapiens
  misc_feature 19: k=g or t
  misc_feature 164: b=c or g or t
acttttatttattttattktatttattgtattttgtttttaatcttctttaagttccaggatgcatgtgcagaatacgcaggtttgttacataggtatacgtgtgccatggtggtttgctgcccctattaacccgtcatctaggttttaagcccagcgtgaatbagatatttctcctaatgctcctcctccccttgctccccaccccccaa

SEQ ID NO: 24354 - DNA, 427 bp, Homo sapiens
  misc_feature 379: k=g or t
tatttttggtagagacagggttttgccatgttgcctaggctggtctgcaactcctaggctcaaacaatctgcctgcttgctgggattaggagccttgaaaccatggagtgttacatattatatatgtatcaattaactgcaaacattatttattttgatgtttgagctttccagcaagagctcctttaaactggctcctgtgaaccgtaaaaaaagttttaaattgtgctaaaatacacataacataaaagttaccatcttaaccattatttgcaaccaattattgtaaattgacaatttataattgtataagtttatgggtcacaaagtgatgtcataatttttgggtacaatgtggtataacaaagtcaagctagtkaatgtaaccatgacttcaaatacttaacatttttgtgatgagaaccgc

SEQ ID NO: 24355 - DNA, 256 bp, Homo sapiens
  misc_feature 175: n=a, g, c or t
tgattgacagaaagatcttcggcaaaatattccacccaagatacgtgggagatattgagatccaagcaataagccatatttgaaaggcattatagtttttgaaagctgtagcgcaatcattcttaaggccagttaccttctccccacatctctgggatcctgtttgaagggagtnctaacaaggcctgtgttcgagcagcccagcatcccttactcctggagcggggggagactaacccctctcctgtgcccacat

SEQ ID NO: 24356 - DNA, 444 bp, Homo sapiens
  misc_feature 93: m=a or c
  misc_feature 364: y=c or t
cttgttatttctccttcagctgtccttaccctcagatacgttttccgctgtcggctgcctcttcttcgtgtgctctctcccctcgtggcctcmtgcctttctgacagctccttcttcctccactggccccttcttccctctctgaggctcaggcctcagtgtctttccggtctccctacacactcccatgaagaccctctccgcattctgacttcggtgccaccctttatgccggagactcccagatctcatttccggatctgcctccttaacttataggtctggatacttcctgtttggtttttcaccttcatgctaaacgcagtttgtctaaatcggaagtcaacttccattctctgccgcycctccctcctgacccatgttggatcattccgctaatcacagggacccaaaagcttcgagtcacttttggctcatctcgtc

SEQ ID NO: 24357 - DNA, 372 bp, Homo sapiens
aaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcttggttttcttcctttgaacaaacatcttcaatatctttatgacagtcttta

SEQ ID NO: 24358 - DNA, 169 bp, Homo sapiens
  misc_feature 19: b=c or g or t
catgagccactgcgcctgbctaagttaatagttcttgccagtgtctgccatttaaaccctgaatctaaagggtgtgggtcattcacagtgcctgacatataggaaggaggaagggctcaataaatagccaccgttattatttctatgattatgtgtccaccaccaccaa

SEQ ID NO: 24359 - DNA, 166 bp, Homo sapiens
tttgtcatgggtattaaatgagataatacatgttagtttcttagaggagctgacacacagcaaactctcagtaaatgttggtcatcattatattcctactgttaaagaaaaaattattcaatggtacttgttaaagcatgataaggaaaattttattcaggactgg

SEQ ID NO: 24360 - DNA, 316 bp, Homo sapiens
  misc_feature 113: s=g or c
  misc_feature 114: v=a or c or g
ttgtatttttagtagagatggggtttcactgtgttagccaggatagtctcgatctgctgaccttgtgatccgcccgccttggcctcccaaagtgctgggattacaggcgtgasvactgcacccggctatttatttactttttgagacagagtcttgctctgtcgccaggctggagtgcagtggcatgatctcggctcactacaacctccacctcctgggttcaagtgattctcctgcctcagcctcctgagtagctgggactacaggcgtgcgccaccatgtccagctaatttttgtatttttagtagagaccgcg

SEQ ID NO: 24361 - DNA, 209 bp, Homo sapiens
agagggggcgcgcttgactgacaggcggcggcggcgcagttgcgagtgcaggctccttgccagaggcctccactcactccagacccctatagcccgtcgctgtcagctgtcaacaaaggatgcgaatgctggccgcttcctgtgggcttcgtgtcacccagaggtgagcccaggccaggatgggggactccagggacctttgccctctg

SEQ ID NO: 24362 - DNA, 374 bp, Homo sapiens
  misc_feature 19: d=a or g or t
taccatagccataatgtadtgtacaattcatttgacttagtcagcaagatcagtagaacagtaacactttttttggcatctgctagttgaatatgagtgtacatctatgtctgctttatgtccttgttactgaagatcctgtcatcatcactgagatcctttagagataccataaatgggtccagacccagcaatttgggttaatactattttccttcattgtgaaataagaattagggcaggaagttaagaaggaggctttagcttggtgtcagaggaatatatggtaaaaatggtatactgttagtcattactcttcatcacctgaacgattaatcttactaggccccccagaggtcaggagaagtgaaagt

SEQ ID NO: 24363 - DNA, 170 bp, Homo sapiens
  misc_feature 151: w=a or t
agactacaggcgcacgccaccatgctgggctaatttttgtattttcagtagagacggggtttcaccatgttggtcaggctggtcttaaactcctgacctcatgattcgcccgcctcggcctcccaaagtgctgggattacaggcgtgagcwaccgcgtcccgccaagaag

SEQ ID NO: 24364 - DNA, 285 bp, Homo sapiens
  misc_feature 19: d=a or g or t
  misc_feature 20: r=a or g
ctcatttctgactggacadrgttcttccaaacaattctgagaaacaaaaacacacacgcagaattaacaattcttttccctgtgcttcttatgtaagaatcctcctgtggcctctgcttgtacagaactgggaaacaacacttggttagtctcttttaagttacaaaaagccaattgatgtttcttattctttttaaattttaaatattttgttataaatactcacaggataccttatttccctagctatcatctcctgacttaatgttttttaaacccaccgct

SEQ ID NO: 24365 - DNA, 234 bp, Homo sapiens
  misc_feature 19: b=c or g or t
  misc_feature 155: d=a or g or t
  misc_feature 156: w=a or t
tatttccccccagtccatbgtgtgaggtaatcttttaaaagtactacaatggaccgggcgcggtggctcaagcctgtaatcccagcactttgggaggccgagacgggcggatcatgaggtcaggagatcgagaccatcctggctaacacagtgadwccccgtctctactaaaaatacaaaaaattagctgggcgcggtggcgggcgcctgtagtcccagctactcgggaggcgt

SEQ ID NO: 24366 - DNA, 376 bp, Homo sapiens
  misc_feature 10: d=a or g or t
cagatgatgdaattcgtcacctggggaatggggcctgcgcccatgaccagctggaggtgattgagctggacaactgcccactaatcacagatgcatccctggagcacttgaagagctgtcatagccttgagcggatagaactctatgactgccagcaaatcacacgggctggaatcaagagactcaggacccatttacccaatattaaagtccacgcctacttcgcacctgtcactccacccccatcagtagggggcagcagacagcgcttctgcagatgctgcatcatcctatgacaatggaggtggtcaaccttggcgaactgagtatttaatgacacttctagagctaccgtggagtctctccagtggaagca

SEQ ID NO: 24367 - DNA, 378 bp, Homo sapiens
  misc_feature 130: r=a or g
ctatcaatttgcttattctgaagcaattttcaatggttttccctgcttttcttttccatgcatctaactgcactcttgtcttctcacaacacataggacccactgctgcacagaaggaacttgaattctratcagccaatgttttatttgtgggacatcccatcaaattttttaaaaaagatcttattgaacagaagagggaaatggaatttgaggatgacttgacattgtgagattaaatggggttggccgaagtttgaccaggacttttccctgctctgctggagagactgtctctcctcttggtgcccttcttggaggagcattttcagcctgctgcctaaacagctgttgatggatagctttctccctgcagcg

SEQ ID NO: 24368 - DNA, 172 bp, Homo sapiens
  misc_feature 13: s=g or c
actgacttgagtstggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaa

SEQ ID NO: 24369 - DNA, 212 bp, Homo sapiens
  misc_feature 38: v=a or c or g
  misc_feature 42: k=g or t
  misc_feature 150: k=g or t
aaaatgcaaaaaattggccgggcgcggtggcgggcgcvtgtkgtcccggctactctggaggctggggcaggagggtggcgtgggcccgggaggcggagtttgcagtgagccgagatagagccactgccctccggcctggtagaaggagckagattccgtctcaaaaaaaataaaaataaaaataaaaaaataaaaaaaataaagtggtcgag

SEQ ID NO: 24370 - DNA, 196 bp, Homo sapiens
gataatgctacttggccccaaacgctggacagagcatgctttttcctgtttggctgggaaagggaaggctgaactgctgagtctgacacttaacaggacttcggcattcccctgaatacagactagatcagagattttatttttttaattgaaaagtaacttgggttctctttagaaacccttatttggtgcgcgc

SEQ ID NO: 24371 - DNA, 223 bp, Homo sapiens
catttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgcccccc

SEQ ID NO: 24372 - DNA, 162 bp, Homo sapiens
ggacattccttttttaaaacatggagccaaggcctgtgacctgaggcccctgtgtccctgcaagtctccttcctggctctgtgtatgagcacagcctaagctcactttagtgccaaggaggctggggacctgtctacactcttcgatgttggtggcatcata

SEQ ID NO: 24373 - DNA, 374 bp, Homo sapiens
  misc_feature 21: d=a or g or t
  misc_feature 27: k=g or t
  misc_feature 204: k=g or t
  misc_feature 205: k=g or t
  misc_feature 360: n=a, g, c or t
ccggcccggcagcgagagcgdcgccakggaggccaccggggtgctgccgttcgtgcgtggcgtggacctcagcggcaacgacttcaagggcggctacttccctgagaatgtcaaggccatgaccagcctgcggtggctgaagctgaaccgcactggcctgctacctgcccgaggagctggccgccctgcagaagctggaacackkgtctgtgagccacaacaacctgaccacgcttcatggggagctgtccagcctgccatcgctgcgcgccatcgtggcccgagccaacagtctgaagaattccggagtccccgatgacatcttcaagctagatgatctctcagtcctggacttgagcnacaaccagctgaca

SEQ ID NO: 24374 - DNA, 325 bp, Homo sapiens
  misc_feature 257: n=a, g, c or t
  misc_feature 293: r=a or g
  misc_feature 302: k=g or t
  misc_feature 312: n=a, g, c or t
tcagctgtcatttatctgactaggggggacatttggcatctccgggtctccctctgcaggggtgcctcggtgacccctcgtacgttggtttatactctgtgggtatttcggtcggatcgcatcctggacgtgggatttcagggatgaggttgtttgcctcttgggcgtctttttccacatttctgtcttcccttgctttcttgccggactgtgtgtcagccccattccagtatgccgtggaccggtgaacgcgagancctagtgccttacagctgtgtccagaggaggggcarggctctgtkgacgcgagangcttttcatgtgt

SEQ ID NO: 24375 - DNA, 189 bp, Homo sapiens
  misc_feature 97: k=g or t
ctttaaacccggctgcactgggcctgtgtggcacgtcctggtccccccgagctccatcccttctggcttacatccaccttgtccctatgcagcagcktttttatgagaattacgagcagaacaaaaaggggtacattagagatctccataacagtaaaattcaccaagctatcacattacaccccagaa

SEQ ID NO: 24376 - DNA, 248 bp, Homo sapiens
  misc_feature 246: n=a, g, c or t
  misc_feature 247: r=a or g
  misc_feature 248: r=a or g
tagacagttcatccatggaaaagcagggaagacagagacatggacacagaagtggataaatgggtatatccaagtgggagcttggatgttgtcttctgattgctttgttttctccatgaactgaagaaccaaggtcaacagtggaagataaggatagagagggagacactagagggcgtgatatagttatccaagagagtgagtgaaccagggggatgaatgtcatgtgattgacaagcggcggcnrr

SEQ ID NO: 24377 - DNA, 313 bp, Homo sapiens
tttgttttcagactcattctcaagtcccttaggctgaaacttgctacagatgaagatggggttactgctgaatctggcctggatgtctggagctggtccaaaatacagtttttctttgaaattttttgggtagctaactccttgatcagtccaggagccccttgggtataaataacctcagggctctgtctggaacttcctttgggccattctagatctcacaggtcctagtaattagacagatgtagacctggagaaggggcatgattcatggctataatctgcccctctctacagtccctaaatgtgccta

SEQ ID NO: 24378 - DNA, 382 bp, Homo sapiens
  misc_feature 108: k=g or t
  misc_feature 295: w=a or t
  misc_feature 299: k=g or t
  misc_feature 306: r=a or g
  misc_feature 309: m=a or c
  misc_feature 316: r=a or g
  misc_feature 322: w=a or t
  misc_feature 328: m=a or c
  misc_feature 337: w=a or t
  misc_feature 362: m=a or c
  misc_feature 376: m=a or c
ctgtgtgaatattccacagtttctgcatccattccattatagatgggcattgggttttccagattttgactattacaaataatgttgctgcaaacattctagtataakcttttggtgagcctgtgtgtgcattcctgttgggtatattcctaggaatcaaattgctaagccatagagtgttggtggggaggcaaaactttacctctcccctcttagggtctccagctgggcctgagaatgaaattgacttaagactgattaacatgtgaaaagcagacagatttttttttttttwagakgtacatrggmccccatrggaaawttaaamcccaaagawttggcaacacttaagtgcttatctmctgggttgaacagmcagata

SEQ ID NO: 24379 - DNA, 236 bp, Homo sapiens
gttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagccccc

SEQ ID NO: 24380 - DNA, 162 bp, Homo sapiens
  misc_feature 110: m=a or c
  misc_feature 111: s=g or c
  misc_feature 150: m=a or c
  misc_feature 151: m=a or c
gtttccgtaaaattgactttgtactctgaaaatgtcaatttatattgaacttggaggagtttggcaaagtctgaataggtcaacctgcaggcgtaactatttttgacctmstcagtttttaaacaatgtgcatttgaaggagttaattammagagagcccct

SEQ ID NO: 24381 - DNA, 317 bp, Homo sapiens
tttcccctgattacataattattgtaagaaattagaaaaactttagtaaatgtgtaaaagaagagactgaaaaaggagaaaaatcacctgtaatcctaccaaaggtaataactaatgccaagcaaactgcacataatatgttgtaacctttcattttcacttgacgtactgagaactttccattttagtaaaaattacagcatgatttatactggctgtataatattctctttttttttctttttttgagatggagtctcgctctgttgcccaggctggaatgcagtggcgccatctcggctcactgcaccctccct

SEQ ID NO: 24382 - DNA, 216 bp, Homo sapiens
tgagaggcttgctgggttttaaatactactggttgatggtacttagagattcttctcagtaattgctgttatcatgttgcatgttgtccatcagagttctaattgttacacatacaacagaagaggaatggattttggagaaatgaagtaatacagaatagagagtcaccatgccctccggagagaaattaatacttgcttaattcagaggaagcg

SEQ ID NO: 24383 - DNA, 480 bp, Homo sapiens
  misc_feature 10: k=g or t
  misc_feature 386: k=g or t
  misc_feature 387: b=c or g or t
acatatattktatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggccatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaackbggtgaaacccatctctactaaaaatacaaaaaattagctgggcgaggtggtgggcgcctgtagtccagctacgcggaaggctggggggatcac

SEQ ID NO: 24384 - DNA, 200 bp, Homo sapiens
ccagcctggccaacatggcgaaaccctgtctctacttaaaaacaaaaacaaaagcacaaaaattagccaggcgtggtggctcatgcctgtaatcctagctgcttgggaggctgaggcaggataatcacttgaacttgggaggcggaggttgtagtgagctgagatcgcgccactgcattccagcctgggcgacacagtga

SEQ ID NO: 24385 - DNA, 156 bp, Homo sapiens
tattttttaacttttattttaggttcaagggtacatgtgaaggtctattacataggtaaatttgtgtcatgggggttccttgtactaattacttcatcacccaggtattaagcccagtacttaaaattagcttctctactcctctccccactccca

SEQ ID NO: 24386 - DNA, 256 bp, Homo sapiens
  misc_feature 17: m=a or c
  misc_feature 18: y=c or t
  misc_feature 19: s=g or c
  misc_feature 24: s=g or c
  misc_feature 27: y=c or t
  misc_feature 28: s=g or c
  misc_feature 37: b=c or g or t
  misc_feature 39: n=a, g, c or t
  misc_feature 40: n=a, g, c or t
tcttaattgcatagccmysaactsgcystcaaatatbgnngcatggccatgcagccccagtgctgcttctctccaggacataagtgggagttctttggagaatgctggagggaatgaaggggaggagtgcgcctctccactgcatttttccttgaagcagaaacttagcttccaacgtccttcagatgccaggtcccacctgcagcttcttgctctctcctgggaatttcagtccagctaccatctctaaagtcca

SEQ ID NO: 24387 - DNA, 178 bp, Homo sapiens
  misc_feature 11: m=a or c
  misc_feature 12: m=a or c
acaaaaaagtmmcaaacatcccttaaaaaaaaaacacaaagactcctagtactttggggaggaggtcatgttttccttataaaaacaaaatttggattgtgttaggtggagtgataaagttgatgctattagtagctttatttttcattgtggtaaaataggcatacctttttttttt

SEQ ID NO: 24388 - DNA, 171 bp, Homo sapiens
  misc_feature 20: b=c or g or t
aagtttactctttaccatgbaataaagtcacctttagaaaatgacagaaaaaaaaatagatgggaaggtgtttattctctgatatttttccagaccccacaggagcaaggagggcagtaacccatgcttttcttccctaaagcaacagccatttctcctcccacccccccc

SEQ ID NO: 24389 - DNA, 169 bp, Homo sapiens
  misc_feature 12: y=c or t
  misc_feature 64: r=a or g
  misc_feature 98: k=g or t
  misc_feature 125: r=a or g
  misc_feature 126: r=a or g
  misc_feature 127: w=a or t
  misc_feature 133: r=a or g
  misc_feature 141: w=a or t
aaccatcctttycttggggttgcgctactgtccaatgagcgcatagtgagggcagtactgctarcgcctgaacaacacacccgcatcaactagagctkttgctttattttggtgcaatttttggrrwaatgaraacctgtwttcatagacttatcagttcaaacagcaa

SEQ ID NO: 24390 - DNA, 355 bp, Homo sapiens
caggcctctgatgcttaacatgtccaaaactgaactcttcttctctttaaaaaacaccatctgcccaggtgttcagctccaactggagtcatcctttgatctgtccttttccgtctacgcttatccatcaaaagtcccacaggttttacctccagaataagtccacatccatctacttttcatctctgccgatcctggtctaaaccaccatcatcttctcttgggctgctgggacgcctcctcactggctacagacttgctctgttctgtgctctccagagcagccagagctaactaactttggaaaatggagagtgggtatctctctctccatcacaaacacgcacctctcaga

SEQ ID NO: 24391 - DNA, 150 bp, Homo sapiens
taggccaggcgtggtgactcacacctgtaatcccagcactttgggaggctgaggcgggcggatcacctgaggtcaggagttcaagaccagcttggccaacatggtgaaactccgtctctacaaaaatattttaaaaaattagccaggcaa

SEQ ID NO: 24392 - DNA, 296 bp, Homo sapiens
caatcagcactctgtaaaaatgcaccaatcagtgctctttgtctagctaatggtttgtaaatgcaccaatcagcactctgtaaaaatggaccaatcagcactctgtaaaatggattaatcagcgctctgtaaaatgaaccaatcagcaggccgtggacggggccaagtaagggaataaaagctggccatccaagccagcaggggcaatgcttgggtcccttcccatgctgtggaagctttgttctttcactgtttgcaataaatctggctgctgctcactctttgggtccacacat

SEQ ID NO: 24393 - DNA, 150 bp, Homo sapiens
  misc_feature 12: y=c or t
  misc_feature 20: k=g or t
  misc_feature 21: b=c or g or t
atttacagtttygggtcagkbctgcagtgaggagggggagaggaggggtcggggagggaggaggaggaggaggaggagctggaggaagccctgactggtatccctggccccagtccagtttggagctcagtcttccaccaaaggcccacc

SEQ ID NO: 24394 - DNA, 74 bp, Homo sapiens
aagactatactttcagggatcatttctatagtgtgttactagagaagtttctctgaacgtgtagagcaccgagg

SEQ ID NO: 24395 - DNA, 89 bp, Homo sapiens
  misc_feature 13: r=a or g
agacatgctccargttgttcttgagatcacagttcccatcacattttctctggagaatgtgaagaacacagaactgggagaggaacagt

SEQ ID NO: 24396 - DNA, 413 bp, Homo sapiens
  misc_feature 106: r=a or g
  misc_feature 110: y=c or t
taaaaaaatgagtgtaaagtctatgttttagaaaaaagtatagtttttaaattgtggcaaaatatacacaacataaaatttaccattttaatcatttctacttgtrtagyccacggtactaagtactttcacattgttgcacaaccatcagcattatccatctctagaacctgttcatcttctccagctgaaactctgtatccattcaactccaactccccattccctttgtacacctattttagaagttcctataaatactttgaaataagatctttccccccttcatggcaaccacatatctactatatatctctgaatttgactactctaggtactctaggtaccagattagtggaaccagatatttgtccttttaccactgacttatttcacttagtaaaatatgacta

SEQ ID NO: 24397 - DNA, 271 bp, Homo sapiens
  misc_feature 107: k=g or t
atagctgtgctcgatttttttgttgttgttgtgactgacagggtgagattccgtctcccaggctggggtgcggtggcgccttctcggctcgctgcaacctgcggcckcctagattcaggcgattctcctgcttcagccttccgagtggctgggatggcaggcactcaccaatatgcctgggtaatttttgtatttttaagtacatacaggatttcaccatgttggccaggctggtttcaaactcccggcctcgggtggtctgcctgcccct

SEQ ID NO: 24398 - DNA, 248 bp, Homo sapiens
  misc_feature 12: y=c or t
  misc_feature 133: w=a or t
  misc_feature 134: r=a or g
tttgcaggtcayggtaatctgaggttacatgaccaagagcatctgagtcagcctgagtctggaaacattcttggaatctgggttccaggcagctggaatcaagtgccatgagaaactttgaagcaaagctgtwrggtttcaatgggaggatagaaaagtcacaaaagattatcttagtaatgagatgctttgaaaaatgagcagtattggagggtacagggaacattgaacaaagatacgtatgggga

SEQ ID NO: 24399 - DNA, 260 bp, Homo sapiens
cactctggagcagcactgttgactcccagcccccaacctcaatcattttaaaatatctacatcttggctgctgagtaatgctgaagaaaagacaaaacccacatgacccagcagacttttgcctctacaaattacgagattccaattttttttccacaaattttttaagttggcaatttgttattctacaaaaagtcctaataatatcttatgtactcttttaaaaaaatacctccaaccctgccacttctcccctcagg

SEQ ID NO: 24400 - DNA, 150 bp, Homo sapiens
agtcaagagttctcaagggcaggttctgtgcccatttgtccatgtatctcccatgctcagaacggttagtgggagctcagttgttatttgttgtattaaaatgagtggtttatatgcaaaggtacacacctatgaaagtgtcggggctat

SEQ ID NO: 24401 - DNA, 210 bp, Homo sapiens
  misc_feature 21: s=g or c
aagaaatactcatgtaggctsggcacagtggctcatgcctgtaatcccagcactttgggagtatgaggtgggtggatcacctggggtcggaagttcgaggccagcctggccaacatggtgaaaccccgtctctactaaaaatacaaaaaattagccacctggtggcgggcacctgtaatcccagctactcaggaggcttgaggcaggtga

SEQ ID NO: 24402 - DNA, 373 bp, Homo sapiens
  misc_feature 21: k=g or t
  misc_feature 38: k=g or t
  misc_feature 39: r=a or g
aatgatctcaagcatttttckttgtttttcagattcckraatttgacaacttgtacctggatatgaatggaattatacatcagtgctcccatcctaatgatgatgatgatcactttagaatttcagatgataaaatctttactgatatttttcactacctggaggtgttgtttcgcattattaaacccaggaaagtgttctttatggctgtagatggtgtggctcctcgagcaaaaatgaaccagcagcgtgggaggcgttttaggtaaaacatttatgttttattttggaatattatttagcttagtaaaaatatgttattttaaagataattgatttaacacaatcttctgttcatgtttattttctgagt

SEQ ID NO: 24403 - DNA, 98 bp, Homo sapiens
aaaatataactacgtagcgggaagaggaccattgtgatccactaccaatagaacatttatagttgaaaatgcaatttgagttgtttgttcaccagtga

SEQ ID NO: 24404 - DNA, 269 bp, Homo sapiens
  misc_feature 48: k=g or t
  misc_feature 49: s=g or c
tatatatatttatggggtatatgagatattttggtacaagcatgcaaksataataaccacatcatgggaaattgggtatccatcccctcaagcatttatccttggtgttacaaacaatacagttataatcttttggttatttttaaatgtacaattaaattattattgactatagtcaccttgttgcattatccagtactaggtcttattcaatttgttttttgtacccattgactgtccctacttcctccctaaccagtcccccagcc

SEQ ID NO: 24405 - DNA, 211 bp, Homo sapiens
ccatttagaacttataaaaattacattttacaagtacaaaatacgggcagcagcctgtcttggcattttttcaggttaagagccaatgtattagtttattaaagtcttattatgaatcaagcatgacttctttgctttaaaatataggaatgcaattattagtttaggagaacacatgttaatcacacatttttatttattgagagccaca

SEQ ID NO: 24406 - DNA, 132 bp, Homo sapiens
ccaagatcattctctatacatttttgggaggcgtcaagctgtcaatagttaacactggctaggtttactattttagcatccattcattcatcacttcaacctactacactctcacttccattcccaccatga

SEQ ID NO: 24407 - DNA, 180 bp, Homo sapiens
cttttttggctttttgactaagatccaatgtagcatgtttttttcagttgaataactgatttttttttggtctgaggacgatatatttaagtggggttttggaatagaaagatgaaataggagctggttttttccactctgcgcatcgacttggtattgccgtgtttccaaagaggcgcc

SEQ ID NO: 24408 - DNA, 129 bp, Homo sapiens
acaatcccaatcaagagccagcccggtttctgcaagcacacaggagcagaagagaaaccagtgaagacttcaccgctgcatatcaggccagcgacggctgctcggtgacggcgctgctctgccaccaag

SEQ ID NO: 24409 - DNA, 311 bp, Homo sapiens
  misc_feature 19: d=a or g or t
taaaaaaaacccagaaatdcgtttaaataccttcccccacccccagcagctgacccttacttattcagaaaaccctcctctgacatcagccccaaaatattgcccccaggtccaccaagggccaaatcagatgaaatgttcaatttataaaggtcaacaaatatttattaattagttcctgttgttaaggagtttataatgtagaagagaaacacggtacataaatcactgcattattaccaatcgtggaaggtggtgacagagctggggtcctgctttgagcatcagaagccactttggcagggaggaca

SEQ ID NO: 24410 - DNA, 322 bp, Homo sapiens
aggggtaagggggctcacagcagtgaaagagccaaatcctcatttaccgagcaaaatgggaaatatatataatgcctaaacctgaaaagatcgagaagtcaagaggtgacaatatgagcacgttattttaacatacagaggtaactaaaagtatcaggtaagtctctacggagtatagtatggaagctgggagcctgttaattttcataacaagccttggaattatttggctctttaaactatgttcatacataattttactcaagtgaaaacgttttaaaaagaacaaaagtgctatgagaatgggcagactgggttttta

SEQ ID NO: 24411 - DNA, 340 bp, Homo sapiens
  misc_feature 146: r=a or g
  misc_feature 147: w=a or t
ccaggctgcttggcttcttggcttcagcccccttcccataagtcttgatggttttcctgcctcacaggaattcctagagctggagtattcaaatactcctgtgtcttagtgcctgctcaaatggtcactcacctgagcagctgctrwgagtcttcacagctctgtgcttgaaacccaaagccctagtggaatgggctaatgaggggtctttctgatccatgggtcacaaggatcagtgggaaaagcatggttttcagcgaggggtagcacaatccctcatcacctcccttggctggggaagggagctccctttgccctgtgcagctcctgggtgggccca

SEQ ID NO: 24412 - DNA, 168 bp, Homo sapiens
cagggaagttattaatgatctcgttcagcagaagaggaaaccaaagattatagaggtaactgattagtttaaaaagtggcatatctgtcagcattatgtgtgttcctattgcccagttttgcccatgtaattttctgtgattatggaaatgtttgatgttggcacatt

SEQ ID NO: 24413 - DNA, 196 bp, Homo sapiens
  misc_feature 124: v=a or c or g
agtcagatacgattggcagggagagcacgagtgttattatgagaattatgccgagataggtaacagatgaggaagaaatttgggcttgagtgaagtaatgggggctgtctgtgaagctttgcgvcagtacagcctaggtaatttgctgagcttgatgggtgtcagggtcagcccaagtgaaagctaagagaggcag

SEQ ID NO: 24414 - DNA, 282 bp, Homo sapiens
  misc_feature 119: k=g or t
  misc_feature 215: r=a or g
gtcattgtttcatattttgtcatataaaatcacctaccctgcttctagttttatactttaatctgagtgaaagtatgatgtggtggaaagaaaaaacagtacagtattacatctgagtkagtctttgaaaaatcatagtagtaaatgaacctcaacactgagtggtcaaaaattgggttaaccaatggggggataatatttggttaattgttttratattaaattttcaagtttataatagagttatggttgagtagtcatccatattgagtaatcacagca

SEQ ID NO: 24415 - DNA, 248 bp, Homo sapiens
  misc_feature 129: r=a or g
  misc_feature 138: k=g or t
taggtttattctgtctactttcagtcctttcgcttataaactttcaatccaagcataaggtctttttcctgttacgctgtttgaactttgtttaaaaattgtggccaagcatggtggctcatgcctgtratcccagckactcaggaggattgcttgagcccaggagttcaagaccagcctgggcaacagtgggaccccatctctacacacacacacacacacacacacacacacacacagtgggcccc

SEQ ID NO: 24416 - DNA, 423 bp, Homo sapiens
caagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattggattctcataggagtgcaaaccctattgtaaattgtgcattcaagggatctaggttggcactccttatgagaatctaatgcctgataatctgaggtggaatattcattgttattgtttgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatca

SEQ ID NO: 24417 - DNA, 183 bp, Homo sapiens
  misc_feature 12: v=a or c or g
gcctcttctgcvacgtgatgatgcagtgagaaggagctgtctgtgaacttggaaggggtcctcatgagacactgaacctgctggtgccttgatcttggacttcccagcctccagaactgtgagcaatacatctctgttgttcataagccaccccatctattagattctgttgtagcagccaaa

SEQ ID NO: 24418 - DNA, 100 bp, Homo sapiens
  misc_feature 70: y=c or t
atcaagtcttgatgccaccaatgatgagtttagtgtacttaatcttttgcctctttgacttttttttttycttttttaagatgaatgatttcggaatcta

SEQ ID NO: 24419 - DNA, 69 bp, Homo sapiens
attgattgagcctggttcacagtcccctcacctcttccctggccatttgctcctatttttttttttgtt

SEQ ID NO: 24420 - DNA, 59 bp, Homo sapiens
cagaaaaaaacccttaaagagcactcccaggagagagtaagcaaaaaaaaaaaaaaaaa

SEQ ID NO: 24421 - DNA, 137 bp, Homo sapiens
acacatcattagtcactgctgagctgtagaaagtaagagaaatcgcaaactccttgattagctgtattttaaaaagctcttcagaaaagtgatctactactatgctctgtgttctagcagaatacaaaggcccccct

SEQ ID NO: 24422 - DNA, 218 bp, Homo sapiens
cattttattcaggggcacatttgagaaaaggtgccatagtgagaatgaataaagcaagcagacagttaacataattgccttgctggcgtactagtttatgtttggaattaaggtttaaaaggttggatctaaattgtgaagtatcttagatgcctagcaaagatgattggattttatatttgaggggaaaaagtgaaaagtctaaatagaggagtaga

SEQ ID NO: 24423 - DNA, 158 bp, Homo sapiens
  misc_feature 19: b=c or g or t
  misc_feature 100: r=a or g
  misc_feature 101: r=a or g
atggaactaatttttattbctttttcctttacatcttctcatattcaactttgatttatatagtcaacattttaaaaaaaatttgctttactgcttaaarractattgaggtctattttgaaatcctggtactgttgatagcattttattggcactag

SEQ ID NO: 24424 - DNA, 71 bp, Homo sapiens
ttcattactacacttacctggcctgtcagcagaaaggtccctagggccttaggtcaccctagtatcctacc

SEQ ID NO: 24425 - DNA, 183 bp, Homo sapiens
gtgacgaaaccctgtctctgctgaaaatacaaaaattagccgggcgtggtggcatgtacctgtaatctcagctactcgggaggctgaggcacgagaatcggttgagcccaggaggtggaggttgcagtgagctgagatcgcgccactgccctctggcctgggcgacagagcaagactccgtcg

SEQ ID NO: 24426 - DNA, 56 bp, Homo sapiens
caggaaaaaaaacccttagtctgaaactttaccaccaatcccccttgccccccaaa

SEQ ID NO: 24427 - DNA, 216 bp, Homo sapiens
  misc_feature 35: s=g or c
ctactcgggaggctgaggcgggagaatggcgtgasccgggaggcggatcttgcagtgagccgagatcgtgccactgcactccagcctgggctctctgttcccaggctgaggcgggagaatggcgtgagccgggaggcggatcttgcagtgagccgagatcgtgccactgcactccagcctgggaacagagagagactctgtctcaaaaaaaaaaaa

SEQ ID NO: 24428 - DNA, 216 bp, Homo sapiens
atagtaagaataaagagaggtaaaattgtgataagttgtatatcttaggtgtcagcaacagattaaattgctagtgccactaagggaactgaattattagatccatttcaaaatacattaagacctgagggagccaggaaataaggaagaggagaggagtaaaagaggacatgagagtgaggaaggcagagagtacagggagtgaatgaaggggca

SEQ ID NO: 24429 - DNA, 147 bp, Homo sapiens
  misc_feature 54: v=a or c or g
aagacgaggaggacgaggatgaggaggaggaaggtgaagaggaggacgtgagtvgagaggaggaggaggatgaagaaggttataacgatggagaggtagatgacgaggaagatgaagaagagcttggtgaagaagaaaggggtgcat

SEQ ID NO: 24430 - DNA, 198 bp, Homo sapiens
  misc_feature 144: k=g or t
ctaactgttcagtctcctatcaattttttttctctgtttttcagatgaggttatttttattgatacacgttcaggttcacagactcttttctcccatctccattttcttattgagtccaaccagtgaactttttatgtattgtktatttcacttttaacatttacatttggttctttaaaaaaaaaacaaaaaaaaaa

SEQ ID NO: 24431 - DNA, 275 bp, Homo sapiens
  misc_feature 20: k=g or t
  misc_feature 86: k=g or t
  misc_feature 112: r=a or g
  misc_feature 113: r=a or g
  misc_feature 124: n=a, g, c or t
  misc_feature 222: r=a or g
ttgaatgacttaaaatgtcktatttcctctcccgacaaccccctacccttctcagcaccatgcacctccctgatttaacaggagtktcgtttaccccttgcatttaggattrrtgaactgaganaagagggtaaaggctttgggattgatcattaatgtttggttttgtgtgacttgttttaaatgcgtgataaattgatgctgacggtacttgaatgagtragaaaagcaaatgaagcctacttttaatatggaattagttgactttatagtat

SEQ ID NO: 24432 - DNA, 90 bp, Homo sapiens
aaagttgactttgccgcttgtcttgaattccattaatttagaatcagggccagtgaattttctccttgttaaggagccgaaagtgcccga

SEQ ID NO: 24433 - DNA, 385 bp, Homo sapiens
  misc_feature 20: k=g or t
  misc_feature 32: k=g or t
  misc_feature 33: w=a or t
  misc_feature 223: w=a or t
  misc_feature 300: k=g or t
  misc_feature 315: d=a or g or t
  misc_feature 319: w=a or t
  misc_feature 329: w=a or t
  misc_feature 366: k=g or t
  misc_feature 372: w=a or t
tcagacatttttggctattkgggtccattgakwttccatatgtgttttagggtggatttttctatttctgcaatatgtcttagggattttgatagagattgcattgaatctttaaatcacttttggtaatattgttatcttaacagtattaagtcttcatatgcatgagtatggattgtctttccgtttatttatgtcttctttaatttctttcaattatgtwttatagtttttcgtgtacaagtctattgcctccatggtaaatttattcctatgcatttgattctttttgatgctatkaaaaatgtaattgtdttcwtaatttcttwttgggatcattcattgctagtgtatagaaatgcaackcatttwgtgtgtcgtgatt

SEQ ID NO: 24434 - DNA, 173 bp, Homo sapiens
  misc_feature 101: r=a or g
aaattagccaggcgtggtggcgggtgcctgtggtcccggctgctcgggagtctgaggcaggagaatggcgtgaacccgggaggcagagcttgtttgcagtragccgagatcgcgccattgcactccagcctgagcgatagagcaagaccctgtctcaaaaaaaaaaaaaaaaa

SEQ ID NO: 24435 - DNA, 123 bp, Homo sapiens
caggagtgtggtgttggtgtcttcttaaattatttaagtaaaccttagcagatttattagtatattcctagcccaagtcaccctttacatactgttagactaaaggtctaaaaatcagccctg

SEQ ID NO: 24436 - DNA, 66 bp, Homo sapiens
tacatatgtaactaacctgcacaatgtgcacatgtaccctaaaacttagagtataataaaaaaaaa

SEQ ID NO: 24437 - DNA, 128 bp, Homo sapiens
ccttctaaatctgattcttcatcctgagtgactttatctaaaaccctgatgcagtggcttctaaactggccaccaagtttgtgtctctaaatctgcacatcttagctgtgaactagaccttcccccga

SEQ ID NO: 24438 - DNA, 362 bp, Homo sapiens
  misc_feature 220: n=a, g, c or t
  misc_feature 325: w=a or t
tacatgaagaacagaaaagtctaattttattgcacctctgccatcaacatataatgtagtgtttcatttttaacttcatctttctaaccaagtttcttctctaggagaaacaaaaatatgattgcatcccccttggtatattatagaatggtatctttacattattctataattttgagttatttttgagcattctggttttttccccagtatgactgtntaaagatgtgtttgctatccttgaacaaatatcctgtaatatctgtgaaaaggcccctgcagactcttgaatacacggcgacttctctagaatacactgtgactwctgttacttttgatttccccatggtggctctcagggc

SEQ ID NO: 24439 - DNA, 150 bp, Homo sapiens
  misc_feature 121: s=g or c
  misc_feature 122: r=a or g
taggccaggcgtggtgactcacacctgtaatcccagcactttgggaggctgaggcgggcggatcacctgaggtcaggagttcaagaccagcttggccaacatggtgaaactccgtctctasraaaatattttaaaaaattagccaggcaa

SEQ ID NO: 24440 - DNA, 298 bp, Homo sapiens
  misc_feature 45: w=a or t
gtcacagaagcctagataaagaaacaagatttcaggcaggaagawataataaagaggcaggacttcaagtgtcctgtgaaacacaacattcggcctccggcacacacatccgtgggagatggctcaacttctttataaagtgaggaaccaaattgtgaagacatctgttctgttattaatttcacatacatcttaagctcctcaaggccagaaatgaggcttcattcacgtcgaattaatgaaacatgattctacattttcaccccatcccgggctccatgttcctgctgcactccac

SEQ ID NO: 24441 - DNA, 108 bp, Homo sapiens
tcggtttttgccattgaataatgataaaccaatattggtacgttattattaactaaaatgcatacactattcagattttctgatttctttctttaacataacatcgca

SEQ ID NO: 24442 - DNA, 110 bp, Homo sapiens
aattgtgcaggttagttacatatgtgtacatgtgccatgctggtgcgctgcacccactaactcatcatctagcattaggtatatctcccaatgctatccctcccccaata

SEQ ID NO: 24443 - DNA, 171 bp, Homo sapiens
tatactgattgggagtaaatacttttgctatgggagcacataacaaacatggttgttattaggttctaaaatattatcagagtgtttgaaattttccaagcaattcagataacaccctacaattttctttcacctataaataatgaaaagctaatcctcagtgcagcctta

SEQ ID NO: 24444 - DNA, 118 bp, Homo sapiens
cacaatagaatgctgctgactgttttaggatgatgctttaaagagccttgagcagattgcacagcctaaagttgatactctcttttccctttcttatagtcgagtaatccggccgtta

SEQ ID NO: 24445 - DNA, 114 bp, Homo sapiens
catgcattaaccattgtggtatctacccatgggaatattatagcagaataatttcactgccctaaaaatcttctgtgctatgcctattcatccctcacacctcccaaccccgag

SEQ ID NO: 24446 - DNA, 407 bp, Homo sapiens
tcataaatggtgtgaaaagattcaaggttagaaaggtcatttgggtcaaatcatcaagagccttgaatgacaggctaataagctctttggactaatgctttgcaaggtttttcacattatcaaacattgaaaatgataatattttaatggtatattaggataaacagaaactgcttactgctagaggtgatgacaagagatggggagagcatgccccaggtcccactggacaccccaagggctacagggatctcagcacttctgtaatccttccaaggcacatctaagttaggaagaagataagatttgtagtttcagatttcatctagacatttctctcaaattcaatttaaagctgttttgtgttctgcccattttctcccctccacacatacatacgcatcctt

SEQ ID NO: 24447 - DNA, 170 bp, Homo sapiens
  misc_feature 144: m=a or c
gaattagctgggcatggtggcacgcgcctgtaatcccggctggtcgggaggctggggcaggaggatcgcttgaacctgggaggcggatgttgcagtgagccgagatcgcgccgctgcactccagcctgggtgacggagtgagamtccacctcaaaaaaaaaaaaaaaaaa

SEQ ID NO: 24448 - DNA, 348 bp, Homo sapiens
  misc_feature 123: m=a or c
  misc_feature 313: s=g or c
attcacacagccttcaagaacctcccctgtgattcctggttaatcatgaaaaaaagaaagagcagtggccggttgcggtggctcacacctgtaatcccagcactttgggaggccaaggcaggmagatcacaaggtcaagagattgagaccatcctggccaacatggtgaaaccatgtctactaaaaatacaagaattagctgggcatggtggcacgcgcctgtagtcccagctacttgggaggctgaggcaggagaatcacttgaacccaggaggcagaggttgcagtgagctaagatcatgccactgcagtscagcctggcaacagactgagactctgttaaaaaaa

SEQ ID NO: 24449 - DNA, 175 bp, Homo sapiens
  misc_feature 173: s=g or c
tgttcaagcgttggaaagaattttgtcgacctttctgcttcattggcatttctttacgttttcctggtaaccagagacaagttgcacaatcggtgtggcatttggctcctgattctgggggagagggagcgctgtctgctttttcagcaggcccagcacagtggagcgcggasaa

SEQ ID NO: 24450 - DNA, 182 bp, Homo sapiens
  misc_feature 34: n=a, g, c or t
tttgtcttttactgctttcaaatggtcgtgagtnggaattttccaattagtatttttagagacttctctaggtgaatgtttatggtagcctacaagctaccatacaaaattacaaaaattagctgggcatggtggcacgtgcctgtagtcccagccactcgggaggctgagacaggagccca

SEQ ID NO: 24451 - DNA, 281 bp, Homo sapiens
atatctatagtgccatgctagtgagtcccacgaattcagttcccacgccaaaccagaccccatggcctgctcagcctcagcggactttccgtgacatttctgaagatctgaaatcttcagtaggttgatgtggtttcctctgcagtgatttttctaggaagttcaaatttgacagcgagttcagctcagctgtggccttctgcccttccagctgtgcctagcaagcaaaacccaggaaagaagcagaagcctcctggccttacatacagaatgcctggtac

SEQ ID NO: 24452 - DNA, 121 bp, Homo sapiens
  misc_feature 72: w=a or t
  misc_feature 73: w=a or t
ctcaggaagtggggactgctaattggtcaggttggagataaaaccaacaggaaccatgaggttgaggtgagwwtttctttcttttttttgagacagagtctcactctgttgcccaggcagt

SEQ ID NO: 24453 - DNA, 176 bp, Homo sapiens
ccaatcgctgcccccaccacaggaacaccaaatttaacaactatctacacaaaaaagcaccttcacaagaaccaaaaatcaggtaagtgatcacagtacctgattttaacttcatattgctgaaagagacactgaagagagtaggaaagacagttttcgattgtctactaccccat

SEQ ID NO: 24454 - DNA, 439 bp, Homo sapiens
  misc_feature 150: k=g or t
  misc_feature 151: r=a or g
tcagcttgtcaagttttttaaaaaaatctgctggatttttgacagggattatgttcaatctgtgagccaatttggggagaatctccatcttaacaatactgaatcttcagatccatgaatatgatttgtacctccatttatttaggtctkrtttaatttttagcaatgttttatagttttcagtgtacagatcttacataaactttgttacatttaccccaaactatgtcatattttttgacggcattgtaaatgaaattgtattttttattttattttattatttatttatttattttaattattatactttaagttctagggtacatgtgcacaacgtgcaggtttgttacatatgtatacatgtgccatgttggtgtgctgcacccattaactcgtcatttacattaggtatatctcctaatgctatccacccgat

SEQ ID NO: 24455 - DNA, 203 bp, Homo sapiens
gttccatgtgctgataaaaagactgtgtattctgcagatgttgaatgaaatgttctataaatgtccattaggtccattttgtcttaagtgcagttttaatcaaatgtttctttgttgcttttctgtacagatgatctttccaatgctgagattgagccattgaagtccccaaatattattgctttggaatctatctctcccct

SEQ ID NO: 24456 - DNA, 237 bp, Homo sapiens
cctgaaagatagattctgtggtattcttttgatggctactcctgaaaatacttcagcctctcaagggttgtttttaatgtttatcaagatttttctttataggagtccctttcaacttattagacttgcttccttgcttttttctaaaaattaaatgtgatccactatctttaagaaatgttaactcttccactgtctgtactaagaacatgagacaagaccattctctacccccct

SEQ ID NO: 24457 - DNA, 155 bp, Homo sapiens
taacagtttttatagatcttttagtttcaactcagcttttacaataaaaaggatttgtattgcattgagtttataaacttttggtttgtgaacttcatatttgatcttttctcttccaatcaaatgtctaggcttgtttgacttccacccccaac

SEQ ID NO: 24458 - DNA, 95 bp, Homo sapiens
  misc_feature 12: v=a or c or g
  misc_feature 13: n=a, g, c or t
aataaggataavntcaaaggcacacccacggaaaaaaaatgcatgctctttcactacataaaaggtttgtcttctaaatctcatcgcccctacca

SEQ ID NO: 24459 - DNA, 88 bp, Homo sapiens
taaaaatacttttctctagcatcgtaggaggaagaaaacaaacacatcagatattttcagcactaaaagagatggttttccccacatg

SEQ ID NO: 24460 - DNA, 397 bp, Homo sapiens
taacattcctccccgtggaggccacctggacttccagtctggctccaaacctcattggcgccccataaaaccagcagaactgccctcagggtggctgttaccagacacccagcaccaatctacagacggagtagaaaaaggaggctctatatactgatgttaaaaaacaaaacaaaacaaaaagccctaagggactgaagagatgctgggcctgtccataaagcctgttgccatgataaggccaagcaggggctagcttatctgcacagcaacccagcctttccgtgctgccttgcctcttcaagatgctattcactgaaacctaacttcacccccataacaccagcagggtgggggttacatatgattctcctatggtttcctctcatccctcggc

SEQ ID NO: 24461 - DNA, 146 bp, Homo sapiens
  misc_feature 121: s=g or c
  misc_feature 145: d=a or g or t
  misc_feature 146: r=a or g
aaaaattagctgggtgtggtgacgcacgcctgtaaccccagctacttgggaggctgaggcaggagaatcgcttcaacctgggaggcggaggttgcagtgagccaagatcacaccattgcastccagcctgagcgacaagagctgdr

SEQ ID NO: 24462 - DNA, 109 bp, Homo sapiens
ccaggtcggaaacggagcaggtcaaaactcccgtgctgatcagtagtgggatcgcgcctgtgaatagccactgcactccagcctgagcaacatagcgagaccccgtcta

SEQ ID NO: 24463 - DNA, 207 bp, Homo sapiens
cagtatttctgaatgaatgcatggtagattattggtatagttgaccatttattgtattttttaaactttattataaacacaccataaaattttgcagcctctccaaatttttgttgaagtgggatcagaactgaaaatgtgtcttttgtgtttaattttaaaacaattcttgttcatttaaaatcaagaaaatgtagcctggacacg

SEQ ID NO: 24464 - DNA, 235 bp, Homo sapiens
ttgtgagattaaaaaaacagaaaactcaccactggcagacctacactaagcaaagactcaactttctcaggcagaagtgaaatgatcccaaatggaagatcatacttgcaggagagaatgaaagagcaacaaaaagagtgaacaggtggataaatgaacactcgctatgtaaaacagccatgaaaatgtcttgtctgggcacggtggctcatgtctgtaacccaacactgggaac

SEQ ID NO: 24465 - DNA, 400 bp, Homo sapiens
tagcaagtaccgacatggcatttttgattccctgtgcttctgtctcttgaacagtagctttaatcttcaggatggtcttttgcagtttggtcaaagagaaagcaagatattggagatgccttcacctagtgtggtttattttaaactgggagattctgtgtgctttgtatctttcaggaggactctacctgaattttctgcttataacttctctctctttttgggaggcaactgtgtgtagatacacagccacaactgagtattcacatgatgtaaaagtaatgaaagtgaccgggcatggtggctcaggcctgtaatcccagcactttgggaggctgaggcaggcggatcacgaggtcaggagatagagatcttcctggctaacatggtgaaacccttt

SEQ ID NO: 24466 - DNA, 453 bp, Homo sapiens
ctttctattggcagtgctgtaggggtagaagttaactggtaaaaaaccaatagcaacataaagtaattcttgtcagagaatcatggaaatgattccagctcattacaacgcaaacggatttgacctggtagagattaaatttattttcatctaatagaaaagctaacccccaaacattacagtttattactgtctagaatgttaatcagtttacatttgttggcaagtttatttcagcattcttttgactgaccatataaatctgtttctttcaataatttcaacttttattttagattcaggggtacacatgcaggtttgttacatgggtatattgcatgacactgaggtttggggtgtgaatggtcccatcacccaggtagtgagcatagtaccccataggcagtttttcagtccttgccccactccctctctcccgcctctagtagtctc

SEQ ID NO: 24467 - DNA, 213 bp, Homo sapiens
tgggtccttagaggaaatcatctcttttcaagttgttagcttttccaggaagttgactgtttatatatctaatgctcatgacttgattttgaagtatgccttcaaacatatttgttggacttaaaataactaaaatggataatactgtatttctggtaaaatggcatctttctgggtcagatctttctaaatatcaatgaataatgagggtcg

SEQ ID NO: 24468 - DNA, 229 bp, Homo sapiens
  misc_feature 104: d=a or g or t
tcttgaactcctgacctcaagtgatccaccttccttagcctcccaaaatgctggcattacaggcctgagccatcgcccctggcctcaatttatttttctaagtdaagttttactggagataaaaaggaaggagatgatactcaattaagaaaaacaatctctggctatagttaatatttcaagataggcacattcacatcgatacatataaagtacaaatgcaggcaga

SEQ ID NO: 24469 - DNA, 117 bp, Homo sapiens
taatcccagctactcaggaggctgaggtgagagaatcacttgaacctgggaggcagaggttgccgtgagctgagatcgcaccagtgcactccagcctgggcaacagagcaagactct

SEQ ID NO: 24470 - DNA, 93 bp, Homo sapiens
cttccttcagatctgtgttcagatttcgtcttctcagagaggcttttggcccctgtccatctctctgaatttacctctgacctctcccccagc

SEQ ID NO: 24471 - DNA, 216 bp, Homo sapiens
cagaacttctaccaagtagttttaattgattagagctatgagaacaaattgcatccttgtatctttttaaggtgatcactagggatgctataaattttaacagtaatatgtgttttaagtttccttttcccttatttttccttctttttcatcaaacttttaaaagatctctgatttagaagggaagcgaagtagatatttgatatgggagtccgc

SEQ ID NO: 24472 - DNA, 320 bp, Homo sapiens
  misc_feature 45: k=g or t
  misc_feature 46: r=a or g
aatatgggactatgtgaaaagaccaaatctacgtctgattggtgkrtctgaaagtgatggggagaatggaaccaagttggaaaacactgtaggatattatccaggagaacttccccaatctagcaaggcaggtcaacattcagattcaggaaatacagagaacaccacaaagatactcctcgagaagagcaactccaagacacataattgtcagattcatcaaagttgaaatgaaggaaaaaatttcaagggcaggcagagagaaatgtcaggttacccacaaagggaagcccatcagactaacagtggatctctcggca

SEQ ID NO: 24473 - DNA, 324 bp, Homo sapiens
ttaaattacatcagtgaatcagcagttgtagcaagcttaggaaatgaaaatgcacctgagttgaaatttgaacttaatagaagtcacatttcagaaactcctcttgactctgagagtcctcaacaagctgaagtatcacctgatgctaaaacatctcttagccttgactgtaaaaaactaaatttcagtatttcacctcctacctttgtttctggagttgggatgctgagcaagttggatattcctgatttaatgaatgagggttctcctgtgcccattgaaactgggaatgtcaacattgttggtatttcctatcagcctagg

SEQ ID NO: 24474 - DNA, 96 bp, Homo sapiens
  misc_feature 58: k=g or t
tgtatggtcctggctgcttgggaggctaaggcggggggatcgtttgagcccgggagtktgaggctgcatggagccatgattgtgccactacactcc

SEQ ID NO: 24475 - DNA, 86 bp, Homo sapiens
attaagactatactttcagggatcatttctatagtgtgttactagagaagtttctctgaacgtgtagagcaccgaaaaccccgagg

SEQ ID NO: 24476 - DNA, 364 bp, Homo sapiens
  misc_feature 26: d=a or g or t
  misc_feature 72: r=a or g
  misc_feature 124: r=a or g
  misc_feature 125: r=a or g
  misc_feature 138: w=a or t
  misc_feature 242: w=a or t
  misc_feature 333: w=a or t
  misc_feature 337: r=a or g
gaattgattaaaaaaaaaagatccadtgatcttttgcctataagaaacacacttcacctataaagaaacacrtacattgaaaataaagggatggaaaaagacattccatttcaatagaaaccarraaaaagagtaggwttagctatacttacatcagacaaaatagatttcaagaccaaaagtataagaagagacaaagaaggttactatgtaatgataaagtggtcaattcagcaagaggwtataacaattataaatatatatgcacccaacactggagcacgcagatatataaagtaaatattattagagctaaagagagagaaaccccawtacrataatacctggaaacttcaacacccct

SEQ ID NO: 24477 - DNA, 143 bp, Homo sapiens
  misc_feature 136: k=g or t
aaaattggccgggcatggtggcgggtgcctgtggtcccggctgcttgggaggccgaggcgggagagtggcgtgaacctgggaggcggacttgcagtgggccgagatcgcgccactgcactccagcctgggcgagakggagaaa

SEQ ID NO: 24478 - DNA, 71 bp, Homo sapiens
ctattttttctagatttatagaggtataattgacaattaaaaattgtgtatattctagatatgcatgaacg

SEQ ID NO: 24479 - DNA, 78 bp, Homo sapiens
atttttagcggagatggggtttcgccgtgttggccgggatggtcttgatctcctgacctcatgatccgccgcgccact

SEQ ID NO: 24480 - DNA, 70 bp, Homo sapiens
ctggtgcgctgcacccactaactcgtcatctagccttaggtatatctcccaatgctatccctccccgcat

SEQ ID NO: 24481 - DNA, 189 bp, Homo sapiens
  misc_feature 183: s=g or c
ttttttttcttttttatttattattattatactttaagttctacggtacatgtgcacaacgtgcaggtttgttacatatgtatacatgtggcatgttggtgtgctgcacccattaactcgtcatttatattaggtatatctcctaatgctgtccctcccccctccccccacccctcgccagtscgcggc

SEQ ID NO: 24482 - DNA, 426 bp, Homo sapiens
  misc_feature 329: k=g or t
  misc_feature 394: r=a or g
  misc_feature 412: w=a or t
caattatattatgatcctaaatttcttattccccaacttatgatcgcttcaccttctttttttccttattggtcagttttaaaggttgcatttcttcttacataatacttagagactaaacaaattctccttttataaagttgagaaggtgactgaataatttccatccattgaatagacattcaagtaaacattcatgttaatagattttaaaattattttccagaataaatactaacaaacctggcaaaaaagatttaaagtctcataatgaccatttttgtcaagaacatactgtatcctggtgagcgatgaatatattgtatgtkcttttcctgtaactagtaggttacatttcttatggcagtagctttagctcttaacattgtttagrattcatttagaaagaagwaatttctttgagaa

SEQ ID NO: 24483 - DNA, 66 bp, Homo sapiens
gggaattacagaatttagctgggcgtggtggcacacatctgtagtcccagctgctggggaggccac

SEQ ID NO: 24484 - DNA, 90 bp, Homo sapiens
aagactatactttcagggatcatttctatagtgtgttactagagaagtttctctgaacgtgtagagcaccgaaaaccacgaggaagagag

SEQ ID NO: 24485 - DNA, 128 bp, Homo sapiens
  misc_feature 42: k=g or t
  misc_feature 43: k=g or t
tatggctgtgattatctatctgtagatgctttctacatgagkkggcttacttcagatttctctcttgagattcagccttgcgcacccagctgacaattgatgtctaactcttttcttttccccaaaaa

SEQ ID NO: 24486 - DNA, 143 bp, Homo sapiens
aaaaattagctgggtgtggtgacgcacgcctgtaaccccagctacttgggaggctgaggcaggagaatcgcttcaacctgggaggcggaggttgcagtgagccaagatcacaccattgcactccagcctgagcgacaagagct

SEQ ID NO: 24487 - DNA, 99 bp, Homo sapiens
ctatgttctggctaagtgctgtgttagaaaactacttgctaagaatatgtaacaagttgggaattagaactctcctcctgtttgttttttttttttttt

SEQ ID NO: 24488 - DNA, 183 bp, Homo sapiens
cttgaattcctgatatcaagtgatctactgccttggcctcccagagtgctgggattacgggcgtgagcactgcgcccggccttatatttttaaatggatcatactttagatattattttgtcaataagtagtctcctgctatgatttaaaattgtaccttatatcaaaataatacatgtgtat

SEQ ID NO: 24489 - DNA, 71 bp, Homo sapiens
aagactatactttcagggatcatttctatagtgtgttactagagaagtttctctgaacgtgtagagcacca

SEQ ID NO: 24490 - DNA, 344 bp, Homo sapiens
  misc_feature 19: k=g or t
actttgggaggccgagaakagcggattgcctgagttcaggagttcaagaccagcctgggtgacacagtgataccctgtctctactaaaatacaaaaaattagctgggtgtggtggcacgatcttgagtcactgcaacctccgcctcccaggttcaagcatttctcctgcctcagcctcccgagtagctgggactacaggcacaagccaccacacccagctactcgggagctgaggcagggggatcgcttgagcccaggaggcagaggttgtggtgagttgagatcatgccactgcactccagcctgggtgacagggcaaggcctgtctaaaaaaaatgttttgt

SEQ ID NO: 24491 - DNA, 368 bp, Homo sapiens
tgttttttataaaatgtaaaattaatttaagcagctaagtctattaatgccaaagagtaaatctatttaagtgaaacattattttcatatgtaagcttttttatgaaaaaattttatgaaaaatattaatggaagtttttttcttatatactgagtcatttaccttatttgatatatgttcttgaaaagcaaatatatttttcttactatccctcttaggagatattaaaaagtcatatataatatatatattttttacaaccagtgatgcagcatttgcacaattatctctgaaggttttattccggaatgcttctgcaccagaaagaaggttctagacataggtatccgcaactacagtgatcacc

SEQ ID NO: 24492 - DNA, 173 bp, Homo sapiens
  misc_feature 19: w=a or t
agggggagtgaaaactagwggagggcgaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagaccccgccc

SEQ ID NO: 24493 - DNA, 85 bp, Homo sapiens
acaagattaggcacaaacttcatgaaatcatatttctaatgacttttttatttaccaaaattctaatttgttctttttttttttt

SEQ ID NO: 24494 - DNA, 391 bp, Homo sapiens
  misc_feature 281: y=c or t
cgactcttagcagttggatcacgaggtcaagagattgataccatcctggccaacatggagaactcccatctctactaaaaatacaaaaattagctgggcgtggtggtgtgcatgcacctgtagtcccagctacttgggagactgaggcaggagagttgcttaaacccgcgaggtggaggttgcagtgagcccagatcttgccactacacttcagcctggcaacagagtgacactccatctaaaaaaaaacaaaacttacagtacaccttttgttagctgtycttgaatttttccttcagtttggactaaatcctaaattctctgtgggctaaaagtccccaaactaatgctttcaaatctttacttttgaaactgggaattgcactcctca

SEQ ID NO: 24495 - DNA, 297 bp, Homo sapiens
taattaacaaagttgctactacatctgcaaagtttaatcgaaaaatttgccagtgatatgatggccttgtcacagagatcacaagggacacggagttgacttttgctcaaggtggaacgacagagctgtgtaggcaagatgagaaattgcgaacttgttcggccaaaggtatgtttctttcataattccacatcctaggttttcttattaagatttttgtttgatggttcatgggttctttttttgtttcttgaccgaaatgattcagaaaaagatccgtatgcttttcgggcagat

SEQ ID NO: 24496 - DNA, 216 bp, Homo sapiens
  misc_feature 2: y=c or t
  misc_feature 46: b=c or g or t
  misc_feature 47: w=a or t
  misc_feature 56: w=a or t
  misc_feature 65: w=a or t
  misc_feature 85: b=c or g or t
cyaggatccattcgaggtttgcccattgtcttggttgacgtgcctbwctattttawttatttatwtatttatttattttcagacbggtttcactcttgctaggctggagtgcagtggcatgaccacagctcactgcagtcttgacttcccaggctccagtgatcctcccacctgaagcctcccgagcagctaggactacaggcatgcaccactacg

SEQ ID NO: 24497 - DNA, 402 bp, Homo sapiens
  misc_feature 20: b=c or g or t
atggaaaaatctatcagccbcacttcagttgctattattaaacagcttttagtcagtcagatacgaagtgatccccaattccactagtagattcatgctccgttcattatcactgttcacagtagcttttctaaatgtttttcacttatcctgggtttctaagtctgcctgattccttcagctttggacgctgctcctatgtcctgttgaagtgaaaagatcaaggctgcctgatctcctttaacaaacaactgtaacctgcccctctttgatttacgatatcattgtcatcattagtcctttttctctctcctattttcgggaaaatattaccctcttcttttaaaaagttaatccacacacatgctcttaattttacccatttccattcattcttcaatt

SEQ ID NO: 24498 - DNA, 184 bp, Homo sapiens
  misc_feature 19: s=g or c
ttcagtctcatagccaatsagagtgtctcttgtaccatctcaagactttgtctctggatgtgcagagaggaatggaggaagggcatttttcttaggttggtttgggaggcctgaggtggcattggagctgagacctgaatgatctgcattctaaggcaaaggtcttgaggtgcagtgatgagca

SEQ ID NO: 24499 - DNA, 141 bp, Homo sapiens
  misc_feature 138: m=a or c
atccaaactgactttttgcaaataatttttccctcactgcaaattagaggaaatatacaactccttttcctcttttctcctaacgtttttgagaatggaaatgatattcaccttttgtttgtctgtttctcctctcamcca

SEQ ID NO: 24500 - DNA, 199 bp, Homo sapiens
  misc_feature 98: n=a, g, c or t
tagcaagtctgaagtcatagtattttattttattattttattttattcttttgtttgagatggagtctcactctgtcgcccaggctggagtgcagcgncatgatctcggctcactgcaagctccttctcccgggttcacgccattctcctgcctcagcctcctgagcagctgggactataggcacccgctaccacgcct

SEQ ID NO: 24501 - DNA, 90 bp, Homo sapiens
cattttaggggttctaatgtacatggtaatgtgtttttcatttcaaattccacttgttcattgctagtatataggaaatgatgaactttt

SEQ ID NO: 24502 - DNA, 96 bp, Homo sapiens
  misc_feature 20: k=g or t
  misc_feature 34: r=a or g
  misc_feature 35: r=a or g
  misc_feature 46: r=a or g
  misc_feature 58: h=a or c or t
tgtatggtcctggctgcttkggaggctaaggcgrrgggatcgtttragcccgggagthtgaggctgcatggagccatgattgtgccactacactcc

SEQ ID NO: 24503 - DNA, 127 bp, Homo sapiens
caggggacttggcagacgcgagagaacaccacagatatttggcaggatgaatcagaatgctcagagaaccacagcttcagacaaaacgtggatcactacgccttgctatacaccttgcagctgatgt

SEQ ID NO: 24504 - DNA, 150 bp, Homo sapiens
ttgcaacctactcatctgacaaagggctaatatccagaatctacaatgaactcaaacaaatttacaagaaaaaaacaaacaaacccatcaaaaagtgggcgaaggacatgaacagacacttctgaaaagaagacatttatgcagcctata

SEQ ID NO: 24505 - DNA, 87 bp, Homo sapiens
tataacttttttactttataaactttaaaattttttaaactttctgatccttttataataacctttagtttaaaacacaaacagccc

SEQ ID NO: 24506 - DNA, 193 bp, Homo sapiens
gtaggttaataatttaaatttgttcagcagctctcatttttgcatttataacttcttgaaaaatgaggaagtgcatttgatttgttgtagatataaatactggtttaagatcaggaattctatttttctttcctctgagaaaggtgttctttgatgtacatctcttgcaactctgatacttggaagttggatc

SEQ ID NO: 24507 - DNA, 226 bp, Homo sapiens
cttagagcccagagatgggaggaaaattaaccagaggcaggtatttgaaggcagtgggacaggaagaggcttgttctggacttccaaatggcttcctttaaaaagaggcatttaaatttttccagttgctttttatagttgatctaggatagaaaaattatggccatcatggtttcctttcatattgttaaaaatgatcaaggggactttaagattttatgagaaa

SEQ ID NO: 24508 - DNA, 188 bp, Homo sapiens
  misc_feature 148: y=c or t
  misc_feature 162: r=a or g
  misc_feature 174: r=a or g
  misc_feature 183: r=a or g
  misc_feature 187: r=a or g
  misc_feature 188: r=a or g
tgatttcttaccaccaacttcatccctccctttctttaaaaataaagggaaataataaaatttatttataaaactttgtggcattccacaaaataattctgaaagaattagtatggccaaaaaaatatgtatggtgtttttttttttyctatttttaaccarggaaaaactgtrgagtgagtragtrr

SEQ ID NO: 24509 - DNA, 230 bp, Homo sapiens
  misc_feature 111: y=c or t
  misc_feature 117: y=c or t
ttgtagtcggtatatccaggatactcaaaagtatccaaagtcctcaaaaactcagtcatagacaatgcagcaggtctatggtttatgtaagaacagattaacatttatgtytaagtyactattagatatttaaggaatgtatgtagaacttcaaaaaatgtttctctttaattaacctttctgattaaccaacaaactaatggttcctgcagcattgaacagagagccgt

SEQ ID NO: 24510 - DNA, 326 bp, Homo sapiens
  misc_feature 136: k=g or t
taaaattggttaaaggactgatttgtcagacctttatctgacctatatcagaatatataatgacatttataaatttattatatccaactactccagcaaagccactgtattagaactcaaaacttattttaatggkaaattttgacccacatgatgtgatgcatggtgtcccacaattttgtataagatgttttttttgaaaccccacttaagaaatggaagaatgtcttacggttaaaatatgtatgtacacaaatataaaacaaatgtttgtgcaagtgttttcaatgcttgaatatgtcctcctatagtatattacaagcagc

SEQ ID NO: 24511 - DNA, 455 bp, Homo sapiens
  misc_feature 138: w=a or t
  misc_feature 418: w=a or t
tactttttttgaggatttttatttttgtttttgcttaaacatatagtttgtctagaagtttaaaaagctaaaagttaaaaatggtgtaattatgaaaatctaacactcaagatagtttctaaaaggaaatcagtagtwaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataggaaatatttgtactcctgtccaggctgcaggacctttcttcgagagcwttgcacacttgacttgaaccacattttctgatccttt

SEQ ID NO: 24512 - DNA, 180 bp, Homo sapiens
gtcattagataacaaggaaatataagcaggctctttggcaaacaaccaaaagctagtaatgcagggagtgggagtgccactgtggaaatttctacgctcccttagtgattttgtgtaagatttcgggaagcctgggctcacaatagaaaagtaggagctatttgaataggaagagaggta

SEQ ID NO: 24513 - DNA, 264 bp, Homo sapiens
ttttaaaaagatcattagtgtctctaaggaaaaggggagtaaaactagtctctgcccaactaaaggtttataatcatagcaaactagtactctaatgaatttaaatgaccacaaatgattcctcaaacttgagcagcacactgctaacaaatgaaaaggtttttcgatctgtgccctagttcattttattttgctatatgcatatgtgtatctacttatgcacaggtacacacacacgcactgtaattacatcacaacaccccg

SEQ ID NO: 24514 - DNA, 225 bp, Homo sapiens
gatgtcataagtaagctttgacatcagtgctcaccaatggcttcttgttgacaagcccaaactttcaggccttaccttagatcagttatcagaagcatttggcactgttccaacttcttgaaactgtccacttttggcttctaagacattgctaagtcctggttcttttgtatttcttgctgccccttattagtttttatcatggaacccccccttccccctccc

SEQ ID NO: 24515 - DNA, 321 bp, Homo sapiens
  misc_feature 49: r=a or g
  misc_feature 64: r=a or g
  misc_feature 247: n=a, g, c or t
  misc_feature 281: m=a or c
  misc_feature 310: y=c or t
tctgttaaaaatgaaggcgacacacacacgttaaccaaggtccacacarggtcaagattatcartatgactgtcttccacctccacatcttgtcccattggaaggttttaggggcagtaaaacaggcatggaggtgtcatctcccttgataacaatgtcttgtcttggaatacctcctgaaggacctgcctcgggggtcccccccactgccttgaaactctctggctctgtcaacctggctggagtncagtagcacgatctcagctcactgcaacctccamtttctgggttcaagtgatccttgtctctyagcctcccaaa

SEQ ID NO: 24516 - DNA, 170 bp, Homo sapiens
cactcacagatttataactgcaggcttggctccttccgggagcttgagacccactgccgcctccgcaacacctccacctgggagtttcagaggcgctctccctcagcgtgtctgcagctgcgtgcctgcagctgcgtgcctgccttctccctgcacctgctccactcccc

SEQ ID NO: 24517 - DNA, 163 bp, Homo sapiens
ccatttatcaattgatcagtgattgatctataagtttatttatttaccatcataaccatttctaagtgcattcacattgttctgcaaccatcaccaccacccatcccagaactttctcatcatcctgaaccgaaactctgcccattcaacaactcccgatcca

SEQ ID NO: 24518 - DNA, 151 bp, Homo sapiens
ttttctctatttctgctgtttgctttttaatttattggcgtgatgtggaaattgattagatatgggtgagatagggttgaatgaaagattactccaaggtttctttggtagggaccaggtagatggtggtatttaccagctgaagtggaaa

SEQ ID NO: 24519 - DNA, 165 bp, Homo sapiens
  misc_feature 102: m=a or c
  misc_feature 109: m=a or c
  misc_feature 118: w=a or t
  misc_feature 126: w=a or t
  misc_feature 127: r=a or g
cggatggatctcctgaggtcaggagttcaataccagcctggccaacatggtgaagccctatcctactaaaagtacaaaaattagccggggatggtggcaggmacctgtmatcccagcwactcgggwrgctgaggcaggaaaatcacttgaactcggcgggggcta

SEQ ID NO: 24520 - DNA, 115 bp, Homo sapiens
ttgatgatacgtaaactatgaaccaagaatcagagtattctagacatgttggaaaggatcttgggtcagtacatggcagtcataaatatgggcaagggaatatatccaatttttt

SEQ ID NO: 24521 - DNA, 177 bp, Homo sapiens
  misc_feature 81: k=g or t
  misc_feature 136: k=g or t
agtagctgggactacaggagcccgccaccacgcctagctaatttttttgtatttttagtagagacggggtttcagtgtgtkagccaggatggtctgggtctcctgacctcatgatccgccaacctcggcctcccakactgctgggattataggcatgagccaccgtgcccggctgat

SEQ ID NO: 24522 - DNA, 109 bp, Homo sapiens
cactcgcctcttttattcttgtaaggattgggcatacaaacgtttcttctcaggaatcaaagaaggctctcatgagaaactgcctccccagcacctgagggccccacca

SEQ ID NO: 24523 - DNA, 291 bp, Homo sapiens
caggtcgttaaagtagtttaaaataacgtattccttaattttcctcagcaggttccccctccctttaacttgtgtgtataaatatatgtgtgtgatgttttctcttacaaagatagtactagtggttataagttttgagataacttttggcaagccttttcaaacctaaaaagcaagtgctggcaagtgctaaaaatacatacgaattaacctccactttggtgaaactcatggtaagaatatgtgagaagttaaggtttcaaataactgccctcctcatccccacccgct

SEQ ID NO: 24524 - DNA, 278 bp, Homo sapiens
  misc_feature 128: w=a or t
  misc_feature 236: m=a or c
  misc_feature 237: w=a or t
  misc_feature 242: m=a or c
  misc_feature 243: w=a or t
  misc_feature 268: m=a or c
atctgcaattctgaaatccaaagggctctgaaaaccaaatgctgcttttgttaattgatttggtggaaaacttgatctgaaccagtgtgagactatttgtagtctgtcccacactgcgggcatacttwtatttattattattattattattattattattattatcattttgaggcagagtttgctcttgttgcccaggctggagtgcaatggtgcgatcttggctcactgcaacmwctgcmwcccgggtttaagcaactttcctgcmtcaccctcca

SEQ ID NO: 24525 - DNA, 274 bp, Homo sapiens
  misc_feature 59: n=a, g, c or t
tttacttctaaaagaatcccgttatgtcgacaaattaacagccttatccccgcaggagnagccttgtgtggcccacttgccgttttttcctcggtttacttaatgtgttcgtgtggctttgctagagttttaagtagtgatggttaaatttttaaatttttctggaggtggtagtgagtcatcaaactctgaggcctagacttatcggaaggcttgtatatgtgtggtttaaaaaaaaaagaaaagagtaagtgaccgttttctgatcagctat

SEQ ID NO: 24526 - DNA, 56 bp, Homo sapiens
agccatgattacaccattgcactccagcctgggcgacagagcaagactccatcaaa

SEQ ID NO: 24527 - DNA, 104 bp, Homo sapiens
taaaatgaaaagacatgtttggcttatgacttaaaacagtcaaacatgtttggtcaaaataatacatatactaacatctgagtgctcagctgtagtcctaccta

SEQ ID NO: 24528 - DNA, 157 bp, Homo sapiens
  misc_feature 50: s=g or c
caggatattatggagccaagatcttggtagaacaaggaaattcgagagtsacattgggacaaactttcccctagaggcatatcttctgattcttaaagaggcagctgagaggctagaaatctttccagcaaaacttacttttttttttttttttttt

SEQ ID NO: 24529 - DNA, 225 bp, Homo sapiens
agtctgtccgtggatactgtgaacatcaggctactcggccgggctcctgcgctcagggcttcgagaaatgctcattttggggctgcccctctgccggcctctctggattcagagggcagccgctgctccttttgttttgtgggcctggctctgggcccggagcagcacctccctggggaggccgcctttccttccgcggcttcttccgtctcctcctgaccccga

SEQ ID NO: 24530 - DNA, 193 bp, Homo sapiens
aaaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaact

SEQ ID NO: 24531 - DNA, 211 bp, Homo sapiens
tgtttcagaaataatcttgaaagttctttgaggctgggggtggtggcacacctgtaattccagcactttgggaggccgagatgggtgaattacctgaggtcaggagttcgagaccagcctgatcaacatggtgaaactctgtctcaactaaaaatacaaaaattagctgggcgtggtggcagacgcctgtaatcccagctactcaggaggc

SEQ ID NO: 24532 - DNA, 82 bp, Homo sapiens
attcggtgggctgaataacaagttatctaataatttatctatctctctctgtgtctgtttctgtctccttactaccctgcct

SEQ ID NO: 24533 - DNA, 176 bp, Homo sapiens
taggcactctgacagaaacaaagaccgaatatatttcatattataccacaatagatctatagctgtagctggcatttactgagcactgttgcactatttattgccactattgacctaacaagtcagcattattctaagtgccctgtgtatattatttaatcctcacacaacagcca

SEQ ID NO: 24534 - DNA, 114 bp, Homo sapiens
tattattagaactacttgagaaccagtacccattggcccaaatataaggtataagtataaataaatccataactataactgttattattgatataactacacacacacgcgcca

SEQ ID NO: 24535 - DNA, 327 bp, Homo sapiens
  misc_feature 299: h=a or c or t
gcacactttattgtacttcgctttattgctctttgtaggtattgagttttttacaaattgaaggtttgtgacaaccctgtatcaaggaagtctatcagtgccatttttttccaacagcatgtgctcactttttatctctatgtctcatttggtaattcacataatatttcaaactttttcattaataaataactgttatggtgatctgtgatcagtgatatttgatgttagtgttgtactatagggtgccaataactctgcctatacaagatggtgtacttaatcaataaacgtgtathctgactgccttaccctccattccctcat

SEQ ID NO: 24536 - DNA, 286 bp, Homo sapiens
aacaagtgtttgataatcagaaatgaaaaaaaatccataaattgcttaaatcagattcttcacttagttttagaagttgggttggcatgaaaaatgaatcaatgacgcttacaatggaaaggaatactatgcttttctcttgtaccttctttaaaataattttatagttgatccctgaaaaatacaagtttgaactacaccagttcacttatatgtggatttttttcagtaaatatattggaaatttttttggagatttgtaacaatttgaaaaaactcgcagatg

SEQ ID NO: 24537 - DNA, 224 bp, Homo sapiens
ccataatacatttttagtagtgggattcttcagttattgccgaatacaggagtcagcaaaatcactgccgccctccccaccccacagtggcttgcaacagtggctgcaggtctgctcatctggttttctttggaatgtcttagaaaatataagtttgagaaattatttagaaatttaaagataacgttggaaattgagtgtgtaacttccaggagaggggaact

SEQ ID NO: 24538 - DNA, 176 bp, Homo sapiens
ccacaagcaaagtttgcactgggcccactgccgagtccagaggccggagaacggccactggtgtgggaggggagcgcacgagtgggactttgcacagcaaattgtgtccccagctcctcctctcccgcctgcctggagccggccctgaaggtttctatgaagaaataatcccccgt

SEQ ID NO: 24539 - DNA, 193 bp, Homo sapiens
tgaaatacaatcatttcccagctcttcccagacccttccaagatgaggttagccagactactctaactactccttgtagcgttgcccgtgtctttcacaattttaaggtgtctactggaagaaaggattcctgttgccaggacagttgggagtggaatatttgtaattcaccctcaaatactatgctccaatc

SEQ ID NO: 24540 - DNA, 158 bp, Homo sapiens
  misc_feature 156: b=c or g or t
  misc_feature 157: d=a or g or t
  misc_feature 158: r=a or g
ttgtttccatagagaaaggttacaagagaagagttctgtctcttggaaacttttgagttctttccaaacagctctttttggacacatatgagaatctagtaagggctgtaactgataggtcccttccttccttggggagttttctctagcccaccbdr

SEQ ID NO: 24541 - DNA, 220 bp, Homo sapiens
tataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgta

SEQ ID NO: 24542 - DNA, 136 bp, Homo sapiens
tttttctatttttagtagagacagggttcagtagagatgccatgttggccaggatggtctcaagttcctgacctcaggtgatccacccgcctcagccttctgaagttttgggatcacaggtgtgagctgccgcacc

SEQ ID NO: 24543 - DNA, 400 bp, Homo sapiens
  misc_feature 85: r=a or g
  misc_feature 86: d=a or g or t
  misc_feature 121: n=a, g, c or t
  misc_feature 168: m=a or c
  misc_feature 226: w=a or t
  misc_feature 289: v=a or c or g
  misc_feature 330: s=g or c
  misc_feature 331: r=a or g
  misc_feature 349: k=g or t
tattcctctctattttatgtttacatatgcatcgtcttatctgtcttcccaggtgacaagctctgtgaaagctggaatttcatgrdgggctcttcgaggtaaagcccagcccctataccantgcttgggtcctcagtagacactcaaaaaatctttctggtcataggmagaattctaagatggccccatgatctctaccacctgctgttactactatgattatgtwatccaacatttcaaaggttctttgaagatgtagttcaggttactaatcagttgggttaaagavaaaatgatgatatgggtgagctgaacctaattatttgagtsrtttcaaagcagataattktcttttgcagcacaggacaaagtaaaaaagattcaaaatacaagaaggagt

SEQ ID NO: 24544 - DNA, 294 bp, Homo sapiens
cattggcttgtttgttgtctctttgcattagatatatgtaagctccttggcataaatttgacattggtaggtagtagggggtctccagtggctcaaataaaatgaaattaggttgacagggcaggacaaattttatttgtggagagttagatacgagcatcaaccctaagaatttgcattctgtctttggtcttcccagtagactaaatcctactaatttttccaagccagctctcaagtttttaacttttgctttttttctgcttttgagagtgcctatcgcaaaactttttt

SEQ ID NO: 24545 - DNA, 148 bp, Homo sapiens
gatcacctgaggtcaggagttcgagaccagcctggcctaacacggtgtaaccccatctctactaaaaacacaaaaaattagccgggtatggtggcgggtgcctgtagtctcagctactcaggaggctgggattacaggcacgcaccaa

SEQ ID NO: 24546 - DNA, 119 bp, Homo sapiens
tatttattttgagacggaatctcgctcttgttgcccaggctggaatgcaatggtgtgatctcggctcaccgcaacctcagcctcctgggtttaagctattctcctccctcagcccccca

SEQ ID NO: 24547 - DNA, 204 bp, Homo sapiens
ctctgtggcaggcctggtcaggctctccaggtggtcagagggcccagtggtgccccagcacggtggtgcccaagccaaccctgtgactgacatgtacgattcactcctttgagtctttggatgccaactcagccccctgacctggaggcagccggccaaggcctctagggaagagccccccactgcagacatgacccgagcata

SEQ ID NO: 24548 - DNA, 57 bp, Homo sapiens
aacaatatggttcctggaggagagacactggaaactttctttttttttttttttttt

SEQ ID NO: 24549 - DNA, 208 bp, Homo sapiens
  misc_feature 36: d=a or g or t
  misc_feature 37: w=a or t
  misc_feature 38: w=a or t
  misc_feature 179: r=a or g
tttacttgaggctcaatataacatgttttacttgtdwwgttggtgaagtttggtttgtatatttaggaagtggaaatatggaaactctgtgctttaaattgagaggggtacagtgaaagaaggggggtatgtagaaagttctcagaatagagggctgggcgtggtggctcacgcctgtratcccagcacttgggaggccgaggcggga

SEQ ID NO: 24550 - DNA, 428 bp, Homo sapiens
  misc_feature 130: r=a or g
  misc_feature 319: w=a or t
  misc_feature 328: d=a or g or t
  misc_feature 352: w=a or t
  misc_feature 424: k=g or t
  misc_feature 426: w=a or t
ttcagctaatttgggtagatattaataacgaggagcactattgctggattgtgttgtaagactgtgtttagttttgttaagaaaccttgaaattgtcttccaaagtggctgcaccactctgaattcctarcagcaatgaatgagaatttctggtataccacaccttcaccaacatttgataatatcagtgttttggacttttgccattttagtaggtgtgtaatgtatcttgctttaatttgtggctaattatatgtgatgtggagcatctttttatttgccatccttacatctttgggaaagtgtttctttggatctwttgcctatdttttaatcagattgttttattatwgtagagttttgagataacaggtttttatcatatataagtcttttgcaactattttctccaagtttgtggctkawct

SEQ ID NO: 24551 - DNA, 141 bp, Homo sapiens
gattcgcatgagcgtgacactcggtaccccacttcaatcttctgcatttaaagttttattgttaggttcaggagagcttggcaaagaagttgtaatttccctacaacgccttggtgtagaagtacatgcagccgaccgttg

SEQ ID NO: 24552 - DNA, 136 bp, Homo sapiens
  misc_feature 114: d=a or g or t
ccttttcaattttccagcagcattctgaggtaaaatcaatagttttcctcccaaataataatttttgagagatatataacttaattgatcatttgccaagtgagaaagtgtgtdgataatcaagctctagccccac

SEQ ID NO: 24553 - DNA, 100 bp, Homo sapiens
acattttaataaataatttattctctctgagcctcagtattctttctgtaaaatggagatagcaccttacagagttgctgtaagacttcacagtcccaaa

SEQ ID NO: 24554 - DNA, 296 bp, Homo sapiens
  misc_feature 189: n=a, g, c or t
attttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcncatgttaagttaatgttttggtggcttagagaaagagacaccaaaacattaacttaacatgggcttgccttatgtagaatactccatgtcttcctttttgccccaac

SEQ ID NO: 24555 - DNA, 124 bp, Homo sapiens
caccccagcgtggcacccccatcccaggctccgggctatggttgggcaggctcatctttaggcctagccctacctcttcccgggccccactgatgagaagcctctgctcttccaccctggacac

SEQ ID NO: 24556 - DNA, 100 bp, Homo sapiens
aacccaggaggtggaggttgcagtgagcctagatcgcaccattacactccagcctgggtgacagaatgagactcctccttcttaaaataaacaagctaac

SEQ ID NO: 24557 - DNA, 214 bp, Homo sapiens
tataagaataactacttctaggccggaagtggtggctcacacctgtaatcctagcactttgggaggcataggtgggtggattgcttgaggtcaggagttcaagactagccttgcaaacatggtgaaaccatgtctctgctagaatacaaaaattagccaggtgtggtggctcacgcctgtaatcccagctacttgggaggctgaggtgggagct

SEQ ID NO: 24558 - DNA, 116 bp, Homo sapiens
ggaggagtcttaccctaatgtaagatggtggcccgtctggctgtggaacccaccgaaagctgagagtctctctctcagccgtaaaggtcggactcgctgaagcaatcaggcccaga

SEQ ID NO: 24559 - DNA, 167 bp, Homo sapiens
gagagcaacgagaagagtgtctggaatggttgggagacattttaagcaggacaaatccagccttaggctagactgcacctgtccacagcccagcccaggcccatggaaaagaatagtaaaacctttgtctttaagcacatagaatatgtgtgaaacccagaaggcta

SEQ ID NO: 24560 - DNA, 253 bp, Homo sapiens
  misc_feature 12: y=c or t
  misc_feature 103: k=g or t
tcactcggtgcygctgcctaggggctgtagaggtcgcgccgctcctgctggggcctgcccacgccaaggacctgcctctgtcgcctcctcttctattgcccaktttccccagccagaacatcccctgaagatggcagaggagagcagctgtaccagggattgcatgtccttcagcgtgctcaactgggatcaggttagccggctgcatgaggtcctcactgaagttgtacctatccacggacgaggcaacacc

SEQ ID NO: 24561 - DNA, 126 bp, Homo sapiens
  misc_feature 109: s=g or c
tttagtggagatggggtttcgccatgttggccgggctggtcttgaactcctgacctcgggtgatctgcctgccttcggcctcccaaggtgctgggattacaggcgttascactgtgcctgagatca

SEQ ID NO: 24562 - DNA, 144 bp, Homo sapiens
  misc_feature 21: s=g or c
  misc_feature 22: s=g or c
aaattggggcaaaacgcggasstccaggctcctacgggctgtgcggtgccagggctcgactgctgagcgtcgtgggctccgagagggacgcgggcggagggcaaagtgggttcatgatatgaattgtaaaattggcgactgagt

SEQ ID NO: 24563 - DNA, 151 bp, Homo sapiens
ataaataaataacaaaaaaacccattagttttaggcaaataaataaccagttatttttaaaagtggttacttaaaatcaaagaagcaagcagacctaatatatgcttctttctttttagatttcatgtgttctttgtatacaagcgacgac

SEQ ID NO: 24564 - DNA, 258 bp, Homo sapiens
agataatgtcattttaaaggaatgtacttatttcctttttcacactttatttatactggagattcatgcaagtgttgccattatcattgaaatgacttttattaagaacctctgtgcctgaaacaaatgtgtatcagatgggagaagagcagcttcccagagtgactcccatgatgatggtggtggtggcaacaggagttgtagaccttttggcgaaatagttgaatataatacattaaatatatttctgcatggcct

SEQ ID NO: 24565 - DNA, 446 bp, Homo sapiens
  misc_feature 12: m=a or c
  misc_feature 62: k=g or t
  misc_feature 241: w=a or t
  misc_feature 245: m=a or c
  misc_feature 298: h=a or c or t
  misc_feature 336: m=a or c
  misc_feature 339: d=a or g or t
  misc_feature 353: y=c or t
  misc_feature 354: s=g or c
  misc_feature 356: r=a or g
  misc_feature 357: r=a or g
  misc_feature 387: m=a or c
  misc_feature 390: r=a or g
  misc_feature 404: y=c or t
  misc_feature 440: m=a or c
tttcaaagagamttattctgatctcaatgccaaaaagatagtttctacacatcacctgcttkctgatgtctatggtgttacagaagtgctacacgggctacagctgaagattggaatactaaagaataaacatcatcctgaccttcatctctgggcttgttccgggaagcgaaaagaccaagatcaaataatagctggggtggagaaaaaaatagctcaagacacagttaatcgagaagawaagmaatatgtacagaaccataaagaaccacctcgtttgcccctaaaaatggaagghacttatataacaagtgagcatagctatcaaaagccacmagdatttggtcaggacystrratctctcgcagaccctgggagctcagatgmtgrtgatgttagtagtytgggaagaagaacaagaattccacatgagaagtaamaacagt

SEQ ID NO: 24566 - DNA, 331 bp, Homo sapiens
  misc_feature 21: r=a or g
  misc_feature 46: k=g or t
  misc_feature 255: s=g or c
  misc_feature 279: k=g or t
  misc_feature 308: y=c or t
  misc_feature 330: m=a or c
  misc_feature 331: r=a or g
tgcacttagctgttctctttrgattctctgactgttgtcgtaagcktctttcctcaggtcagttgtacagcattgtgtcttcactcagcaatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgsactatgcagctgctaacggtagckaccagtgtgcagtaacattggtgactgcyggggcaggtgtcaacgagggcmr

SEQ ID NO: 24567 - DNA, 201 bp, Homo sapiens
  misc_feature 22: s=g or c
aaaaggggccgcgcctgcgcascgggcggaacgtagcggtgttggcgcggagtggaccccggctgcggcccctgggtgtttccacaccggtagccagctgtgccctgaggtggaagaggaccggccacccaggaattttccaacaatggcgccaccatcggtcccggagtcccagtgatgctctgtgccatagagcccgct

SEQ ID NO: 24568 - DNA, 147 bp, Homo sapiens
acagaaaagaacagaaaatggaagaaggactgaacatttttccttcattgccaaatttattcacaagtttattgaaaaacattaatctatatgtcttggaccctcagtgaactccaagtgaataaatgcagagagattcacagagca

SEQ ID NO: 24569 - DNA, 222 bp, Homo sapiens
  misc_feature 13: s=g or c
gaaatcagcctgsccgaggtgctgaaactccgtctctactaagaatgcgaaaattggccaggcatggtggcaggcgcctgtgatcccagctgctcgggaggccaaggcaggagaattgctcgaactcagggggtggaggttgcggtgagttgagattgtgccattgcactccagcctgggcaacagagcgagactctgtctcaggaaaaaaaaaaaaaaaaa

SEQ ID NO: 24570 - DNA, 471 bp, Homo sapiens
  misc_feature 20: k=g or t
caccaaaggaattaggaagktaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagttactggttaatttccttgaagtcaatagagactctctgggtcctcatccccatgcatatatgtctgggagaagcaagcattctccaaaacagggctgttgctttcttcctggccgcatatgtgactgtcttcccctagactgatggtatacttttgagaggggcggataaaggtttgcaaactttaatgggcata

SEQ ID NO: 24571 - DNA, 253 bp, Homo sapiens
  misc_feature 76: s=g or c
gtgtggccgatgcccgtcgccagtgacaccgggacaacagctgcgggctctgtgcgagcggcccagcagcgcgtasctcagcggagtgagcgagcgcggggcagtagcggcctgcgattgtgagatggggactgagaacaaggaggtgattcccaaggaagaaatttctgaagaatctgagccacatgggtcattattagaaaaatttccaaaagtggtttaccaaggtcatgagtttggagcaggatgtgaa

SEQ ID NO: 24572 - DNA, 369 bp, Homo sapiens
ttatatggcttaagaacatctgacagctcagtgaaagcaaagtggaaaagtcactgcctgggatttaaaggtgtgtctgcagcttcagcttttgaatcattgggtttagaaaccacagcccttgcttcagacaaagtcccaagaattggagtctggtgttggctggcaaccatatcattcaagttaagccaagtgaggtgagaaactaacggaatggcaatttcaaatgcagattcctttgatgtttcttttatctcaagataaaactcagtgctggggatttcttcatcctcatttgactaaacccagtcaagatgtgtgcaggggcccggaccaccctggggaccatcaccgttagcaaccaggctg

SEQ ID NO: 24573 - DNA, 197 bp, Homo sapiens
tttctacagatgtcgtttcaccgtgttggccaggatggtctcaaactcctgacctcaggtgatctgcccgccccagcttcccaacgtgctgggattacaggcacgagacactgcacctggctgtaattgtcctgttttttttctgattgtcctaattattatgaagccattataatctattttgtctctctagacta

SEQ ID NO: 24574 - DNA, 242 bp, Homo sapiens
acacacagatggccacttctgcctccatccactcaacgccaacaggcaccgttcctccaccaacaacgctcaaggccacagggtccacccacacagcgccaacaatgacgccgaccaccagcgggacgagccaagccctgagctcattcaacacagccaaaacctctacatccctacattcacaaacttcctccacacaccttcctgaagtcaccccaacttctaccaccatcacccccaac

SEQ ID NO: 24575 - DNA, 334 bp, Homo sapiens
atcgctgggaaattttcttttattgctgctttggttatttcctctcttgtttacttctttctttctgtaactatctagatggatcctccatgtcacaacttctcttttccttttggcagttttctgggagaaaccctcagtttgtttgtttgttttgagatggagttcgctcttgttgcccaggctggagtgcaatggcgtgatctcggctcaccaaaacctctgcctcttgggttcaagtgattctcctgcctcagcttcctgagtagctgggattacaggcatgcgccaccatgcctggctaattttgcgtttttagtagagacggggtcct

SEQ ID NO: 24576 - DNA, 245 bp, Homo sapiens
  misc_feature 169: y=c or t
  misc_feature 170: m=a or c
ataatgtatttcctcacaggtctggaggttagaaccaaaaattgtgatataactacaatgtgaggagtgggaaaggataggtatcaggattttggcagggttggtttcttctgaagactttcttcttggcttctagatgtccatcttctttatatgtcttcacatagtymtccccatacatgtctgtgtcttaatctcctcttcttaaggacaccacttatattggattagagaaagcaacccta

SEQ ID NO: 24577 - DNA, 129 bp, Homo sapiens
ctcaggagttcggtacgtgaaagttagctctcccggaggtgccggtgaactcaaaatcgtgctgtgcccggcgtcaggcgtggagacaacagaaagttgtgcttaaagctcgaatcagaaatccccgaa

SEQ ID NO: 24578 - DNA, 308 bp, Homo sapiens
acagtgttattattgataagtaaagacttactcctgtcattttgttatttgttttctggttgttttgtagtcttctttcttccttccttcctgtcttcctttttgtgaaactaattttctatggtcatgtgtttttatttcttgctttttatttcttgtgtatctgttgtaggtttttgatttgaggctactatgaagcttgcaaataacatcttataacccatcattttaaactgatgacaactcttgattgtaaaaacaagcaaacaaaaaactaataaaaatgcttaacttcattacccccttat

SEQ ID NO: 24579 - DNA, 296 bp, Homo sapiens
  misc_feature 46: k=g or t
  misc_feature 47: k=g or t
  misc_feature 203: r=a or g
atggttgttggtgggaggcctcaattcctcctctatgtgggactckkcacagggttgagtgtccttatgacatggcagctgcactccccagatcgagcgatgcaagaaaacaagacagaagcttcagtgccctttttgaccacgccttggaaatcatcccccatcactctcgccatgttctgttccttagacacaagccagtraattccgcccacattcaagggaaggggagctaggtttcaccttttaaaaagaggtgtgtcagagaatctgggaacagattttacaaccacgca

SEQ ID NO: 24580 - DNA, 118 bp, Homo sapiens
tgatttgtggtcatgaacatattttcttgtttgatttcaaatttcagtctagtgtcccttgccccttaggctgcagatgtcaatttgtggtcatccatgccgatgtgtaaatgagtaa

SEQ ID NO: 24581 - DNA, 86 bp, Homo sapiens
ttgcttttcttattcctcctctcctggagagctgtgattagaaaccacacccacccttgaatgaagtgcttgaactggggggggaa

SEQ ID NO: 24582 - DNA, 232 bp, Homo sapiens
  misc_feature 12: m=a or c
  misc_feature 91: b=c or g or t
aatatctctagmatgtgcccatcaggacaccatccagatgctgcgtgcgtttttccaggccacacagaggggacaccctccaggtgcaccbtgcatgaatatcaggctcaaccgtgctttcagggtaggaagcggagggcatttgaagagtcctttcccttccttcattcatttgttgtctccttgaataaatgctgttgaaaaccaaaaaaaaaaaaaaaaaaaaaaaaaa

SEQ ID NO: 24583 - DNA, 282 bp, Homo sapiens
  misc_feature 89: s=g or c
  misc_feature 90: r=a or g
  misc_feature 131: r=a or g
  misc_feature 156: k=g or t
  misc_feature 159: y=c or t
  misc_feature 208: k=g or t
  misc_feature 221: w=a or t
  misc_feature 239: y=c or t
  misc_feature 258: k=g or t
  misc_feature 259: r=a or g
  misc_feature 260: m=a or c
agtaacacttatgcagaaaatgtttacaccttgtatttagtgaaaatctagctaaatttttaggatcttcttcttttccttttaaagasrggaaaaaaaaaaacatttaaaaaaacccatttaaacatgarggatattactggaagtttgtgattkgtyctccattttctagaagtcccattcaagatttcaaacattttcaaccttkggtctctttaggwtacatactataaagtttycactcagacattaaacagkrmcctaattgaaaagaatgggggt

SEQ ID NO: 24584 - DNA, 157 bp, Homo sapiens
  misc_feature 156: r=a or g
  misc_feature 157: r=a or g
acccgggaggtggaggttgcagtgagccgagatcacgccaccgcactgcaacctggccactgcacgccagcctggcgacagagcgggacttcctctcaaaaacaaacaaacaaaaaacagggcactgatttctgaattatatgtctccctattcarr

SEQ ID NO: 24585 - DNA, 212 bp, Homo sapiens
aaagatttcatgcagttagagaaagcatgtcttagtttatcagtttagaaataggaaaatggaaccctaaaatttgcaagtaccgacccaaaactctgagaataatgttagttccaggaagctgattgcatcatttcagtggaccagaacagaaaataatgagttacatttaataactctttttaagttttctaatttaccacctggctctc

SEQ ID NO: 24586 - DNA, 322 bp, Homo sapiens
  misc_feature 134: n=a, g, c or t
  misc_feature 135: n=a, g, c or t
agcataccatgtgttacacagcagatactgaagctgtaaacagtaaattcatacttacgatgttagaaaaataagattctgattatgaaacaaaaggttgttttcagttgaagaagtaaataatagtaagaatnnggaattttgcaaaagccaagccttcagatggtcagataaagtacctgatgctgaaaaacaggaaattgaatcatgtctccaaaatgtgccttttgtcatgcactgttacagctatatttcttgtaactacattcagcctccagccaagataaagaattatgtgatacatacttcatcttccatcaca

SEQ ID NO: 24587 - DNA, 469 bp, Homo sapiens
  misc_feature 5: k=g or t
  misc_feature 441: k=g or t
acgtktacgtaacggcggctccgagcgcctggggtcctcccagagctcctgggctcgagctctttgcatgagcacctcgggccttctcgtggctacctctgtgcttccctgagacctgatttgtgagccctttttgctggttttcgccagaggttttttaccaaatcaaaatttcaaccattgactaacacaggggttgaaggaagaggacggggaagttcagtgatggatgggaacaacagtcttagatgatagggataattaagagggcatagttggggacttgtggttatttggcacagctctctactctcagtccaatgtttggaaatgaggatgctccacgtgctaccctaaagaaccatttatgtaagtggactaagctaaaactgccacagctaaactattcctgcctccctgcttgcttctcccatctctgtkccatagtctttggtgctatttacatata

SEQ ID NO: 24588 - DNA, 176 bp, Homo sapiens
  misc_feature 152: k=g or t
aacaagaaaaagaggaaactccctctgcattcctgcagaggctcagagatcagatgagaaaatattttggattaaatctggaagaaccagtgggcaaggccttttaaaggttagctttgtgactaaaagctggcctagcaggccagggagtkcagctgcaggcgtgggggtggcaa

SEQ ID NO: 24589 - DNA, 119 bp, Homo sapiens
ttatctctgtttaataaggatagggacctaacaaaaccatccatgaagttctggtaatgaaatgtcaagtctcagtatagaattttctcattagaaaaatcccaaaggaaagacccctt

SEQ ID NO: 24590 - DNA, 111 bp, Homo sapiens
aaagtcgtttactcagtatactccctaagtaaatggagagaatatttactattatagctgaagtgtttccatttgacttagttctaggaagtcagcatgaatgggcccgac

SEQ ID NO: 24591 - DNA, 257 bp, Homo sapiens
  misc_feature 223: k=g or t
ttttacttctggtcatttcttgtactatatcttatgtattgattgattgattgattgattgattgagacagtctcgctctatcacccagtctggagtgcagtgatgtgatcttggctcactgcaacctctgcctcccaggttcaagtgattctgctgcctcagccgcccaagtagctgggactacaggcatgcaccaccatgcctggctaatttttgtatttktagtagagacagggtttcaccgtattggacaggc

SEQ ID NO: 24592 - DNA, 310 bp, Homo sapiens
  misc_feature 264: k=g or t
  misc_feature 266: v=a or c or g
aattcatgaaatttagcaagagtgagaagtaagcttgtttgctgtgaacacagattgcagatgtatttggtatccattataaataacttagttatttataacacactagtctaatatatttctagtattttttaaataaagggtagataaataatggttttactttactgtggtaaatatttcttgagaaaatgttatgtaatcaactatttaataacaaatgaggacacagttctgtcttcataaaacctagaataaaataakgvagttaaaattaccatatagacaattgtatggaaggcagaatcga

SEQ ID NO: 24593 - DNA, 171 bp, Homo sapiens
tgaaaagaaccaccaacccaatcaagatgaggcagaagagggactggaggcagggaacctaaggccaattcatgctgacttcctagaactaaatcaaaaggaaagccccaactttccatgcccaagtaataaaaggaccagagggtactccctttgcaacaccaccgcccc

SEQ ID NO: 24594 - DNA, 256 bp, Homo sapiens
tgagcccttcccaacctttaggtcccgattccttccatgctccaaatcccgtgccccgtccacgccctcccgcagagggaggagcgacgggttacgctgtcgcccaggagctgaaccgcgcgaggaccccatccatcagattatatggcgatttagacggtgggaagaccgcaaggaaatggtcagcggatgacgtaatgtttggggtggcgtcccattctgtaacttctgtacggcatcagtgacacgggtctgc

SEQ ID NO: 24595 - DNA, 182 bp, Homo sapiens
agtcttgaacccctggcttccattgatcctcccactccgcctcctggatagctgagattacagctgtgctctaatatacctggctggatctcttttgagagctaggcttcccagaagcctctagcaaaagtcttttcatgtgggccagaagttggtcacactggcaaggaaatcggattgca

SEQ ID NO: 24596 - DNA, 312 bp, Homo sapiens
tttcttccatatatattgagaactacatcagatggtgttagtttttgcctcaaccgtgaaacgtgattgagaaaacccaagaggagaaggaaagttttttatacttacacatatttttactgtttcttttgttattgttttctaatatttcaagatgacttctttgatcatttcccttctagttagagaactcccgctaaccattcttttagggtaggtctactggtgacaagttgttttcgttttcctttatttaagaatgtctcaatttccctttcattcccaaaggataacttcaccagatatagaatt

SEQ ID NO: 24597 - DNA, 236 bp, Homo sapiens
ctctttcacttagcatattttcaaggttcattcacatcgtaacatgtatcagtatttcattcctttttatggctgaataataccctgttttatggatatacaacattctgtttatccattaatcaggtaatggatatttaaattttctaccttttagctactgtgagtaatgctgctataaacaaccatgtacaagtttctgcacagacatgtattttcatttcccttggagcggc

SEQ ID NO: 24598 - DNA, 229 bp, Homo sapiens
  misc_feature 70: m=a or c
taggggtctcgctttattgtctgggctggtctcaaactctggacctcaaggaatcctccctcttcagcamttttcgaagccaaggtgggaggattgattgagctcaggcgttaaagaccagcctgggcatatggtgagatctcctctctacaaaaaaaaatttaaaaattagcccagtatggtggcacgtgtctttagtcccagatacttgggagattgaggcggggag

SEQ ID NO: 24599 - DNA, 206 bp, Homo sapiens
  misc_feature 11: y=c or t
  misc_feature 36: s=g or c
  misc_feature 37: r=a or g
  misc_feature 38: r=a or g
  misc_feature 91: y=c or t
  misc_feature 119: k=g or t
gttggccaggytggtctcaaactcctgactgacctsrrgtgatcttcccgtctcagcctcccaaagtgctgggattacaggtgtgggccayaatgcctggccccttctgcatccttgtkattaacatgtccctatcatttttttatgacatccttactttctgtagaagatgttctcagttcattttattatttccccaccccagt

SEQ ID NO: 24600 - DNA, 358 bp, Homo sapiens
tctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcga

SEQ ID NO: 24601 - DNA, 330 bp, Homo sapiens
agtgaagctccctggagagctgggggaggggcaccccactgctgggagctgtggcttggggtatgaggccctgacctgagccccctgaggaggcagggacaggcagacgggcctatctggaatgggggcttggggccttatttgggccatctccctaagcaatccccttccttcctgggtgaccttagctgtgggtctgggatctcttccttgggtggtgaaaatgtgaaagctggggactggtgagagggggacccggaagtcaggagcttgggttccctgcctctgcagggaactcccagagccgagtcccccatgagcaggcaggac

SEQ ID NO: 24602 - DNA, 104 bp, Homo sapiens
aaggcatgtcttacatggcagcagggaagagggaatgagaaccaaatgaaagggattttcccttttaaaaccctcagatcttgtgagacttattcacgaccatc

SEQ ID NO: 24603 - DNA, 112 bp, Homo sapiens
catgcagatggcagtggcaacggtggggcgggggagccactggtctccatgcactcattcatgctggcattggaggtgtggtggagggatcacagggtgcactcacactggc

SEQ ID NO: 24604 - DNA, 432 bp, Homo sapiens
  misc_feature 44: k=g or t
  misc_feature 246: r=a or g
  misc_feature 275: r=a or g
  misc_feature 307: m=a or c
  misc_feature 396: k=g or t
ccatcttgatggtctcaacactaatttttatgatgcaaatttakacactgatttttgtaaaggacaaagttttaaaagcgtatttaacttgatgttttctatcagcataaataaaatggtcatgaatagtcattaaaaacagttgccagtgataatctgcatgaaggaaaaagaaccctgcaaatggctattgagttggaagtattgtttttgatatgtaagagatattcagaatgctcacactgraaatgcctcaactttttaaagtgtaagaraccaccatgagtggtgtctagatttctaatgmagaatcatgatacagtttggattaagtatcttggactggttttaaacagtgctttgtaccggatctgctgaagcatctgtccagctggkatcctgtgaaagtttgttattttctgagtagacatt

SEQ ID NO: 24605 - DNA, 237 bp, Homo sapiens
gctcacaaatgccttgatctcctgggctcaagctatctcctcccacctcagcctcttaagtagctggagctacaggttatctgccaccacactcagctaatttttaattttttagaaagacggggtcttcctgtgttccccaggctggccccaaactcctgggctcaagcaatcctgccttacctcccaaagtgctgggattacaggtgtgagccaccacatctggcccaagtcacc

SEQ ID NO: 24606 - DNA, 367 bp, Homo sapiens
  misc_feature 61: k=g or t
  misc_feature 145: y=c or t
  misc_feature 173: r=a or g
  misc_feature 182: w=a or t
  misc_feature 242: w=a or t
  misc_feature 246: r=a or g
  misc_feature 309: r=a or g
  misc_feature 315: b=c or g or t
  misc_feature 316: n=a, g, c or t
  misc_feature 351: k=g or t
cctttaaaatcacaatgttgtgtatttggattgtattgctctggttcctcacagaattttkttaaaaaatatcagaccacattggcattatgccactagtctatattgaaaaatgtattcgaggccaggcacagtggctcatgcytgtaatcccagctccttgggaggctgargcaggtggwtcgcttgagctcagcagtttgagatgagcctgggcaacatggcaaaaccccatctctacwaaaraatacaaaaattagctggtcatggtggtgcgcgcttgtagtcccagctactggggaggctgargtgggbngaatcgcgtgagccctagagatggaggttgcagtkagctggaggttgcagt

SEQ ID NO: 24607 - DNA, 206 bp, Homo sapiens
  misc_feature 124: y=c or t
  misc_feature 139: r=a or g
  misc_feature 150: k=g or t
  misc_feature 158: w=a or t
  misc_feature 163: w=a or t
  misc_feature 172: k=g or t
  misc_feature 175: h=a or c or t
ctaataacactggcttaagtgctgacttgaaatgctattttgtaaggtttggatgtaagtaatcaattgaggtcagcagtttgtatgagacatagcttcctccatttgcccccactcctttttycttttttaagttttragatgcttcckgtgttttwatgtwagaattgtkgthctccttcttttcttcttcctatacctcatca

SEQ ID NO: 24608 - DNA, 155 bp, Homo sapiens
  misc_feature 44: r=a or g
acataactgggggtgtggagagcgcctcattgccactgcagtgrctaaagctgggaagacgctggtcagttcacctgccccactggttgttttttaaacaaattctgatacaggcgacatcctcactgaccgagcaaagattgacattcgtatca

SEQ ID NO: 24609 - DNA, 254 bp, Homo sapiens
  misc_feature 12: y=c or t
  misc_feature 29: s=g or c
  misc_feature 41: s=g or c
agttcttgcctytctgaagatggcggcastatgccatccasgactcccaggcccccagtctcagctctgggggtgagagttccccctccagccccgcacacaactgggagatgaattaccaagaggcagcaatctacctccaggaaggcgagaacaacgacaagttcttcacccaccccaaggatgccaaggcgctggcggcctacctctttgcacacaatcacctcttctacctgatggagctggccacacgc

SEQ ID NO: 24610 - DNA, 90 bp, Homo sapiens
  misc_feature 44: s=g or c
tttaattcatggtatcccaatttaaataatatccttgcaaacascaacatgtttttgccaatattaaggtaatgttaaagaaacagacta

SEQ ID NO: 24611 - DNA, 432 bp, Homo sapiens
  misc_feature 45: r=a or g
cagttttggcttctgttgccattgcttttggtgttttagacatgragtccttgcccatccctatgtcctgaatggtattgcctaggttttcttctagggtttttacggctttaggtctaacatttaagtctttaatccatcttgaattaatttttgtataaggtgtaaggaagggatccagtttcagctttctacatagggctagccagttttcccagcactatttattaagtagggaatcctttccgcatttcttgtttttgtcaggtttgtcaaagatcagatggttgtagatgtgtggtattatttctgagggctctgttctgttccattggtctatatgtctgttttggtaccagtaccaggctgttttggttactgtagccttgtagtatagtttgaagtcaggtagcatgatgcctccagctttgt

SEQ ID NO: 24612 - DNA, 356 bp, Homo sapiens
caaagaatgggaaattctgtagcccttctggcttaccctgtgtgattataaacctagcctcaaaagagattgacaggcatgactcaagtgagtgttcacatatacaagcctgcatgagccctctgtgggtaggtggtcacacttggcatctgcagcattgacgtggccccgctgggtgccttgagcatgccctcttcctgctctgcaatttgaatcaccaccgtgccccttccaccactgttccccatgcaaaagctctgcttccagcagcccccactgaccgctctctgtgtggagcaaagtgctgtcgtgcggtgaccaccaggtgaagagcagcttgtattcagacatctaga

SEQ ID NO: 24613 - DNA, 183 bp, Homo sapiens
agttggactctccttcctaagttgccagcacaagcttcttctccaagaacaaagttactgtatggagaaagagaaagaaggaagggattggatgctctcttcttcctcaggattctgggctgtctcctgatctcttggaaatgagttggttgtgttagacctttccagtcaaaaggggccggt

SEQ ID NO: 24614 - DNA, 418 bp, Homo sapiens
  misc_feature 13: w=a or t
  misc_feature 44: k=g or t
  misc_feature 45: k=g or t
  misc_feature 207: s=g or c
  misc_feature 254: r=a or g
  misc_feature 258: k=g or t
  misc_feature 302: k=g or t
  misc_feature 319: y=c or t
  misc_feature 320: k=g or t
acacaatctaggwtctcctggaggtttctggttggggtggtttkkgtttgagaggggactccaggaatcctttaagaactgccttcaggctgcatatttcctaaggggtactgaacacccccagatcagaggcaaatggggcaaaagttaatgagcacggccagaaagatgctcccttgcaggccgaggacaggttgttaagcgcasaaacatggttccagcattgtacattatttaatccaaagacgcctgtrgcckgtcggatgcggcccacatcgagagcctgcaggagaagtcgcagkgcgcactggaggagtayktgaggagccagtaccccaaccagcccagccgttttggcaaactgctgctgcgactgccctcgctgcgcaccgtgtcctcctccgtcatcgagcaggcg

SEQ ID NO: 24615 - DNA, 355 bp, Homo sapiens
  misc_feature 270: m=a or c
  misc_feature 271: m=a or c
  misc_feature 339: m=a or c
  misc_feature 341: r=a or g
  misc_feature 354: s=g or c
tgataaattgttgaaggctgtgtgaagcctagtatgagtgcaaggaacacctgggggctgcagtattagggtgacctccacacttttgaagatttttgcctcccagaagtaaaccaggtttcacagtgaaaagccaaagaagtttccctgtggctttgtcaaggagaggagaagagtaacacttttgaaatatgctcaaagtattcaccatacagatgtcatacattttgtggtaaaataattgactagagtcttatgtcacatgggacmmaggcatgtccccaatcccagatccttctagccttcttgtctcacaggagatgctaagaaacacttatmarattcacagcccasg

SEQ ID NO: 24616 - DNA, 448 bp, Homo sapiens
  misc_feature 51: d=a or g or t
  misc_feature 52: y=c or t
  misc_feature 378: m=a or c
  misc_feature 394: r=a or g
  misc_feature 414: n=a, g, c or t
gaataatcctcagcatatatcatttctaaagatagaggctgtaattctgtdyctgatgaagagctgaagaatatctcacaccggttggtaagtgacagtcagtaactaccagacaattaggatgatgcatcaggaaaattggagtcaaaatatcccatgtacagatgctgagtccatcaacaaaggagggatatcgtcatcacatctagcagcagaagacacaggaaaaccacatcacaacaaggataaagggcaatggcgttgctgcagaggacagaacggtcatcacttcggtcctacctgagttaactctcaaagactatggaaaataactttattcttaaaaggcagccaaggaaaatattttaagtagggggmtgtgattaatggaacrtgtagagccctcaatatcanattactggtttgcgtgtgaccctgtgtttgggtt

SEQ ID NO: 24617 - DNA, 128 bp, Homo sapiens
catttatttaaatatttatttccactgcttcacttggctagcctaaaaatatatgtattaaaaaataaaaataaatattatggttagtatttttgtgaaataattgttcgagattttctcccctgcaa

SEQ ID NO: 24618 - DNA, 376 bp, Homo sapiens
  misc_feature 351: r=a or g
aagttgttccatgggtgtacacgtagacagacacacatacacccaaattattgcattaagaatcctggagcagaccatagctgaagctgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacctagrtggtgaataacatattcccagttca

SEQ ID NO: 24619 - DNA, 283 bp, Homo sapiens
cagtgatttgtgtcattagaggtgcccctcagattggttgggagttgaagtcatatctgggaaaagaaaaaaagtgaatatttgttgtataactacttgttttaggcacgattgcttttgaatacattatctaatcattacaatatcaaaggaaagtattattctaaaaggagaactaccacgtgaacttggcccttcctgatatctaaacttatgcttcgtctgtggtatagcaaactgtctctggggttgtctttgaaatcacattgaggttttttttttt

SEQ ID NO: 24620 - DNA, 309 bp, Homo sapiens
  misc_feature 111: w=a or t
  misc_feature 112: w=a or t
  misc_feature 244: r=a or g
  misc_feature 294: w=a or t
  misc_feature 295: k=g or t
tatcaattcccagctttggtagggcctgtttcattctagaaaacatcctttatgtctagtaattgctgtttagattcttacacctgtttccttgcaaaaacttaataagcwwtaaaataagataactatgtgcctctggcaggggaatcctgctaaacggttaaccatgaggtgcctagcgtgcattcataatgaaaggtgcaaaatgcgggtgactttacagtcataaagtaattcagaagargcagccagccctggcaatgttgtggcatgctacagtgtgttaacagaggwkgaggaagaggggag

SEQ ID NO: 24621 - DNA, 138 bp, Homo sapiens
  misc_feature 130: k=g or t
actattaaattataaaataagaggcttctcagcttctagagccacacaattatggaaagttctagtattaaaatcatagcaccttagcagggaagaattacagaaattatagaatggtaaaatattagakccagagat

SEQ ID NO: 24622 - DNA, 240 bp, Homo sapiens
  misc_feature 45: w=a or t
  misc_feature 48: k=g or t
  misc_feature 96: k=g or t
  misc_feature 233: w=a or t
  misc_feature 234: k=g or t
aaatttcaaaacgtaggataaaaggaatcaaatgtattaatggawaakcaactgaacttaatttcgattcttttctatcattttttcctaggctakagatagactaaattcatatctgaaaattctcaatttttgagaaaagacaaaatgtttgtcgttacagttttgttgttgctgcccttagttgctttcattaccctcaaattctgtaacttgattaattttccaactcwkagacac

SEQ ID NO: 24623 - DNA, 292 bp, Homo sapiens
tctcttttataatactgattttcttgcttttgagtagttacctagcaatgggattgctggatcatgtgggtagctgtatttttaattttttgaggactctatactgttctccatagtggctgtactaattcataatgccaccaatggtgtacgagggttctgctttctccacatcctcaccagcatttcttaatgcctgccatttggataaaagccattttaactgaggtgagatgatacctcattgtagctttgatttgcatttctgtgatgatcagtgacgtcgagcttc

SEQ ID NO: 24624 - DNA, 373 bp, Homo sapiens
  misc_feature 111: y=c or t
  misc_feature 213: m=a or c
  misc_feature 288: k=g or t
  misc_feature 289: r=a or g
  misc_feature 299: w=a or t
ccagcctggagtgcaatggcgcaatctcggctcactgcaaccttcgcctcccaggttcaagcaattctcctgcctcagccttccgagtagctgggattacaggcgcatgcyaccacacccagctaatttttgtatttttagtagagacggggtttcaccatgttggtcaggctggtctcgaactcctgaccttgtgatctggccgtctgggcmtcccaaagtgctgggaggcgtgagccaccatgcccggccagtgaacactaacgtcttacgaggtatttatgagakraaagcttaawattgcaaaaagtccatgcagagccctcattcctcgcaacacattgggctgaggccactgtctaattgcagttta

SEQ ID NO: 24625 - DNA, 170 bp, Homo sapiens
  misc_feature 144: w=a or t
  misc_feature 145: k=g or t
tgtgatcttcctggtcagcgctctctctagcatactcttcctctatttggctcacaaacaggcaccagagaagcaaatggcaccttgaacttaagcctactacagactgttagaggccagtggtttcaaaatttagatataagwkgggggaaaaatggaaccagggcacc

SEQ ID NO: 24626 - DNA, 404 bp, Homo sapiens
  misc_feature 391: m=a or c
gagaagaacatgaaagtccgaaaatcaaggcctaattgaaaagttttgggaagcctgagtagagtttggacaaggagagaatccttgtcactggaaataaggaactgaatggaaaagtgagagttagagtatggccagtgatctttggaatttttgcctggaggggcctcagagaaatggcctcttcttacagtgtcaggaagatgcctggatacttcaggcaacctgagtttagaatttttgcctggggagacatttgaaaaggtcttgcacttcaccaagttcagagtacatgaaagtgggatttatttcgagttgggaatgaaagaggaagaaagcaagaaaggaaagtgggcttcttagggtagtagtcaaaggtacaaattgagamgtaaccacgctca

SEQ ID NO: 24627 - DNA, 172 bp, Homo sapiens
  misc_feature 21: s=g or c
  misc_feature 123: k=g or t
cagcttccatttaaccttgasagaaaagagaggttctaaatgaagaactctttaagaaagaaagaatacacccataaagaactcagctattttgcagtaaagagaagaacaaaatgggtacakgattgtggatatcatagatgctgttctcacacaaccactgggggtctcg

SEQ ID NO: 24628 - DNA, 170 bp, Homo sapiens
ttctttgatttaaaaaaattaactatacagttaatggtttagaacttagaactacttagaattaatgctaaagtgtcaggaagaaattaatttagcttcaataattgtgactggcctcaggaattctcccttccacacctgcccacctcacctcactgcaccacaccctc

SEQ ID NO: 24629 - DNA, 181 bp, Homo sapiens
tgtttggagcttgagtatacagactgtaaatatagttcttgtatttgtactaattctgattcttttgctgtatagccttagatgtgcaatgcagacactatctaactgtgtgtggtaaccttgcgtcacggagctgttagtgaacgaggtaaaaataataaaggtacagccagtgcatcat

SEQ ID NO: 24630 - DNA, 348 bp, Homo sapiens
  misc_feature 11: r=a or g
tctcagatctrcgatttcttcatctgtaagatggaaacaatatgtgtcttttctaaggggaaagatcaaatgacatcatgtatgtgaaaatgcttagaaatgggtgatgatgatgatgatactgattattagggtatctaataaagttggggaaagaacaaaatccccccctcacaccctattgcaccaccagccttctccctccctgctcaattatacccatgttatagggaaggaaatagggaagaaacttgtctaaggtcacatggatgttcgcaacaattgggatgcagaacttgatctgactcccaggccaggtttgattttgatttgcagtggcagagagga

SEQ ID NO: 24631 - DNA, 330 bp, Homo sapiens
  misc_feature 285: s=g or c
  misc_feature 297: k=g or t
  misc_feature 304: s=g or c
agcggtaccttccaccagcgctccacgatgaccgtgccctggcggccaggaaagcgacgcatcacttataaggaagaggaggacttgacactccagccccgttcctgcctccagtgctcctgagtccctagtaggcctccaggagggcaaaagcaccgagcagggtaaccacgaccagcttaaagaactgtattcggctgggaacttgacggtgctggctactgaccccctgctccaccaggacccagtacagttagactttcacttccgccttacctcccagasctctgcccattkgcacggscttctctgtgaccgtcgactcttcct

SEQ ID NO: 24632 - DNA, 325 bp, Homo sapiens
ccaggtctaatgtgcacaccagaagggcagtttagtccagtctagcttccagagaacagacccaagagagagtcccgctcaggccctggcacttccatgggcttgtggtgatctagccagggagtttgagggtctcaggtactcaggatcaaggtgtacgcaggggacggctccagctgggctttttttcccttcacactttgagtgggatctttgtgctacgtataccttctaaagcccacagccttcaggcaagggcttttcttgtctgaggctaaagtggcattaatgtgagcctaaatctcaccttaaacatggggcaaat

SEQ ID NO: 24633 - DNA, 133 bp, Homo sapiens
gggtatttgaggtgctcccagagaagctttctcaactcagattaagtagagatgagattaagaaagtgctcagcctcttcagggagaaatctgcactggcctcagctgtgtagtgagtatttttttttttttt

SEQ ID NO: 24634 - DNA, 147 bp, Homo sapiens
actggacttgtgaatttttgagtacatactatgtgtttcagaaatatgtagaaataaaaatgttgccataaaataacacctaagcatatactattctatgctttaaaatgaggatggaaaagtttcatgtcataagtcaccaccaaa

SEQ ID NO: 24635 - DNA, 256 bp, Homo sapiens
ttactgtttattaaaagttccttcctccaagagaaactttttaaatacttttgattcaatccaataatctcaggaggagacttttaaaagttcatggaaaatgtgtattatgaacaaatcatgcatggatttcaaaatttttttacaccaaaataaactcatactaacttgttataacatgtatgaacaggatctagtttgaggtactaaaaagaataagacatatgtttgaaaagagcccctatcagagcaacta

SEQ ID NO: 24636 - DNA, 165 bp, Homo sapiens
tgtcaatgcccaagtgcagatgcaataatagtgcttcaactgattgttgcaaacccctcatgagggatgccaaatcccagtgcagatggtaacacaggctatttttcacctccaacctctaatatcctttctttctttctttccttttttttttttttttttttt

SEQ ID NO: 24637 - DNA, 370 bp, Homo sapiens
  misc_feature 105: y=c or t
  misc_feature 135: k=g or t
  misc_feature 136: w=a or t
  misc_feature 269: r=a or g
  misc_feature 270: s=g or c
  misc_feature 333: r=a or g
  misc_feature 334: w=a or t
  misc_feature 341: r=a or g
  misc_feature 342: r=a or g
  misc_feature 350: w=a or t
tttactcgattccatgatgctacttggtctgactactctcaactcctacctcactactggacagtaagtcctgtttttagagagccctacacaaggaagcatgayaaatcctgttgagatcccatctcagtattkwatcattccttataagtcccagttagtgcttatcttaatattatttgggagctgaacaataatagatcctactacattttggcctgtccaggaacctgacccagttgtactcaccacactggaggaaggtttarsaaccaaaggacgagctataagttgctcttatgcaaacatgatgagtttcacaagatatacccrwgtattarrctcattawcatcttcattatgccacgat

SEQ ID NO: 24638 - DNA, 404 bp, Homo sapiens
ttcctctttaggttccaaataatgaagttcatttagtattattattattgtggttgttatattattgttgagttggggtctttgtctgttgcctatgctggagtgcagtggtgtgatcatagtaactgcagcctcgaatatctgagctcgggagattttcccacttcagcccacattgacctgagtggctgggactacaggtgcatgccatcacgcccagctaatttttaagttttttgtagaggtgaagtctcagtatgttgcccaggctggtctcaagcttctaggcacaagctatccttcctttggcctcccagagtgctgagattatacacatgagccactgtgcctggtcacaaagttcatttattcattcaacaaatatttgttgtgcatcagccaca

SEQ ID NO: 24639 - DNA, 232 bp, Homo sapiens
aacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctcaggtgtc

SEQ ID NO: 24640 - DNA, 93 bp, Homo sapiens
gagaactggtctgaccaaatacaaagggattactaaacagtagctggaaggtatacattctttaacgattgaagagaaaatttatggggcccc

SEQ ID NO: 24641 - DNA, 193 bp, Homo sapiens
  misc_feature 11: k=g or t
acctgccagtkatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccatt

SEQ ID NO: 24642 - DNA, 234 bp, Homo sapiens
ttcagaacctatcttaaagcttggacaatttgaactcagtattcataatagacttcatagtaagactcaagtttacttgtcctcctataactgttcagttagaaaaaatttcatcttaattttccataaagttacatattataaaaccttgagctttgagaaattttgtataccaaaataatgctattattcgtcgttatcttcattttcaagaacaatacttggccagcagca

SEQ ID NO: 24643 - DNA, 336 bp, Homo sapiens
gattggcatgaaaccactaacttcattctagaatcattgtagccataagttgtgtgctttttattaatcatgccaaacataatgtaactgggcagagaatggtcctaaccaaggtacctatgaaaagcgctagctatcatgtgtagtagatgcatcattttggctcttcttacatttgtaaaaatgtacagattaggtcatcttaattcatattagtgacacggaacagcacctccactatttgtatgttcaaataagctttcagactaatagcttttttggtgtctaaaatgtaagcaaaaaattcctgctgaaacattccagtcctttcattta

SEQ ID NO: 24644 - DNA, 414 bp, Homo sapiens
  misc_feature 290: n=a, g, c or t
  misc_feature 291: k=g or t
  misc_feature 292: s=g or c
atacaattttttcttcacatttcttatgattagagtttgtcgagtttcttgaatctgtgtgttttagatttcactaaatttcgaaatattttggcaattatttcttcaataattgcctcccctttttttataattacagttacttattaggctgtatgaagttgtttgacaccccaaatctgtgtttcctcttttcccccccatcattttttttctctatttttaaattttggataatttcctgtgtctgatctgttagacgttttatatctccttgtccttacttaaankstataggttttcttcagctttcttgaacatagtagtctgtttgtactatttttctcttccttatggattgtatgttctcgcttctttatttgctggagaattttcttggatgcagacaatgta

SEQ ID NO: 24645 - DNA, 368 bp, Homo sapiens
  misc_feature 144: k=g or t
  misc_feature 145: d=a or g or t
  misc_feature 311: r=a or g
cctctcattgaagttccagtggtttgaaattagttttggacacattgtcttaatgtactgaaaattgctctgctgtattttgcagcgttcttcatttaatttataatggtccatattagacacatttggtaagagaagtccagkdtacacatttagggccatggaatagtattttgtaaaatccatttgggaagttgcaatacccacaatctgacatgtcctaaaatgtaagggattatctctaaggggttgatgggagaaatatttagatgtaccctgttaacagccagtcattttgatttacttatggraatcaagtgaataaaaggcaacataatttgggaaattttattctaatatctaataaa

SEQ ID NO: 24646 - DNA, 150 bp, Homo sapiens
gagaccttcctcgacaccccacgttatgtgggtttccgcaagaccttccgccattgcctgggctttgaaagcgctttaggaacggtaaagcattgctgtaacttaaagtagtgttactctggcttgactgaaatgttctgtggaaacggt

SEQ ID NO: 24647 - DNA, 244 bp, Homo sapiens
ttattaattattattatttactggctccatccactcttatgaaaatttaagtattattgctttacatttttacggcacgagttggttgtcaaagcatgtttacaaacatttatttttaataacagcagtactgagctgtaattcacccatttaaagtgtacaattcagtggttttagtatattcacaaggttgtgcatccatcaccacaatcaattttacaacatgctcatcatcccaaaccga

SEQ ID NO: 24648 - DNA, 408 bp, Homo sapiens
  misc_feature 392: r=a or g
tgaagccttattctgttttcataagacttacttgcttaattcaagcaaaacaaattttggtctaaattacctagataattatgacagctttttacttgagaagtgtagaacttgcttcaggctacaaaactgtattattcctaaatggataaccaggtaggattctaactggcattattgtatgcttaagattgatttaacaacagctattcccagtaaggaaattttaaaaatcagatccagttacatgtattatgatttttctaccttatggactattttggagggataagctattaagactaagactatgaatgagagttggggaaggagaggaagggaggaacctgcacaccacattggaacctgcacaccacattaacacaaaggcratcttctggctcgact

SEQ ID NO: 24649 - DNA, 263 bp, Homo sapiens
  misc_feature 4: s=g or c
  misc_feature 148: s=g or c
  misc_feature 201: y=c or t
  misc_feature 202: s=g or c
tatstaaataactgttaaattcttttgatctagagtgcagtttaaatgtttccttgttgacattctctctcaatgatctgttcattactgaaaatgggatgtcaaggttttttactattattgcacagttttttgtctctccttttasaactattaatgtttgctttatatatttaggttctccaatgttgagtgcattaystatttacaattattgtattctcttgttgtactgacccctttattattacataatggccgac

SEQ ID NO: 24650 - DNA, 203 bp, Homo sapiens
ttattactgttacattaatttaacatgcatttatagaagaatacattcaaagcactgatgtaggagatacacggtacttggagcagtcagccaaaaatcacagatactgctttcacttaaatggaaacaattctccgataatgctttgctttttttcttatgtcactcttgtgtactatctatttttctcctctctgggaacg

SEQ ID NO: 24651 - DNA, 369 bp, Homo sapiens
aagacatgactcctcttttaaatttgacatcttaaaggaggtttattccattttttaaattttaactgaagatactatagtacaatacttaaatgacagatcttctgtttctcttcattttaatgcatactttttgatctattatgatgcatactgtgaatattctgcccaccaataaatgactcaaaaatggccagagtgacacatatgagccacagttagacctggacatgagttatgaggactaccacatggtggtcacaataattgagctctgagttctcaagtttaaaggaaaacaggcactatacacaaaactctactgacatattatcatggacacaaaggacagagtgctgagcactgagt

SEQ ID NO: 24652 - DNA, 163 bp, Homo sapiens
atttcctttcaaagaaatctcttgtaaattacaaaactgtgaattgggttgccaaaaactgttgcccttcgttagatgcttcaaacagtgtaaatcctatactgcaccctgtccacctctgctccctcctccctcccctgagagtgaggacctcatccgacca

SEQ ID NO: 24653 - DNA, 136 bp, Homo sapiens
gatcccggccagccaggtgacccccacgctctggatgtctctgctctgttccttccccgagcccctgccccggctccccgccaaagcacccctgcccactcgggcttcatcctgcacaataaactccggaagcttt

SEQ ID NO: 24654 - DNA, 409 bp, Homo sapiens
atggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtgga

SEQ ID NO: 24655 - DNA, 204 bp, Homo sapiens
caagctatggacacatacacagtattcacctgtattatttttaaagcaaaaccagcattattctacatacattactctgcaaccttgttttttcacttatgttgatatcacggacaactttccaagtcagtaaatatgcagcttatttattctaattgctgcataatagtcctataatggatatatcataatttactcaaccac

SEQ ID NO: 24656 - DNA, 171 bp, Homo sapiens
tgaagttaagatgaagtcatatcggattagggtgggccccaaatgaaatgattggtgtccttacaaggagagggagatttggagacacagaaagacagagagacacggagagggtggaaggccatgcagtgatgaagggagagattggagtgatgcagctgcgagccgaga

SEQ ID NO: 24657 - DNA, 107 bp, Homo sapiens
  misc_feature 90: y=c or t
  misc_feature 91: y=c or t
acttcgcaggcgcccgcccgcctctcggccacctctgcagcctgccaggcacctcctcttgcgctctcgctgatttcgcccacccacctyyctccaccccgtgccaa

SEQ ID NO: 24658 - DNA, 119 bp, Homo sapiens
  misc_feature 94: d=a or g or t
tctaagattaagactcttctgggatctcttggaatgttagccccatctgctaacctcttcttgatatgaggaggtctggtttttgacaggagtdctttagagggggaatagtggaagaa

SEQ ID NO: 24659 - DNA, 113 bp, Homo sapiens
  misc_feature 45: k=g or t
taaaaggtggtcggacacaattttgattccaaaaggtcctgttakaaagaaaagagagaacatatttatatttacctccctcccctttatacttattatatttaccctcccaa

SEQ ID NO: 24660 - DNA, 189 bp, Homo sapiens
cagaccatgaacttggagtgaatttctttggtacttaccaggttccctgttttaaaatatacgaacatgtacattggtgacctttccagtgatggccagggagtgacaatgaagagctatagtctgtagctcttaatctgtgtgtacactgggcagggcatcatctgttggtttctgaaaggaggaggg

SEQ ID NO: 24661 - DNA, 302 bp, Homo sapiens
  misc_feature 12: y=c or t
acaggaaaaccyagaagaaatggataaattatacatacaaactattaacactgaatgacaaatagaaaatctgaacagactaataatgagtgatgagactcagtcaggagtaagaagcctcctaacaaagaaaagtccaggactgaatgacttcactgccaaattctaccaaactatcaaagaagaactaatactagttctcctcaaactgttccaaaaacatgaggaggaaggaattctccttaactaattttgtggggccagcactagcctgataccaaaaccagcttaggacacaacat

SEQ ID NO: 24662 - DNA, 238 bp, Homo sapiens
  misc_feature 12: y=c or t
  misc_feature 13: y=c or t
  misc_feature 225: d=a or g or t
acaaatgaatcyytccatttccaccacctgctccctagttcagactccccattatccccgtcttctctgatgtttccccactccattcctgctttgatcatatcatcttcctgcttcaaaacattcatcacctcaccatgcccttgaaaatgacgctcaaaaatctcattttggctctgaagaccttttataattattcccccaatttacctttccaagtctgtdactctattcccca

SEQ ID NO: 24663 - DNA, 240 bp, Homo sapiens
  misc_feature 11: m=a or c
  misc_feature 13: m=a or c
  misc_feature 46: w=a or t
  misc_feature 47: y=c or t
  misc_feature 86: s=g or c
  misc_feature 101: k=g or t
  misc_feature 129: b=c or g or t
  misc_feature 131: w=a or t
caagtaaatamamatacattaagagatagtgttttaagtgacatgwyagcttatagttgttgtatttgtccagacagagagcatasaaggagagcatgcakagaagtcttcactggccgaactggaacbtwttttttacctccaaagataagcagcgtttgaaaaaagtggagttggaagggcatttcaggcttagagaatcacacaggtgaaagttgagagtgagagagcacggcgcct

SEQ ID NO: 24664 - DNA, 134 bp, Homo sapiens
  misc_feature 130: w=a or t
gcaacttattgttcagaatcactcacaaatgggaaatctgatataaggacaaaatgggagcactgtggcctatttttacaacttttgtgtacatctgcaattgtttcaaaataaaatgtttaaaagggawaatg

SEQ ID NO: 24665 - DNA, 188 bp, Homo sapiens
  misc_feature 11: k=g or t
ccactgcacakaagcctggggattcttattgttttgatatttaaaaattgaatctggccgggcgtggtggctcatgcctgtaatcccaacactttgggaggctgaggagggtggatcacctgaggtcaggaccagcctggccaacatggtgaaccctgtctctactaaaaatacaaaaattagccagg

SEQ ID NO: 24666 - DNA, 179 bp, Homo sapiens
taagagtaaattgaaatgtagtataagtagggtacatgagtcctttttttggctggtctgtgttgaacaaagacctagtagctgcatgcttggaaagctttcctgtgttcatgcaatcttcgtccttattgtagccaggcagctgaggagatatcccctaaagaggcgaactccccaac

SEQ ID NO: 24667 - DNA, 354 bp, Homo sapiens
ttagtttacattcctggttctgcagcctatacaagtttgtctgcctatatctatattttttcctgcctccaaagcaggtgacacttggatatttacacagaaatttgtcaggcagttgtttggtaagaggaccagagaaacgcactgggctggagtctgtgacagagtacagccttgagagaagtacgtggggcatggcaagcagaaactaaatatgctatcagaacaagaattttggaattagagcacacagtggtattcagcttggcgtccagtaattagaccattaaggattggattgaggctgaggatctagagctctaaaaatcaagtcagaatttctcttaggagtta

SEQ ID NO: 24668 - DNA, 174 bp, Homo sapiens
  misc_feature 103: k=g or t
aacttggtaccaaatggaaagggtttcatgaggtgacagtggcttttaaacattcatttgaccgattattctaattgttccttgttaaatcattgcaacagtkgcatgggggagaatggatattttttgaagaattgcttattccactttcaatttttaaaaatcgagggggga

SEQ ID NO: 24669 - DNA, 192 bp, Homo sapiens
  misc_feature 171: k=g or t
  misc_feature 172: k=g or t
  misc_feature 181: s=g or c
  misc_feature 182: s=g or c
  misc_feature 183: s=g or c
gcaacctccgccttccaggttcaggcgattctcctgcctcagcctcccaagtagctgggattgcaggcatgcgccaccacacccagccaattttgtatttttagtagagatggggtttctccatgttggtcaagctggtctcgaactcccgacctcaggtgatcagcctgkkgtcgggggsssaaagtgctg

SEQ ID NO: 24670 - DNA, 283 bp, Homo sapiens
atttacaagccagccaatgaatctgcttacctgattgtgtttgtgcagacatactttaaaaactggcaatagtaaagccatgttacgagccttaaggacattgaagtcgttaaggtccctgagaatggctataacaaatcttagtgatgggaaacatttttataagacatagctaattgttgaagctccactataattgatactaatagcttggtgaaattcctaaatattaacaagaaattgcatgcgtgttttgttttttttaaggactatggcaaggatt

SEQ ID NO: 24671 - DNA, 271 bp, Homo sapiens
tagattcctgtatagcttaaactagtggttttcgtgcaataggctgaatttccttgcctttcatctctttttgaacccttaaataaagtgatacttgtctgtacctgcatttggacagctaaatgccaccccaggaaacaactgtggagcagatttatatcactatgaatccatggttatcagcttcaaatgtagtctcagccccatagtcctactagatttttctagtcattttaacttttccctgcaatgactatttcaaaccaacata

SEQ ID NO: 24672 - DNA, 231 bp, Homo sapiens
taatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccgc

SEQ ID NO: 24673 - DNA, 190 bp, Homo sapiens
  misc_feature 12: r=a or g
  misc_feature 16: k=g or t
  misc_feature 44: k=g or t
  misc_feature 53: s=g or c
  misc_feature 125: w=a or t
  misc_feature 136: s=g or c
  misc_feature 182: r=a or g
  misc_feature 185: s=g or c
caggaggctgargcakgagaattgcttgaacccaggaggtggaktttgcagtsagctgagatcacaccattgcactccagcctgggcaaaaagagcaaaactctccctaaaaaaaaaatgtagawtatctcttaasatttccgttatggtaaaaaccatatgcaataaatacctcattgtargcstaccc

SEQ ID NO: 24674 - DNA, 349 bp, Homo sapiens
ctggaaacgtgttaaaggtatcatcccaaccctactgcatcagaaattctgggatggcattcagcaatctgtattctctcaagccctccaggtaattctgatgcatgttcaagtttaagagcagatggtataaaattatcactctagagtctagatttttggtgtgagtgccaaaaataatggctttaggcataattgatatgtagatctttctgataatattaactaacagtttcagctgctttttaaagttgttttttgacaagagaagaatattataagcatgtaagatcatgcttttattcctatttgttgtggcatttaattgatataaacactggaccaaaga

SEQ ID NO: 24675 - DNA, 320 bp, Homo sapiens
  misc_feature 49: m=a or c
  misc_feature 161: k=g or t
  misc_feature 170: r=a or g
  misc_feature 219: m=a or c
  misc_feature 279: k=g or t
aattagaggttgaaaaaggttcaagacctggttgtaccacagctcccamcgacagctaaggaaccagtttggcgtctggtttgtctgttgttttactgctgaccttcaaatcaactttaacccctgacctctggaggcatctatcatgacaagaggctgtktaacacaartggtgcccatttataggggaagagactctgaagatttcctttttatgamgaatttagtttttcacccctcttttctcagtcaccacaggtgaaatccctctcagcagckggcttatgaaataatgtgaagggaggccttaatgagcagca

SEQ ID NO: 24676 - DNA, 292 bp, Homo sapiens
  misc_feature 6: k=g or t
  misc_feature 143: r=a or g
  misc_feature 144: s=g or c
  misc_feature 227: r=a or g
  misc_feature 243: d=a or g or t
  misc_feature 246: k=g or t
  misc_feature 256: k=g or t
  misc_feature 268: k=g or t
tatgtktaattatttttttcttcattatacatacatacaaacataggtgcactaaattttcaaagtattttaagggaagcatgtgttataatcagcagaacccttttaggaaagaaaccatgatgcagaacaagcgagtccarsccatggcccatgagcctcatgcagcccagatggctttgaattaagcccaacaacatgttgtaacctttcttaaaatattgtgrgattcttttgtgattdttktttgtgagtktgtttttaagcktatcagccattgctagtgttagta

SEQ ID NO: 24677 - DNA, 193 bp, Homo sapiens
  misc_feature 171: m=a or c
  misc_feature 172: m=a or c
  misc_feature 178: r=a or g
  misc_feature 179: r=a or g
aagaaggaaagggaaccctatccgattcattttatgaggccagcgtcaccctgataccaaaaccagagaaagacagtacaaaaaaagaaaactacagaccaatatccttcatgaatatagatgcaaaaaaaatttaaccaaatattagcaaataaaattcagcaatgtgammaaaagrrttatacaccatgaa

SEQ ID NO: 24678 - DNA, 74 bp, Homo sapiens
  misc_feature 26: y=c or t
tagttcatgcacacctgacaacagtytaactgagggagccagggcaggaattattatctccattatgcagatga

SEQ ID NO: 24679 - DNA, 131 bp, Homo sapiens
tttttatattttgtagagtggagtctttctatgttgccaaggctggtcttgaactcttgggctcaagcaatactcctgcttcagtctctcaaagtgttgggattacaggcatgagccaccactcccggcct

SEQ ID NO: 24680 - DNA, 318 bp, Homo sapiens
ctttatattgcttttgcctgtgaacaggagatgaagcatatgaatgtttatcggaatgataaatagttgaattattagacttttaataaacttggtcttatatgttcttttgagggctttgagtgttttatgtcactaattcagcaacctaccattacttattatttttgacctggtagaagccacaaggatgagttaactgtcctttcttctttaaggaatttagagtattgtagaggagatacacaacagtggcaacaattcaagacagaatagcatggttttgataagagcagacaaggatgcaaaggaggagat

SEQ ID NO: 24681 - DNA, 278 bp, Homo sapiens
  misc_feature 18: v=a or c or g
acagtatacatatgtttvctgctaatttaaaatgaaaatctcaaaatgacatatacatatttaccatgaactattaatagttaattggtaagaagatgtaaatgttttccattggaaaggtaatatacagacgcactaggagtcaaaccatgttaaagagcatttgtagaaacagctaagtcttccacccctatcatcaactcctggttcctttccccacaggcaactgctattatgctaaattattacatattcttccagaaatattttatacaggc

SEQ ID NO: 24682 - DNA, 165 bp, Homo sapiens
  misc_feature 52: r=a or g
cagagataattgcctatactaagaatctatactgcagaatatagtgtatcaraaacttttttcttttaaattattaaagtgtcttttatacttttatgaaatcattggtagccccccaagtgtttaataactggcattaagcttagagggtgaaaaaaaaaaaaa

SEQ ID NO: 24683 - DNA, 375 bp, Homo sapiens
  misc_feature 71: m=a or c
  misc_feature 72: m=a or c
  misc_feature 289: n=a, g, c or t
  misc_feature 290: n=a, g, c or t
  misc_feature 291: n=a, g, c or t
cacttaattagtaaatggtagagctaagattagaacccaaactttccataccttgttgtcctttccttttmmgtgcattaagtacacagttggttttaattagatcagccttggttagttcacatgtagagaacattcgagaactctgcaatgcattttgaacttgtgcctattattgaaatatgtacaatttgccctccttcctactgttccattccaaacttccacttttgtctcatcctcatcttagttttcagtaataatgaaacagcttaagctgtattcttcnnnaaaataactttatctcactacaacaacagcaggtattttgtaatttaaccctattttgaaatcttgatgtttaatatttgtata

SEQ ID NO: 24684 - DNA, 252 bp, Homo sapiens
  misc_feature 34: h=a or c or t
  misc_feature 248: n=a, g, c or t
tatttcattccacacaagtctaacagagaacaahaagccacactaaatcatactaaattattcaatacagcacttggcggatgtttgtgaggtatgtatgttaaagatgatggtaatctttgtagggaagagaaaggccagaggactttcacatattcaggaaatgtgcttagacatgcatttattttctttgctttgtttcttttaaagattcacaagcttttgtgagtgtattacagcggactggnctaa

SEQ ID NO: 24685 - DNA, 201 bp, Homo sapiens
catgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggca

SEQ ID NO: 24686 - DNA, 126 bp, Homo sapiens
taaaaacaactttgcctttgaaacgttaataaatggatttactttgctaagatttatggcaagtgtcaaaaatagtatctgaagatactgaatcatcatgaaatgaactctacttctggccaaagc

SEQ ID NO: 24687 - DNA, 100 bp, Homo sapiens
tagtatgccaaaaatgggagcaattggatctcaagatagaatgatcatgatttaactatttgtaaatattttttagtggaatatgtgctttttttttttt

SEQ ID NO: 24688 - DNA, 184 bp, Homo sapiens
caagtcaatagaaaaagcaagaaaaggtgctatctcctctgaagaaataattaagtatgcacataggatcagtgcaagtaatgctgtatgtgctccactgacctgggttccaggggacccccggagaccctacccaactgatttagagatgagaagtgggttactgggtcagatgaacaatcct

SEQ ID NO: 24689 - DNA, 146 bp, Homo sapiens
attctaacactcacccatggtgattctaaagcagatgggctgaagatcataggataaatgaaagattaaagactcattttccagagagggcatgtggcaatttcttggcactaaccgcaatgagataaaaaatggcactatccttc

SEQ ID NO: 24690 - DNA, 201 bp, Homo sapiens
  misc_feature 48: k=g or t
catgaacttgagttttttgttgttattgttattgttgttgttgttgtktttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggca

SEQ ID NO: 24691 - DNA, 120 bp, Homo sapiens
atttacaaggaacgaaggggccactgactcagagcggcaagtacagcgagtagtccgagagcgcccaccggcgggcggggcggctggtacggccgatcatgggcagtttctgcacgtagc

SEQ ID NO: 24692 - DNA, 273 bp, Homo sapiens
aaagaagattcaggagaaagtcaaaacccaattcaagtattctaagtgatacaaaaatgtaaagagaccaaatttattgactcattgacatccctgaaagagagggggagaaagcaaacaacttgaaaaccatattggaggatgtgatggttaatatcgagtgtcaacttgatttgattgaaggatgtaaagtattgttcctgtgtgtgtctgtgagggtgatgccaaaggagattaatatttgagtcagtggacaaggaaaggcatacccat

SEQ ID NO: 24693 - DNA, 68 bp, Homo sapiens
  misc_feature 49: w=a or t
gcattcttcaagacatctgttcacacagaagagctaggtcttttaaaawagctaggtctttcaaaaaa

SEQ ID NO: 24694 - DNA, 155 bp, Homo sapiens
aggatcgctgggaaaagtcttggactgaggagctccaaaaaggaagctgtggcgctgcgtagggaaggagggaagaaagtaggtctccgagatgctgcggcttgtggtgcagtcggccaagattgacccaccactagccccactacccaggccaa

SEQ ID NO: 24695 - DNA, 197 bp, Homo sapiens
cacgtccaaagctgtcactgctactgcttcaggctcacatccccccgacctgatggcgtgcccgccccctctccctgcggcccatgccacaggtttctgtgttttgctttagggacagaaccacttaggaaggaaagaactcccggtctccagggtggtatttcagtgtctgtgataatgtcacgcaacacctcttc

SEQ ID NO: 24696 - DNA, 220 bp, Homo sapiens
  misc_feature 63: h=a or c or t
  misc_feature 71: y=c or t
cattcaaacaacagaaagtacataaatacatcatgagagtatactacagagaactaaagagahaggaaagytaggaaatctgaatcacatttacatttattaaagtttactactactgctttgtagaacattcttgtgtttcaatgtgtggttagaagagtgaaaatatgtttggtttattgccatggcctgttagggagagtcaatactcacgggcaga

SEQ ID NO: 24697 - DNA, 86 bp, Homo sapiens
caaatagcagctcaggaaatcccacggttgacttgccttgatggcaagcttggtggagagggctgaagctgttgctgggggccgca

SEQ ID NO: 24698 - DNA, 137 bp, Homo sapiens
  misc_feature 58: r=a or g
  misc_feature 69: r=a or g
  misc_feature 77: r=a or g
agaacctcccggcggacaagaagctgggaggcgcgcagaaccatcgtcagtccccgargctctctgcartccgcgtragtcctggccaaggtctggcctcggaagctacgagctacaatcttccttcatcctaccac

SEQ ID NO: 24699 - DNA, 183 bp, Homo sapiens
gattttcaaaaaagttgcctcccgttgctcttaagtcctgcagaatttagatacatttgtactacgtttatttatgtaagatattcacagtgctctagtaatttgactcaaaattatgcaagtattagtacagtttctcataccaagatcaacaagaatgccagattgtcttccccacaaaat

SEQ ID NO: 24700 - DNA, 166 bp, Homo sapiens
tagatattgttcaactcaggagagagaaacctcatgacacatcctgatataaattgactacatattttaaagtttttattttgaaataatgatagatgcatagaggctcacaaagaaatgtatggggaaatgccatgtattcaccttccagctccctcagggttca

SEQ ID NO: 24701 - DNA, 240 bp, Homo sapiens
  misc_feature 40: b=c or g or t
  misc_feature 70: k=g or t
  misc_feature 74: w=a or t
  misc_feature 79: w=a or t
  misc_feature 82: w=a or t
  misc_feature 92: k=g or t
  misc_feature 93: d=a or g or t
  misc_feature 123: r=a or g
  misc_feature 124: r=a or g
tgaaacctttgctactggtcctttatagacaaagcttgcbaactcctgatgtagacctatgagaagtgtkaggwcttgwttwagacatcaakdataaaaagtgtcaagagtcaggaaagtttrracaaaggtatagaattgagaagtggtaggattcagcgtgtattttgaagattcatgctaaaaaaattgctggtaggttggatgagggttatgaggggaaagagaagatgaggtaga

SEQ ID NO: 24702 - DNA, 262 bp, Homo sapiens
  misc_feature 97: r=a or g
  misc_feature 233: w=a or t
  misc_feature 245: r=a or g
aaactgttttgaaaataaatagcctagtctcttatcctctttagcgtggattaaaggtgaagttctgcaaaatgggagagtgttcacagtagaatarctcagattgattgaacacatttgaggaagagactcctgcatgagataccagcatttttacaaatactttttatgtacattctttattttgtcattttgtcaaccctctccccaagcacatcttctttccttttacwatgtctatgtarggaaaaaaacaaaacaa

SEQ ID NO: 24703 - DNA, 121 bp, Homo sapiens
taggtgaaaatgatagcgatggagaaatgatagctctcaatcaatgggatgttttagtgtttcctaaaccagttgaacttagactgcggcttatttttggagaaaaatgaaatgccctcat

SEQ ID NO: 24704 - DNA, 198 bp, Homo sapiens
gtatttttgaagttgaagtttttctgggaattttttgtttgctctgtgtgtgtgtatgtctttaacacaaattggaatttgtcctgtgccaaagatttttagttgatagatatcttcagtatgggccattattttctgtctctctacataaggggcctctggtactaatattcttccacaagttgttgatcccgaccc

SEQ ID NO: 24705 - DNA, 92 bp, Homo sapiens
gttgttttgtaattataaatagtactgcaaggaataactctgtgcaaatgtgtttttgtattgttggaggtggattttcagggtaaatttct

SEQ ID NO: 24706 - DNA, 197 bp, Homo sapiens
attgtatcatagattaacattttaaattaccataatcatgctatgtaaatataagactactggctttgtgagggaatgtttgtgcaaaattttttcctctaatgtataatagtgttaaattgattaaaaatcttccagaattaatattcccttttgtcactttttgaaaacataataaatcatctgtatctgtgccg

SEQ ID NO: 24707 - DNA, 69 bp, Homo sapiens
tttatttcatcacttctttgtttctttttcttttcctgacttcctagggtttagggttttttttttttt

SEQ ID NO: 24708 - DNA, 118 bp, Homo sapiens
tgcattaaatttactaattataaaagctgcaaagcagactggtggcaagtacacagcccttttttttgcagtgctaacttgtctactgtgtattatgaaaattactgttatcccccca

SEQ ID NO: 24709 - DNA, 197 bp, Homo sapiens
  misc_feature 104: s=g or c
  misc_feature 128: d=a or g or t
  misc_feature 129: k=g or t
  misc_feature 130: y=c or t
  misc_feature 192: b=c or g or t
  misc_feature 193: k=g or t
tagtagaggcgaggtttcacgatgctggccaggctggtctcgaactcctgacctcgtgatccgcctgcctcggcttcccaaagtgttgggattataggcgtgasccctgcgactggctgtcttgaatdkyttaggatgtgagcaagaagtagtctacttcagtcactatttgccttcccactcaccacaggbkacct

SEQ ID NO: 24710 - DNA, 180 bp, Homo sapiens
aggtttttaaatgtcctagaagctaaataccttctttgctgcctcactaactgacagatggatggattgtattttttttgttcaattttggcactgtactaggtcgccatgggttgggcagatcctgaagagaaccaacttgagtctgacagtccttccagaacacggcacccacctcca

SEQ ID NO: 24711 - DNA, 132 bp, Homo sapiens
ttgccataaaataattcccccaagtggaattgctgagccaaaaggtttgcatttttacattttgaggtataatgctaaattacctcccagaaagctgcaccagcctaccagagcactgagggtaagccacca

SEQ ID NO: 24712 - DNA, 187 bp, Homo sapiens
gcttcaaggatcttcaaaatgcagctaaaattcaagatttagggcaatctattattaacatttttgttcattcaatgaacatgaaatactcccaacagtttaaaattgttaattgtagaggaggggaggtttccatggtcttttctttttctatgattccttcctctcttatttcaatatgagcccc

SEQ ID NO: 24713 - DNA, 118 bp, Homo sapiens
  misc_feature 118: n=a, g, c or t
ataaaaggcatacatctaaagattagaagacatgatgaaaacatcttccatcagtgctatagtttgaatgtttgtcccctccaaaattcttgttgaaagataattcccagtgtaacgn

SEQ ID NO: 24714 - DNA, 254 bp, Homo sapiens
  misc_feature 214: y=c or t
  misc_feature 221: m=a or c
  misc_feature 234: k=g or t
  misc_feature 235: v=a or c or g
  misc_feature 244: s=g or c
  misc_feature 247: m=a or c
  misc_feature 251: m=a or c
agggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgagaggcacagaaatggacaccagaaataaggcccagctccttgtgctcctgaytcttctmagtgtgctcttckvacagacttsggmatgmcct

SEQ ID NO: 24715 - DNA, 360 bp, Homo sapiens
  misc_feature 2: k=g or t
  misc_feature 25: k=g or t
  misc_feature 172: h=a or c or t
  misc_feature 274: n=a, g, c or t
  misc_feature 275: n=a, g, c or t
  misc_feature 276: s=g or c
  misc_feature 301: r=a or g
  misc_feature 307: n=a, g, c or t
  misc_feature 321: r=a or g
akccttgtgttcaccggagcttaakcgttgcagcaggaaaacttccatctcgctctcctggctttgatcctcactggacatcagaccagaggcaccgaaggagggaggatgcgagatgaccggccctttggcaacctgaccatcgacttagcagagccttcaaaagcaagchaggggctggctgcacgaccaaagaggcgccgcgcctctcgtggatgtgtgtgtgtgagtgatccagcgagtgtgtgtgcgtgtgagggtgtgtgtgtgtatnnstgtgtgcacagcacaactgtgtgcrtgtccnagtgagtgtgcctrtgcatgcgtgagtgtgtgtacgtgtgcatgtgtgtgtga

SEQ ID NO: 24716 - DNA, 249 bp, Homo sapiens
  misc_feature 17: s=g or c
  misc_feature 71: m=a or c
  misc_feature 72: w=a or t
  misc_feature 197: r=a or g
ttataaatatgtatcasagcattgtaatattatcactcaggctagagtgcagtggtgcagtcatggctcamwgctgcctcattctcctgggctcaagcagtcctcctgcctcagcctcctgagtaattgggactacaggtgtgtgccaccacacctaatttctattttgtagagatgggttttgctatgtagcccargctggtctcaaactcctgggctcaaactctccttccaccttggcctcccaaa

SEQ ID NO: 24717 - DNA, 187 bp, Homo sapiens
caaaaaaataaaaataaaaaataaatattaaactttgccgatggacatagaagatgacctgcatgtatgttcatactacggtcctggagagcacccaggaaggctggtgaggaagcaagatgacatctctccaaattgatttcttaattcagaatagtatcaaagctaaagacaataaactgagtgt

SEQ ID NO: 24718 - DNA, 355 bp, Homo sapiens
  misc_feature 298: r=a or g
tgggcagtctaattcttaagaagagttaatactaaaaactcttaagtgtgtgatttacttatgagaactgtttactctccaagtggatcagatcatcacaaaatggaaaagcacgttgttgacctgaaataatatgaacaaattttaagacaataaacactttagtaggctaattagtggtaaaatatgcaacactttttattagttggctaaatgtcattttgcttgcaaatcaattattcaactgctatttgataatatggttgctttattttacctataattcatttgccattargtaatcaccaaactcagtgtttataaaatagcatatcacaaacgttacccaaattcc

SEQ ID NO: 24719 - DNA, 395 bp, Homo sapiens
  misc_feature 63: r=a or g
  misc_feature 67: r=a or g
  misc_feature 138: n=a, g, c or t
  misc_feature 139: h=a or c or t
  misc_feature 174: k=g or t
  misc_feature 329: w=a or t
  misc_feature 344: w=a or t
  misc_feature 348: r=a or g
  misc_feature 376: d=a or g or t
agaaccaagagactgggtctatgtaacagttttcttcaggcagtaaattcctcttacatgctrggargagcaaagggtgggggaagagggaaggtcacttttctcccagggagaagtggtttgtgggtttctgtgcanhaaacctggggctactctttcttttcgaggaatttkatcttacattttataaattaagaagtacttgttcattgttgacagcctagaaaacacaaggaagcaaaagcaaaagcaaaaaagttacttgtatctccccattttagagatactattattaacattttgggctatagcctttcagccttttttcwctatgcacaatttgwctcrctgtctgcaattatactataaccttgtdttgttagctgttttttcat

SEQ ID NO: 24720 - DNA, 311 bp, Homo sapiens
  misc_feature 72: m=a or c
atacggtaagagccacattcgtagaaaaacttctggtgtggccaggttttaggtaactttttaatccaaaamtattgtgccataaatgtttttcagtaatattttttggtccactgtattcctgtgacacagtgcattatctgttcttgtatttctatagcacctctctattgggtttatcatcatcaacaagactactgtttactgtagttcaagtgactttcctacttttgtatttccaaaaaaaattatcttgtaagtagcttgtcatcaatccccttgtcgaaaactagaaaaaaaggagttgaccc

SEQ ID NO: 24721 - DNA, 332 bp, Homo sapiens
actagggtctcttctctgacgagatgatacctggtgtgcaagtctccttttagaaatgcatagattctgctatatatttcttttcttgttggtctcttaagaacaactgggagctcttacctaacctgaagtgtctccttgtgttgttttcaggaattgggacactcacccaggacacactatggtgcttcagccaagtgaaaggcactatcgagattggaaccacagaaggtaggagaaatccccatgcccttttccttgcctccttgggagtttgtgctgatttcaaaattaaaaactttcatctttactttcatgaatctaagtccccg

SEQ ID NO: 24722 - DNA, 261 bp, Homo sapiens
ctcctggacctgagcaaattcagactttaccataaattctatgctattttacattcaatctgacagagttccttgcagtaaataattcaagattcatcaatttaaagtacagattgtttaccaaaaatatcaacttataaaaacaagccttcgatgagttcagcatatactcttttatgttggatgacatgatgacacattaggtaacacagaaaaatattttgatatgtatttagaaactaaatagagataaaaaaaaaa

SEQ ID NO: 24723 - DNA, 309 bp, Homo sapiens
tctgagaaaaggtgttcaggccttgctttctgcttctaaaattactaactgcccaggaccatcagttcatttcttcaactgtggctccaacagatctttcgctgtttgctggcccaggtattgctctcctctgccccgagtcaatggcagctgggagtggttaccacttccttctcttaccacagttccttctctaccacagttctgttttgtatgtcattcccctagcccaggatgatcagccactttcatttacgttcattattacaccttattatctgtgcaaccaagccagtctctcctacagcg

SEQ ID NO: 24724 - DNA, 144 bp, Homo sapiens
  misc_feature 70: r=a or g
  misc_feature 108: r=a or g
  misc_feature 135: r=a or g
agcaagcatcagaactagaatcagatatgatgtgttgggattatcaaattgggaatttaaaacaactaarataaatgtgttaagggttctaactgaaaaaaagtagaraacattcaagacctgatgtgtaatatraacagagtc

SEQ ID NO: 24725 - DNA, 215 bp, Homo sapiens
  misc_feature 86: r=a or g
  misc_feature 101: r=a or g
  misc_feature 123: m=a or c
  misc_feature 138: r=a or g
  misc_feature 140: r=a or g
  misc_feature 145: r=a or g
  misc_feature 148: m=a or c
  misc_feature 150: r=a or g
  misc_feature 162: m=a or c
  misc_feature 170: k=g or t
  misc_feature 175: n=a, g, c or t
attattctgtgcctcggctgccggaagggctcgttcctgtgtcatctcctagcggcctggcgccgaggcggcggtacgcaaggctrgagccgcagcgggarcccccggtcttgtagatgatamtctccaagctgtaargragaartcmargattaaggagamctggactkgagangagcctttttcaaaaaacaacaatgacaagagaaaatgta

SEQ ID NO: 24726 - DNA, 306 bp, Homo sapiens
ttttgtgttgttgttgctgttgtttttccactagaattttgaatcggattttaccagcaattggtaacggaaaggaaaggatgtgtcttccaattgagaaacagtggttaaaaactgaaagtgggccgggcgcggtggttcacgcctgtaatcccagcactttgggaggccgaggcgggcggagtaactgaggtcaagagttccagaccacactggccaacatggcgaaaccccatctctactaaaaatacaaaatttagccgggcgtggtggcgcacggctgtaattccaggtacgcgggagtct

SEQ ID NO: 24727 - DNA, 252 bp, Homo sapiens
cccagactagaacattgtgaggctaatgcctttctagcaacaatattttagtccccagcgctattctagcagcagggagtgctcaactgacgtggttttttcacatatatttaacatggtttagctcacctgacttatatattctaaattagtgattctaacttaatcagttttttaaaaataggctatcattatagaaatatccactttgaaaataggcacaaggtattcagtttctctttatgcacagga

SEQ ID NO: 24728 - DNA, 313 bp, Homo sapiens
gatagatagatagatagatagagaaatgagaaggtttctcttttgcaatagaacgtcatggaccagtgttaaatgtgagtggaaggagttctggaattggaaaaccatcatttttcaaccatcacagtaaatatggctcaggcaagaattatcaatcaatgctaaagctagggggaaatttcgcttaggagcaggatattagggtattagtctgggcttaaagtatctcctcacagattgttgttagtttctggggaaagaatagtaaccatgcaatggaaaaaaatggacaacctcttgactaggttatcaa

SEQ ID NO: 24729 - DNA, 280 bp, Homo sapiens
aataactccctttagcatttcttgtaggacaggtctgatgttgatgaaatctctcatcttgtttgtcagagaaagtctttatttctccttcatgcttgaaggatgtttccaccggatatactatcctagggtaaaagtttttttccttcagcactttaaatatgtcatgccactctcttctggcctgtaaggttttcactgaaaagtctcctaccaaacatattagagagcaccattgtatgttatttgtttcttttctcttgctgcttttaggatcccg

SEQ ID NO: 24730 - DNA, 327 bp, Homo sapiens
  misc_feature 64: v=a or c or g
  misc_feature 67: k=g or t
  misc_feature 74: w=a or t
caacctttataaagaatacagagttgaagtaaagggtgagattttcatattgatagaaatgtavtakattttcwaccatctagaggtggaataatatttaggacacaggagttagttgggagattaataaatactttatgaatacaacaatacttcaaacattaggccttctagagttattctaagatatttggggccatacctaggcattgctatggtggtttgttgctagcctgttcacttagtcattaaaacaatttacctttttcatccttgttatacattattttctgaatttctgctttaatagttaacagtaggccccag

SEQ ID NO: 24731 - DNA, 146 bp, Homo sapiens
atgcccttgatattttttccttcatttcaaccttggtgaatctgataattatgtgtcttggggttggctcttctcaaggagtatttttgtggtgttctctgtatttcctgaatttaaatgtttgcctgccttgctaggctgggggt

SEQ ID NO: 24732 - DNA, 233 bp, Homo sapiens
agctagattctctctccgtatgttccaactctttgttacccactcctccaggctaaaatatcagggttagatttgtagaaacaagaagagctgagacctggctacttgttcagatcttaaaccagagatgtttcagccagaatggtgatttgtgaatatccgaagcagcttccaagattctaaaaccagcaatgctttttgatgagtcctctcatctccaccaagaccacaca

SEQ ID NO: 24733 - DNA, 109 bp, Homo sapiens
  misc_feature 63: k=g or t
  misc_feature 67: d=a or g or t
  misc_feature 78: k=g or t
  misc_feature 79: d=a or g or t
cttttaagtcttttgcctgtttttcaaagggttgtttgttttcttattctgtgggattgtttktaadtttttgatttkdcaacttttattttggaataagagggtatat

SEQ ID NO: 24734 - DNA, 306 bp, Homo sapiens
  misc_feature 286: n=a, g, c or t
ttttgtgttgttgttgctgttgtttttccactagaattttgaatcggattttaccagcaattggtaacggaaaggaaaggatgtgtcttccaattgagaaacagtggttaaaaactgaaagtgggccgggcgcggtggttcacgcctgtaatcccagcactttgggaggccgaggcgggcggagtaactgaggtcaagagttccagaccacactggccaacatggcgaaaccccatctctactaaaaatacaaaatttagccgggcgtggtggcgcacggctgtanttccaggtacgcgggagtct

SEQ ID NO: 24735 - DNA, 177 bp, Homo sapiens
  misc_feature 11: r=a or g
  misc_feature 137: s=g or c
  misc_feature 138: r=a or g
aggtgcaaaarttggctgggtgtggtggcaggcatctgtggtcctggctgctcaggaggctgaggcaggagaatcccttgagcccaggaggcggaggttgcagtgggccgggatcgcaccactgcactccagtctgsrtgataaaacgagattccgtctcaaaaaaaaaaaaaaaaa

SEQ ID NO: 24736 - DNA, 122 bp, Homo sapiens
aaaggaagaaattaaagagcctgaaaatattaatgcagctcttcaagaaacagaagctccttatatatctattgcatgtgatttaattaaagaaacaaagctttctgctgaaccggccccgg

SEQ ID NO: 24737 - DNA, 359 bp, Homo sapiens
tgataaccactaaagttttgttttcaaaatcaaactaattcttacagcttttttattagttagtcttggaactagtgttaagtatctggcagagaacagttaatcctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgcac

SEQ ID NO: 24738 - DNA, 239 bp, Homo sapiens
  misc_feature 134: s=g or c
caggagatcgagaccatcctggctaacacggtgaaaccccgtctctactaaaaatacaaaaaattagccgggcgtgatggcgggcgcctgtggtcccagctacttgggaggctgaggcaggagaatggcgtgasctgggaggcagaggttgcagtgagccgagatcacaccactgcactccagcctgggcgacagagcgagactccgtctcaaaaaaaaagaaaagaaaagagcccttc

SEQ ID NO: 24739 - DNA, 343 bp, Homo sapiens
  misc_feature 76: m=a or c
  misc_feature 141: r=a or g
  misc_feature 152: w=a or t
  misc_feature 153: d=a or g or t
  misc_feature 337: r=a or g
attaattaactaattttttccatgaagtgaaatgtgctacacttggtttaggttttgacacaggcttttcagctgmtggaaggaggaatatctagctaaagtggaaatttaggaaaaaattacagtcatgaattgtcagaratccaagaacwdcagatgtcattggaagcaatgcttttatttctcagagaaggcaactaaagcccagagaggtgaaatgtcttacccaaagccacatagcaagttgtagtcagaatcagctctagaactgtttcatcctggagaaccacctccatctagtgtttgcgtgtatcctcagttggatggcattcctgargctcag

SEQ ID NO: 24740 - DNA, 124 bp, Homo sapiens
  misc_feature 69: r=a or g
ttgtaaacattatttcttctacgtaattttaaggagcagattctggccagatttctgaagaaacatggrattttctgcagtctatttatggtggagggcctgaagttatcctgcgacccccggt

SEQ ID NO: 24741 - DNA, 73 bp, Homo sapiens
  misc_feature 7: n=a, g, c or t
  misc_feature 8: n=a, g, c or t
  misc_feature 36: d=a or g or t
tagaaanngtagatactaggtgtagtcggtgcaaadgtaattgtggtttttgacattgaaagtagtggcagct

SEQ ID NO: 24742 - DNA, 356 bp, Homo sapiens
  misc_feature 7: n=a, g, c or t
  misc_feature 8: b=c or g or t
  misc_feature 10: r=a or g
  misc_feature 11: n=a, g, c or t
  misc_feature 123: y=c or t
  misc_feature 124: w=a or t
cacgtgnbarnaagtgtaacttcccttttctggattctcaagcagttactttcacggtcagaacacgcagctattatgattgaaaacttaaaagggcaacaatttcagtcttgcttctagggywagacaggaacttggcaaacatctgtggcctgttcagcaaaggatgttaatatttaagaatcttgtcttgggctgggtgtggaggcaagtggatcacaggaggtcaggagtttgagaccaacctggccaacatgatgaaaccccatctctaccaaaaaaaatacaaaaatcagctgggcgtcgtggtgtgcctgtagtcccaacgcaggaggttgaggggagaattgcttgaa

SEQ ID NO: 24743 - DNA, 378 bp, Homo sapiens
  misc_feature 2: h=a or c or t
  misc_feature 7: n=a, g, c or t
  misc_feature 8: n=a, g, c or t
  misc_feature 146: d=a or g or t
thataannatgtatcacagcattgtaatattatcactcaggctagagtgcagtggtgcagtcatggctcactgctgcctcattctcctgggctcaagcagtcctcctgcctcagcctcctgaagtaattgggactacaggtgtgtdccaccacacctaatttctattttgtagagatgggttttgctatgtagcccaggctggtctcaaactcctgggctcaaactctccttccaccttggcctcccaaagtgctgggattacaggcaagagcaactgcatccagccttactaatgttgtttatttcattgagtaagtaagctttagtgcatatactatgcaaaggtcactgtttagcactgttagcgagaatacata

SEQ ID NO: 24744 - DNA, 130 bp, Homo sapiens
  misc_feature 130: r=a or g
aaaacgctccgcggcgccatgggctgaaaactcaaccgagatggaatctcccagtctgaaccggtttcaaccggttccgagtttgaggcactaggaggagggggagaagcggctgcagcggccgcggcar

SEQ ID NO: 24745 - DNA, 336 bp, Homo sapiens
  misc_feature 119: m=a or c
  misc_feature 196: s=g or c
tttggcttgcagactgccttctatcccagaacagctgagaaatctatgaagctgagattctgaaggacccagcttaggttcttccacttaggcctcaattcccttccttttccaggggmagccttagtttcccatggccctgaaacacacacatttcccccttcctttcccagaagccactggccccccatagcasccagtgcatcctttttacaagtggaagaactaggatggctttccaaagtcttctagaaatgaagttctttctctgtgcagctttcccccttggagcaggagtgaagatgtttcattatcttgggcctgggaaaccacttc

SEQ ID NO: 24746 - DNA, 174 bp, Homo sapiens
  misc_feature 100: s=g or c
  misc_feature 140: r=a or g
gccgtagtgaccactgaccgggtcttgctcgatcaggccgatcttgccaaagctcaccagataggggtgcgccttggccgcggccatacccgcggcacgsccaagtccttcagcggcagggccgagccgctgcgcaccarcgccttgagcaactgcccccccacctccacgctc

SEQ ID NO: 24747 - DNA, 121 bp, Homo sapiens
ctcatctccctcacagcccccaaaaaatctgcaacccagtttaccggtcgctaccattacctggggggtcgttttgtgccacctgctctggaaaagaagtaccagctgaacctgccacccg

SEQ ID NO: 24748 - DNA, 357 bp, Homo sapiens
  misc_feature 104: w=a or t
caagaaagtcttgttggttctatctataaaacatattcagatcccaggcggggcgtggtggctcaacgcctgtaatctcagcactcggggaggccaaggcgggwacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactctgtctggaaaaaaaaaaaaaaaaaaaaaaaaaaa

SEQ ID NO: 24749 - DNA, 212 bp, Homo sapiens
actcttaaagcaatcatataagcattgtctttttaattgtccactgatcatgtcttaataatttgtttcagattatgccagatactcttggtcctgcttaccttggtaattgagggtagaattaagaaagttttaggattaggaatcattcttctaattcagagagtaattagttggaatcacaaaagcattaggtgctgaactgccagaga

SEQ ID NO: 24750 - DNA, 258 bp, Homo sapiens
atagatatatatagtgtaaatatataggagtaaaatttgtattagaattccagctcaggcacagtgacatatgcctgtaatcctaaaactttgggaggctgaagtgggaggattgcttaaggccagtagttggagaccaacctgggcaacatagccagacactgtccctatagaaaaaaaaattagccaggtgtggtggcatgctcctgtagtcccaggtactcgggaggtggacacagaaggatcacttgaggccat

SEQ ID NO: 24751 - DNA, 172 bp, Homo sapiens
acgcgaacgcctaagtgaccagaacgactggtgtgaagccgtgatctgactctgtggagcctgggactggtttcagcgagagcctctgtactgctctgtagtctctgctaggacatggacgaaaagggacgcagccgggagagcgactgccccaggtgggggctggggggga

SEQ ID NO: 24752 - DNA, 176 bp, Homo sapiens
catttaaaccacagcagaaatacaatagaaatttaggagtatcatctgctaaaccaacatccagttttgctgaactctgaggttctgtatgtccaaatacacttgactcttgaaccaagttgggggttaggggcactaattctctgtgtagcagaaaatccacaagtaacttttga

SEQ ID NO: 24753 - DNA, 446 bp, Homo sapiens
agtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagccatccctgcattcctagtatgaaacccacttgatcacatcatggcaaatttcaagctaccaacatgagggcacga

SEQ ID NO: 24754 - DNA, 108 bp, Homo sapiens
cttttaagtcttttgcctgtttttcaaagggttgtttgttttcttattctgtgggattgtttttattttttgatttttcaacttttattttggaataagagggtatat

SEQ ID NO: 24755 - DNA, 321 bp, Homo sapiens
atcccatcagccgagatgaacctctagtcttgctttgaaaaaatcattctgtgtaactcttgactgtgactaagttcctaatacacctgttgggacgatcactgacaccgtataccattttagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcaccg

SEQ ID NO: 24756 - DNA, 390 bp, Homo sapiens
taacaaggcagttagaccatcttaatcaccgtcttttaaaaatttgctttttctttaattaaaaaaataacatttattggcattgccaggcacaagcctaggtgtcaaagagacagaaataaaacagagtccagactttaagaagactctaataagggagacaacaggtaattacaataaaatgtgccctaacataaaaacacagcatattgtggaaacatttgttgagggtgaatattaaatttagcctgcagaggtgaaggaagtcttccaggaggagcttagaaggagttcagaatttgttgagcttcatgaatgcagaaaaattgaggcctcattcccctctgcatccacactacctgctataacggccagaatatagtgggcccg

SEQ ID NO: 24757 - DNA, 201 bp, Homo sapiens
taatacacatttataaataacttacagagtatctatcatatactgtaataattcttaaaataaatttttattgcaaatttacttaccacagacataatttctgagtcaagtctttcaacttttcttattccaactacacaaagaaattagtggaactgtagaaaatttacaaaatagaggaaaatatataaatgggtaaac

SEQ ID NO: 24758 - DNA, 160 bp, Homo sapiens
  misc_feature 126: r=a or g
  misc_feature 128: r=a or g
gaatgattagtgatgttgagcatgttttcatgtgcttgttgaccaggtttacatcatctttggaggaatatctattcaagtcttttgcccactttaaaatcagattttgttgttgttgagttgtargrgttctttacatattgtggatattaacccctta

SEQ ID NO: 24759 - DNA, 151 bp, Homo sapiens
ttaatttcctttcaataatgttttgtaattttcactgtataagacttttcacagcctaggttaaatttattcataggtacaaacagttgttaattcccacagttttacttaatgattttttaactttatgatagggtttactggaggatat

SEQ ID NO: 24760 - DNA, 295 bp, Homo sapiens
atttctgtaactccgtagactatcgatttaagcgccgccccatcttaccagtattttggtttcaccgtgtttatgatgatgttaataaatctaatgtgcaaaaataccgttttaggaacacaattggagataatttttttttgtatttgagacggagtttcccccttgttacccaggctggagtgcagtggcgctatctcggctcaccgcaacctccgcctcccaggttcaagcgattctcctgcttctgcctcccgagtagttgggactacaggcatgcgccaccacgcccggg

SEQ ID NO: 24761 - DNA, 210 bp, Homo sapiens
  misc_feature 135: d=a or g or t
  misc_feature 182: k=g or t
aattctcctgccccagcctcctgattagctgggattacaggcgtgtgccaccatgcccagctaatttttgtgtttttggtagagacggggtttcaccatgttggtcaggctggtcttgaactcctgacgtggtgdtccacctgcctcggcctcccaaagtgctgggattacaggcgtgagckaccacgcctggccgaaaaacccactcga

SEQ ID NO: 24762 - DNA, 119 bp, Homo sapiens
gtctttccccttctgactgccgccacgctgcagtccagaatatttgaagatcaaaccgaacttgagagactaacgagaacggtccctttttattcctaacagattccttccgtggtact

SEQ ID NO: 24763 - DNA, 110 bp, Homo sapiens
tttagagtgtataattctgttggctatctcttcctccttgaatctctcttgttccttggtattcagtacactggacttcctgattctccttttctactaacactacccca

SEQ ID NO: 24764 - DNA, 211 bp, Homo sapiens
agaaggcgaagaagaaagaaaggggaagcagtgaagaaagggacggagatactgggacagggagaaaaaagttgtggagagtagcttttaaggagtcatttggtggccatggatccaacgtgctcttctgagtgcatttataacctcatacccagtgacttgaaggagcctccccagcctcctaggtacatatccatttttaaggcaacag

SEQ ID NO: 24765 - DNA, 213 bp, Homo sapiens
  misc_feature 135: m=a or c
cccaaagtgctgggattacaggcatgagccacagcacttggccttatttattttttaaatagagacagggatgtcactttattgcccaggctggtgttgatctcctagcttccagcaatccttgtgctttggctmccaaagtgctgggattacaggcatgagccaccataccgagcccctagtgaattttaagtaagatttgtgtagtgctgt

SEQ ID NO: 24766 - DNA, 366 bp, Homo sapiens
  misc_feature 18: r=a or g
  misc_feature 19: r=a or g
  misc_feature 20: r=a or g
  misc_feature 30: h=a or c or t
  misc_feature 128: s=g or c
  misc_feature 289: w=a or t
  misc_feature 290: m=a or c
agaacccggggtgtgggrrrcaggcgtgchtcagggcttgctttatggtataagctttgtctgcttcagggacttttaggagctggggatcctgggcccagccgtaaccagacagatttctgagcccsattatcccatcccctctgtctggacggtagagcagtctgaatgttcctcactaggaatccacggcaagacagttattcattcattcaacaaatatttattgaatgcccgctgtgggttagtcaccggagcggcaacagtgagtaaataggactatctctgwmcccaagaatcttacaacacagtctctccctccagcatctggttttgtagcctggatgtgtctgctagtagccgaat

SEQ ID NO: 24767 - DNA, 165 bp, Homo sapiens
gaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccgatc

SEQ ID NO: 24768 - DNA, 183 bp, Homo sapiens
aaagagatctatggaaaactgggaatgtaatgtggattctgtcagagctcctacagagcacagttgcctttagtttcctttaaagatgtaaaaatattgtataatacagttttgtccctacacaattgtatttgccaagcttagtgcattatgatacctttatttatttgttttgggcagtgt

SEQ ID NO: 24769 - DNA, 298 bp, Homo sapiens
aggctggagtgtgagagcctctgtgacgcgcatctgccgggctactcatacagccagtgcccagcgctgtcctcccagcagaggagctcgtctgcgcggaaccagagagcgatctcgcggcgggcactctccaccgagtcgctgccgtgaatcaggttcctgcgcggaagaggcgcgtgtgagcgtgggaaagagacctccggcacgcttcagcgccaccaacttgaagcccttcctctcgaagcgccgcacaatctcgcccaccagccgccgctgcacgccgtccggcttcacggcc

SEQ ID NO: 24770 - DNA, 328 bp, Homo sapiens
aagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccact

SEQ ID NO: 24771 - DNA, 242 bp, Homo sapiens
ttaaaaacggttaagatggtaaattttatgttatgtgcacctaaccccagttaaagataatgattaaaatagtgtttacttttgagtacagttttgttctttacacttgccaaaatctttctttgttcaaatttcttttaaaaatctgttaacaggaggttaagtgtgaatatttcatcttgttctgtgacagtaaactagtcatctatagtagagagcagaaaataaaaatatttccagaa

SEQ ID NO: 24772 - DNA, 203 bp, Homo sapiens
tgcctattagttgtgttacttattcagatatcttctgtgaaaaacctgaccttgtgaaggtaaaatcttttgtcaatttgtaatttaaaaaaacatatttttacaatgggtcaaaggagttctttatattttctggataccagtcttacgtgagatatgttttgtgagtattttttccaactatcatttgtctactcattggc

SEQ ID NO: 24773 - DNA, 250 bp, Homo sapiens
  misc_feature 182: s=g or c
  misc_feature 183: k=g or t
gacttcattgcataatgcagtagccactggatttgcagcagaaacactctgctacagaacaagtgtcttggttcaccaaagaggacaaagaaaacagcaagttttagggggttgaatcctggattcccctggcaaacaccattctactttccgtctctacgaatttgactactcgaagtacskcatgtgaaatgttggtgccaaatgaacttttctggttcttctgaatatgccactgttgctggagaaa

SEQ ID NO: 24774 - DNA, 313 bp, Homo sapiens
  misc_feature 274: h=a or c or t
  misc_feature 296: k=g or t
  misc_feature 298: y=c or t
caaatgaactcaagtaatgcaacataatacatttaatgaacaaatcaaagcagtctgccggctgaactcagttagctgctctgaaagtgacggagttaaatccatcacgccttttacaactgtcttagttaaaaataacctagaaatatctttccaagctctggctatcagcctttatcagcttctacactggtgagttaaatgtggcaagagacatccactttgccccaagtgtattaatgcaggacacagtctgaaaatgcttgagcttgchtgatatttttacaaatgtttakgytttaaagcccaatca

SEQ ID NO: 24775 - DNA, 154 bp, Homo sapiens
  misc_feature 99: r=a or g
  misc_feature 100: r=a or g
cttttaggcccattgggatgttcattagaactctgaaaactacagttctcccctttatgaggactgcaccacagctcgccctctcctgggttccgcctrrttgcagagtgagcccatgggacagccctctgaaattatactgcttacaaccgca

SEQ ID NO: 24776 - DNA, 224 bp, Homo sapiens
  misc_feature 39: m=a or c
  misc_feature 64: r=a or g
  misc_feature 107: w=a or t
attttggagcagcaatttttattttaaataaaattccamttttaagaaattcagggaagatttrgtcacattgaagatacagtatttttgtagtatttataaactgwtctaaatgatagactatagaaaacatttttgtcatatgaaggtaaatcagtccattattttggatcatttaaactgaacattacaccttctgggctttgatttatgaagtggcacag

SEQ ID NO: 24777 - DNA, 267 bp, Homo sapiens
aagaataagtatgtcatagcctcttgaaactacattagtaatgattgttgtttaagatgctggagatgtagtggcaggagtagtccaagtatcttacaggagcaaagaggcaggggacctaacccttcaggtggtgaaagatgaagagtaatgtcaggaatgacttcctagcagcagagacacttgagctatgccaacagtgacgaggagataaccaggtgaggtgtgagaggatgcagaagtgaggagcgcccagacagagagggg

SEQ ID NO: 24778 - DNA, 87 bp, Homo sapiens
caaaagctttttattgcttttagatagactcggaaaaggctaagatgtcctgggcttccctgtcaatgtgcttccctgaagtcagtg

SEQ ID NO: 24779 - DNA, 267 bp, Homo sapiens
  misc_feature 14: r=a or g
  misc_feature 78: r=a or g
  misc_feature 79: r=a or g
aatcttatatgggrcttacgataaaatgtattgatgttagtgattgtcaaaataggtttatcatttaaaaaactaggrrattactaagtataaagaagaaaaaccagtattaattaagtgatgagacctgttcattttgttttccctgacttatttccattaccaaacatagtaaagtccagaaaagattaaaaaaaaaattaacacagccattccattgttttttaccacatggagaaaggaccaggctggaagcatatgtccccc

SEQ ID NO: 24780 - DNA, 86 bp, Homo sapiens
  misc_feature 14: r=a or g
  misc_feature 60: r=a or g
  misc_feature 70: r=a or g
  misc_feature 76: m=a or c
ccgtgagggaagcrcaagtcctgtgtaggcccagagaagggaaaaagccttttttgggcrtaagagtgartgttgmgggttggaga

SEQ ID NO: 24781 - DNA, 100 bp, Homo sapiens
  misc_feature 48: k=g or t
  misc_feature 79: r=a or g
tctcacaattctgcaggctggaactccaacatcaaggtgttggcagakgtggttccttctgtaggcccctctccttggrtaaccatctcttccctgtgtc

SEQ ID NO: 24782 - DNA, 157 bp, Homo sapiens
taatacacaaaacaaaaagaagatacaaaaatgagagctgggcgtggtggcatgcacctgtaatcccatctacttgaggctgtggcaggaggaatgcttgagcccaggagtttgagaccagcctgggctgacatagcaacaccgtctcaataaaaaa

SEQ ID NO: 24783 - DNA, 210 bp, Homo sapiens
cccctgaggaccattatccagccctcttgcagactgtcttacctttgatcaagtgtcagccttgcttggtataggtagcttttattccattaatagctgaaatttagaaatagttctcttctctggctagggaggtgaagtttctgaaggctaataagtttatagtctattatcttataactttactcaacaaatatttatgaggcaatc

SEQ ID NO: 24784 - DNA, 137 bp, Homo sapiens
taactgtaacaattaataacttaatctggacttcagttttacttacctattcccctcactcttcattgttacttccaaatgaagttttatgttttaccaccttatcttttatacacaataaattaaaagtcacacga

SEQ ID NO: 24785 - DNA, 198 bp, Homo sapiens
agtatgttatatataactttatacaatctaaagggatgtaatttaggcctgcattatatttatgtcaacaattatgacaatttaaataatcaaaactaaggcacagtctaggtttccaaagtcaacttatgtggaacaaaccacttcagaagtaaagttagactactttactgcattcagaaagaaagttgggacact

SEQ ID NO: 24786 - DNA, 443 bp, Homo sapiens
  misc_feature 274: r=a or g
  misc_feature 319: r=a or g
  misc_feature 336: w=a or t
  misc_feature 348: r=a or g
  misc_feature 359: m=a or c
  misc_feature 370: m=a or c
cctgtctgacaacatcataagagtcatggttatgtaattcctgtcatcagaaatcaagagaaatacctgtttcttgggtgaaaaaagcctttttttgtagtactaaattgtaaaagcattgagctatacatagtgggcactaatgatttattggacagtgtgataaacagtattttttacaaataaatttcatcccagtatccttgaatcctcctcaggtaaaccccgagactacctgataagcagtgatgtgctggaggccaggataatatgrcaaagggatctgctgagtccaaaaataaagcttcatctatttaarggatgactaggctgcawagttttcagagratatttcacamtccggtctcamttctctgagccaaacttttcaaatgaagtcttttgcatttttcaactttttttgaaataatttcaaatctact

SEQ ID NO: 24787 - DNA, 165 bp, Homo sapiens
gagcaggggggaggagaggggctggctctcagtccccgaatcgcgtggggtgcctccaccccctgcgatgggggtccctagagccagggggggaagaggggctggctctcagtctgcgcctcgcggaggatgcctcccccacttgcaatgtgagtcctaagagca

SEQ ID NO: 24788 - DNA, 417 bp, Homo sapiens
ctaatcgtgtgtaaggaggcattttgtgtgtctttgcaatgtatacaattggattatttggaacaccattttgaatgtgtatttgagagaaagctcgcctgtgggttttgagttgtggtgtaatggtgaacatgtagccacgtgaaaggccgttggatctttgttctgattcttcagtcgtcttcttgcaaattcagagaaatgtcttttaatcatttcgtttacatatcccagatccttggaaatcatgaaaaataacttgccagagtttgcatcagccctcagtaagtcatgaaccatagagaaggtcatggggccatttattctttggaccactggctacttctgaagttctggcttccttctctctaggaggagtcgtgtattcaggcttttaagttaaatgcataaaaattc

SEQ ID NO: 24789 - DNA, 154 bp, Homo sapiens
ataagaaaacaagaacaaataactccctagttaggtcctgtgccaaattatatgtcacttttgaactgatgtttgtaagttacttagtaataaatcattgagctatgttatgtatctctcatatgtatgaagatagaaatttacaccccacgac

SEQ ID NO: 24790 - DNA, 122 bp, Homo sapiens
tgagaaaggtaatattggtaaataaagaaataggaaacaatgtaacaaatgttaagtacagaaatacattaatgggtggtaaataaagatgtaaaagaaggcaatgcgatcgatggtggcaa

SEQ ID NO: 24791 - DNA, 213 bp, Homo sapiens
caacattcgatttattggaggcctacttgcagcatattacctatcaggagaggagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacc

SEQ ID NO: 24792 - DNA, 345 bp, Homo sapiens
tactggcttcttttaactaccatgtttttttgagattcatctagattatggtatatattactgttctttattgatgaataatatttcactgtatggatatatttcattttgtttatccatcatttgacggatgtttgcatttacagatgttgtcttttgtcagtaatggtgctaaaaacattcatgtacaacattttatgtgggcatgttttcatttttcttgagtatacattaaggagtataattgctttgtcatggcatgtctaggtttaatgttgtgggtaattaacaaattttaataaggtgcctgcaccattttacattttcatctgcaatatgaggaaa

SEQ ID NO: 24793 - DNA, 305 bp, Homo sapiens
  misc_feature 281: y=c or t
aaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaataattcagcttagagaactatcaacacaggacaatgcaagcccatgagctgttccggtattttcgaatgcyagagctggttgacttccgacagcg

SEQ ID NO: 24794 - DNA, 138 bp, Homo sapiens
actacctcatgatttaacttccctctcaccaccgtcatgctcgtttggaggcccaggaacacacagatcaggtgacaatgcattcagctgcaggggtaatcattcacattcacacgcatgggactatgctaggcaaaa

SEQ ID NO: 24795 - DNA, 321 bp, Homo sapiens
  misc_feature 2: n=a, g, c or t
  misc_feature 3: h=a or c or t
  misc_feature 275: m=a or c
anhggggggtgttctttggcggtcggggcaggggtcacaaggtgctcagtgggggagcttctgagccaggagaaggaatttcacaaggtaacgtcatcagttaaggcaagaaccagccattttcacttcttttgtaattcttcacttgcttcaggccatctggatgtatatgtgcaggcttgggctcagaggcctgacaataataaaaactgacacttgcaaatggatgagaagtctagctaaaattttttcaataactgtttgattatgtttamttacaattcaaacctaatgttgtcatcctttaatattcagctacta

SEQ ID NO: 24796 - DNA, 313 bp, Homo sapiens
  misc_feature 3: h=a or c or t
  misc_feature 73: n=a, g, c or t
  misc_feature 74: n=a, g, c or t
  misc_feature 75: n=a, g, c or t
  misc_feature 260: w=a or t
  misc_feature 261: b=c or g or t
  misc_feature 262: w=a or t
athcaatgggcaccaggagaaaggttttggttcttggatctggctacatatctgcagcctgtattagaatatnnntcaagagatggcaatatagaaataacagtaggatctgacatgaagaatcaaattgaacagttaggcaagaaatataatattaatcctgttagcatggacatttgtaaacaagaagagaagctgggcttcttggtggcaaaacaggatcttgtcatcagcttgttgccttatgtattgcaccctcwbwgtggccaaggcctgcatcacaaacaaagttaacatggtcactgcaagctac

SEQ ID NO: 24797 - DNA, 128 bp, Homo sapiens
cgagcgagagttgcaaagttgcacgcgggagttggggctgggggaggaaatgcagctgtgcacaccgccggttgcggccatcgccggatcttgtgcattgagtctagatgtttgcagacctggacaga

SEQ ID NO: 24798 - DNA, 392 bp, Homo sapiens
caggctcttctcgttttactgaaaaaggcacctcctcagggccgcaagcttcttatcattgggaccactagccgcaaagatgtccttcaggagaatggaaatgcttaacgctttcagcaccaccatccacgtgcccaacattgccacaggagagcagctgttggaagctttggagcttttgggcaacttcaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacaga

SEQ ID NO: 24799 - DNA, 288 bp, Homo sapiens
  misc_feature 105: w=a or t
atgtacttctaaaatcataccaggacaaaaaggagttataaatcaaaaatgaaatactgctggcttatatgcttgcctatctagctgccataaccttcgttattwatttttttgtatggcttcaagttactgtctagtgccctttcatttcagcttagagaacttccttaactctctttaccatatcttgtaggacatgtatactagtgacaatctctctcaactttcgtttatctaagagtatcttagtttctccttcatttttgaaacatagttttaccagacggt

SEQ ID NO: 24800 - DNA, 150 bp, Homo sapiens
  misc_feature 71: n=a, g, c or t
  misc_feature 72: n=a, g, c or t
  misc_feature 77: m=a or c
  misc_feature 85: b=c or g or t
  misc_feature 95: m=a or c
  misc_feature 97: r=a or g
  misc_feature 101: s=g or c
  misc_feature 102: s=g or c
  misc_feature 109: r=a or g
  misc_feature 110: s=g or c
  misc_feature 118: s=g or c
ttccagctattaaaattgacgatatcaggcttggcacagtggctcacgcctgcagtcccagcactttgggnngccamggtgggabgatcacttgmarccassagtttgrsataaaaastaggatatcagtctacttataatcttgccccc

SEQ ID NO: 24801 - DNA, 421 bp, Homo sapiens
  misc_feature 2: m=a or c
  misc_feature 3: n=a, g, c or t
  misc_feature 4: h=a or c or t
  misc_feature 238: r=a or g
  misc_feature 308: m=a or c
  misc_feature 358: y=c or t
  misc_feature 359: d=a or g or t
  misc_feature 369: r=a or g
  misc_feature 378: v=a or c or g
gmnhaatactcatcttttcagaatgggaataggacaaatgaaggagagtaaaacttcatcctttattgctttttttcccttttctcctaatagcctgtaggtgttaatataaatgttaaaaatatttgtacagggtgtgcatgtatggtctaaagaattaattgttattaacacagcattgtgtattcctgtaacttatttctggtgttggggatgatttgattaattagttcttagraaaacagatgctggtgccgcattctcggctttccaggcaaattgctattctctatatttgacccgtagcmtgtagaattgtattctaccctatgaaaaatttataatcaacttcttaccydttaaggcacrtagagatgvaatccagcgcaaatttgatgctcttcgtaacagctgtactgta

SEQ ID NO: 24802 - DNA, 188 bp, Homo sapiens
caagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccgag

SEQ ID NO: 24803 - DNA, 133 bp, Homo sapiens
atgggccaggaaccaacaggactactgtaaataagttcctgtctcttgccaacaagaggttaccagtgaaaagagctgctgtccagtttttgaataatgcttggggaatccaaaaaaaacaaaatgccaagca

SEQ ID NO: 24804 - DNA, 177 bp, Homo sapiens
  misc_feature 3: r=a or g
ggraactggaagagaaggagcatctgttacagagcaacattggcacagggtagaaagagctgggtcttaggacccaagccttagagatgaataaacgcaaggtatgattgattaatctaatgatggttagtctcagtggaacaaataagtataacactgttgagattgtaagttcgc

SEQ ID NO: 24805 - DNA, 191 bp, Homo sapiens
  misc_feature 95: s=g or c
  misc_feature 96: m=a or c
  misc_feature 98: s=g or c
  misc_feature 99: m=a or c
  misc_feature 127: m=a or c
  misc_feature 132: s=g or c
  misc_feature 133: m=a or c
  misc_feature 137: m=a or c
  misc_feature 159: m=a or c
  misc_feature 167: s=g or c
  misc_feature 168: m=a or c
tttaatatttgcctttatagagaccattggattctcacgtctatttctgcatttagtccattgccatatgctgttttggttgaaatatatgcatsmasmttcaggctttcacaggcatgtaattggmaaagsmaagmatattttgatagcctttttagmtaattgtsmatattctttgatagtgcgccaaa

SEQ ID NO: 24806 - DNA, 166 bp, Homo sapiens
gcaaaatcgaaggtggttcttcagggccgggcacgctttcacaaaagatggtgatgttaataataacctgccctctttgtgaagattggcaggccttcattgtcataggctgtattcgtagggcctttatgcctgcaaaactgggacttttgagtttgagaaacga

SEQ ID NO: 24807 - DNA, 201 bp, Homo sapiens
aatttgtgttgttatctgttctctgaatgtttagtaaaactgtttataaagctataaagggttgtatagctctttatctttaccttttgtcttacccctgatttttcaacttttttagtagagatgttgaggtcttgctctactgcccaggctggtctctaactcttggcctcaagtgatcctcctaccttggccccccaa

SEQ ID NO: 24808 - DNA, 121 bp, Homo sapiens
taaacttatgaaaatgtattaagaaagagtgcagctcgagagagattcagagatggaacacaccagaccccagatcacaaagccaaccatgcccagcccctcccagcacccccagccccac

SEQ ID NO: 24809 - DNA, 150 bp, Homo sapiens
ttccagctattaaaattgacgatatcaggcttggcacagtggctcacgcctgcagtcccagcactttgggaggccaaggtgggaggatcacttgaagccaggagtttgacataaaaactaggatatcagtctacttataatcttgccccc

SEQ ID NO: 24810 - DNA, 298 bp, Homo sapiens
cattgctcagagcctctgttgagttcccttctgaggaggatgccagaattagagactctggagatcatgaagttggtgaactgcccagagaccttcgcatcagacatgaggtgcatcatgggcgagtctcctgcagtgtagggctactttgtcctggcaggaatgaactctgctggcctttcatttggtggaggagccggaaagtaagtctttctcactcaaagtcagctgtgaacataagtcaacttgctgggtctcttcccttctagaattacttgttattaacatggcgtgctca

SEQ ID NO: 24811 - DNA, 230 bp, Homo sapiens
  misc_feature 34: y=c or t
  misc_feature 87: w=a or t
caaattctggtaatgttttcatggtttgattttyatattcttttgtatattgtattaagacattaacctttttgtttttgttttgtwttcactttaggggacacttaacaaatccactagttcaagaagcttaaaatcccttgaccctgaaaacagtgaaactgagttagaaaggattttgcgtcgcagaaaggtgacagcagaagcagatagcagtagtaagccggtca

SEQ ID NO: 24812 - DNA, 292 bp, Homo sapiens
gatgattgcattagaaaccaagagtgaatatacatcacagaaagtacgataagaaaaatggaaaaatgaagaaaataaaaagatttttaaaaaggagtcaagaggtgacaagacaggcaaagagagccagaataaatataaatggagttccccaaatgtaagcccaaggatagtggtgatgtttatgtaacactgaatatacttaatgccacttattgaatactttaaaacagtaaattttatgttccttattttactacagtaaaacaaagcaagccaaagcaatggacgc

SEQ ID NO: 24813 - DNA, 176 bp, Homo sapiens
cgacagcaacccgaagacagggaaatttaggtaaaaaccaaacagttatgagttcttatagttaactgtccatctgctttgcttcttcttagccttgttgccatcacctggtccaaattgccaactgtctttcctggattattgcaacaccctttgtgctgcttgccctactaccc

SEQ ID NO: 24814 - DNA, 193 bp, Homo sapiens
  misc_feature 21: y=c or t
  misc_feature 22: y=c or t
  misc_feature 23: y=c or t
  misc_feature 138: k=g or t
  misc_feature 139: w=a or t
  misc_feature 145: m=a or c
ttacgggggtgcccattttcyyyctgggagtgttctggagaagcaaaccaaagtgtgtgcacagactcacagagtccatgacacactggggccaggagctgtgtttcgtggtctacccccaggacgcccccgaagagkwggtagmatggcccctgcccaccctccctgctgcctgccacagacaagcccccca

SEQ ID NO: 24815 - DNA, 238 bp, Homo sapiens
tagtttggaattctgtggctatttaggtgactgacataaatgggggcagaggacataatgaggttagttcttacggattcaaggcagatagtgttggtgaaacagtgagtggcaaaattaggcgaggtggtgactgggctccctgatgacctcttgtcgtggagcaaaactgaataagcaaaaacttactcaagctcctgaggcccattcatcatccctattgatagatttgaggtga

SEQ ID NO: 24816 - DNA, 90 bp, Homo sapiens
  misc_feature 23: r=a or g
  misc_feature 70: n=a, g, c or t
cttgtgtttctttgttgctgcarctatctgcccaagttaatgcaaatggacacattttttatgtcagaanaacacacacacacacacaca

SEQ ID NO: 24817 - DNA, 104 bp, Homo sapiens
tgggtctattgtctaatggtgaagtttgggcttccagtgaacccatcagccaaatattgaacattgttcccagtaggtaatttttgatcgttacctccctccct

SEQ ID NO: 24818 - DNA, 51 bp, Homo sapiens
  misc_feature 1: m=a or c
  misc_feature 28: r=a or g
  misc_feature 29: h=a or c or t
maagccctgaagggtcaaaagaaatacrhaagcaaaggctattttcttttt

SEQ ID NO: 24819 - DNA, 236 bp, Homo sapiens
accttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgctgg

SEQ ID NO: 24820 - DNA, 109 bp, Homo sapiens
attccggcccagcctcttcctccctcgctgtgccgaggagggatctagaagggactttccagagagggttagcgtgcagggtgtggaaatggaataaaagcatatgcaa

SEQ ID NO: 24821 - DNA, 167 bp, Homo sapiens
aatcaatgaatccaggagctggttttttgaaaagatcaacaaaatagatagaccactagctagactaataaagaagagaacagagaagaatcaaatagatgcaatagaaaatgataaaggggatatcaccactgatcccacagaaatacaaattaccttcagggagc

SEQ ID NO: 24822 - DNA, 229 bp, Homo sapiens
aaacggattggcctaatgaagaagttcaacctggagagatggaaaatcagctctcataactaagttaatttagtataaaaatagaattgatagtgagggtataaagtgtaaccatcagttaaacctctcctgtcattcctagcttccttgcttcagaattgaaatggaagtgggggtgtccctactctgtagaatctgggactgggcaaatgtttgtgtggcctccttt

SEQ ID NO: 24823 - DNA, 349 bp, Homo sapiens
tgtaaaactgaggcacgagcaaagtgaagacactggctcatattcctgcagcctggaggccgggtgctcagggctgacacgtccaccccagtgcacccactctgctttgactgagcagactggtgagcagactggtgggatctgtgcccagagacgggactgggagggcccacttcagggttctcctctcccctctaaggccgaagaagggtccttccctctccccaagacttggtgtcctttccctccactccttcctgccacctgctgctgctgctgctgctaatcttcagggcactgctgctgcctttagtcgctgaggaaaaataaagacaaatgctgcgccctt

SEQ ID NO: 24824 - DNA, 307 bp, Homo sapiens
  misc_feature 99: m=a or c
tgcctttgacctattaaagaaggaaagtgggtaatggagtcccagccactcaagagactggatatcccccgagaatggcttgggttaccagctatggamcccttggaaagatgaatctaatccttctcactggtttttctttgcaaattcatttgcttttatttttctaataacaataaactctattttccatgttctcagggcccctgggtagacagacacagcttgatttcagagcagacataggcgaagaaaacatggcattgagtgtgctgagtccagacaaatgttatttatatacacatcc

SEQ ID NO: 24825 - DNA, 117 bp, Homo sapiens
  misc_feature 101: r=a or g
  misc_feature 115: s=g or c
cttctcctcgtttccacccctcccccctcggtcgtgggcctcattcacgcttccccgggcttggggagggggcggaggcccggcgtgacaagcggcccagractcccgtggacgsct

SEQ ID NO: 24826 - DNA, 235 bp, Homo sapiens
  misc_feature 33: m=a or c
  misc_feature 91: k=g or t
  misc_feature 92: k=g or t
  misc_feature 99: m=a or c
  misc_feature 104: k=g or t
  misc_feature 136: r=a or g
gagatgtattatgcaaagtaccaactgagccamaaacaataaacgaaacacagaactcagccttaagaaagctatatatgaataattatgkktacctcmctggkgcatttacaatggacttttgttcatgggagarcctcgttgacatgcacagtttgcaatcttatgttgatcgatgttaaacgtcacagcagtacttgctcaataaaggtcatattggaaacatagtcaaaaa

SEQ ID NO: 24827 - DNA, 315 bp, Homo sapiens
  misc_feature 99: k=g or t
  misc_feature 124: m=a or c
  misc_feature 307: v=a or c or g
atattttaaatcaagacaaaataagacgggctgggattataggcatgagccaccgtgcccggccgcataaatcatttctaaattcactcctagccataktatatgagttcaaaatcttttctamctagtctagactctagagagttttcgagaagatttttcctcatggagatataatgggagaaaatgagttccatcttccagataaactagtgtgttatctgccttagctcgtcagatacatgagaaatcagaccacacactaataaaaacctaatttaaaagtgtatctactaagtgtgtatgvtaagtttt

SEQ ID NO: 24828 - DNA, 267 bp, Homo sapiens
  misc_feature 110: r=a or g
  misc_feature 130: k=g or t
aaactctatgagtgtctttttgagaccataaagcagactttagtaactttctatttctgtaagtactaaatgtctggcattttaaacttttgtagaatacataatgttgracactggaataatactattkattttcacctgtgaaaaatgacttcattgtacttgaaacacctcctttgcatttctccatttgtgccattcactagtggaaataaattgtattataccatgatctactggctttttaaaactgtattaaatatgcac

SEQ ID NO: 24829 - DNA, 349 bp, Homo sapiens
  misc_feature 104: w=a or t
  misc_feature 143: y=c or t
  misc_feature 144: m=a or c
  misc_feature 145: s=g or c
  misc_feature 318: s=g or c
  misc_feature 319: r=a or g
atcattcatgtcgatgacatgaaagtgaagtaaatttattctatgtaaattcacactaaaaccagtacagtaccataagtagaatacatgtaagaatccacccwagtcttcactatattgagtaaatataacatgctaatttymsaattaatgaaactaaacttttaaacatctccattatatctacatccttttgaaggtatttatcatagttgccaattttaattttaggattgactttctctttctgaatgacttcataaagtttggtgtgaattttgaagacttgggttactaatgattgtatctttgctagtsracaacttatgaaatatactcaatgcgtcaa

SEQ ID NO: 24830 - DNA, 168 bp, Homo sapiens
cactgctttcactgtgtttttataagtaaagtaaaatgtagttagggcacgtcattccagtataatatttataccaagtgtgtgaatattttatatacaaaaaatgtgctttaaggtggcttacactatacttagcatgtgttaacatggtcttgggtaatcgccagg

SEQ ID NO: 24831 - DNA, 146 bp, Homo sapiens
ctttgaaatgtaatttccctcaccttggcagtgcagaaagtttgtgatttttattgccgaaatagctttcaacattttgaaattgacttaagagaatgttggctgtgtatgtctgtatcttgcatttctattggctttgtgaacca

SEQ ID NO: 24832 - DNA, 134 bp, Homo sapiens
gggtggctgggactgcgggcgcatgccaccacgcctggctaatttttgtatttttggtagagatggggtttccccgtgttggttaggcttgcctcgaactcctgacctcaggtgatccgcctgccttggcctct

SEQ ID NO: 24833 - DNA, 86 bp, Homo sapiens
aaacatccacttaagttctttgatttgtaccattccttcaaataaagaaatttggtacccagaaaaaaaaaaaaaaaaaaaaaaaa

SEQ ID NO: 24834 - DNA, 209 bp, Homo sapiens
tagtattaatttataattagggattgttcaaacttcagatctgtttacaggttgtaaaaataaacttcggtatcagtgcatctacaaaagtgttatttggtaatccaaatattagagttttcccaaatccaaaaacggtcagaaataagtccattatcaatataatttgaagaagatttttagtagtactgtgaagttcgtgcttacca

SEQ ID NO: 24835 - DNA, 189 bp, Homo sapiens
caccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccac

SEQ ID NO: 24836 - DNA, 248 bp, Homo sapiens
  misc_feature 20: d=a or g or t
  misc_feature 66: w=a or t
  misc_feature 71: h=a or c or t
  misc_feature 72: w=a or t
  misc_feature 73: w=a or t
  misc_feature 111: w=a or t
  misc_feature 141: k=g or t
  misc_feature 142: r=a or g
  misc_feature 150: d=a or g or t
  misc_feature 171: h=a or c or t
  misc_feature 197: d=a or g or t
  misc_feature 198: w=a or t
  misc_feature 208: d=a or g or t
gtaccttctctatttctgtdtaaaactcctaaaattctgtatgcctcaagaatctttctaaggcgwatathwwcatgcttaaacatattgactgaaaaatgagattttttwcctttacatcttgattaatacttagtattkrctatcttdtaggtctaatcgttatatgahagtagccattctgaacaggtaaaggdwaaaaatatcdggcaataattgattcaagatcgattaatcaacaggtagtt

SEQ ID NO: 24837 - DNA, 241 bp, Homo sapiens
agatgtaacatgttacctagattttaaaggttgagtaagacttcaaaaggtaatagttttggagtcagggctttacttgctagagggaatattatcagtaaagagatggataataaagtgagtaccggctggataagaagatgcataaggaaggcataaaaaggaacttgatagaactttaactttttgaaggaaaaacgaagacatgttgagtagtcatgggagaaatttgtaggccaca

SEQ ID NO: 24838 - DNA, 256 bp, Homo sapiens
caatgttttcagggaaaactggatttagtatataaaatgctgtgcttgaaaactgggcccatgtatcacacttggcaaggcacttgatacataccagataaccacatatttggttaaatgcgtttgttgtttgaatagatgtagatttatgtcattaatatttatatagtgttcatatgagtttttcgtctgtggtatacctgttaatgaaagtatacacttactgttgatttaaaatcccaaatctatgacccag

SEQ ID NO: 24839 - DNA, 367 bp, Homo sapiens
cagcttgctatatttcattgaagattttttgatcagtgttcatggaattgtctcttacttgattttttctgcttaattatatctcttacttaattttttctgctaaattgtataactcagatttttatgtagtaagtgctaagtaagtttgtgttgagtctgtggtgtcaatagcattgacagccttgagcttataggaatcagaaaggtactgtggtggtgaaagagaccaaattgtctattgacaagaccatcttccaccagatgcatataatatctgcaccagaaggaaggggaaccaaattttatgtttaacactgacagcagtgtagtatccaagatgccaaattgggtaaaagacagaacc

SEQ ID NO: 24840 - DNA, 63 bp, Homo sapiens
atttaaaattctaataataatgacaataaagttgataaaggctttcttatttatttattttta

SEQ ID NO: 24841 - DNA, 99 bp, Homo sapiens
  misc_feature 23: v=a or c or g
  misc_feature 55: v=a or c or g
cctttaattgtcaacctccagtvttgactctagaaatatgaggaaagcttttcavtttttaaaatttccatttaaatttagtctattaaaaacaaacct

SEQ ID NO: 24842 - DNA, 141 bp, Homo sapiens
  misc_feature 18: r=a or g
  misc_feature 124: r=a or g
  misc_feature 126: m=a or c
taataacatttggaagaratttttcctttgttttgtaaagtggctaaggttgtaggagtgtgtggtatttattaccttttaaatgaactgtaaatttgccttagaaatttgtttaaaaggctarcmaagtgagaccctttg

SEQ ID NO: 24843 - DNA, 278 bp, Homo sapiens
  misc_feature 2: m=a or c
  misc_feature 145: w=a or t
gmgggcgtgagcaccgtgcccagcctatcagtcaactactttttgtttttatcttcatatattaagggaatttttagttaaacaggttgccctcacatacattttatgatcttatattagatacctttggatgtctgtatttttwagtaggcagatgaaagtgtttttagttaggattatagggattgctttagtaaaataatatttcctcagagaatctgtcttactccaacaaatactaactctaaagactgttttctgtgttttttagtcggcta

SEQ ID NO: 24844 - DNA, 152 bp, Homo sapiens
ttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccaag

SEQ ID NO: 24845 - DNA, 382 bp, Homo sapiens
aaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggcgcc

SEQ ID NO: 24846 - DNA, 146 bp, Homo sapiens
  misc_feature 8: s=g or c
  misc_feature 22: r=a or g
  misc_feature 23: w=a or t
acgctgascgtcggcgccgggrwtcggtggcctctagtgagatctggaggatccaaggattctgtagctacaatgttgtcaagactttttcgaatgcatggcctctttgtggcctcccatccctgggaagtcatagtggggacagt

SEQ ID NO: 24847 - DNA, 127 bp, Homo sapiens
atcaagacaccaggcagcaggacacacacacactcacatacactcacacacatagagaccaacagatagacagctacctaaagcctgaaagactgacagcaacacagaaaaaaagaaacaggcagtc

SEQ ID NO: 24848 - DNA, 363 bp, Homo sapiens
agagagccgggctactctgagaagaagacaccaagtggattctgcttcccctgggacagcactgagcgagtgtggagagaggtacagccctcggcctacaagctctttagtcttgaaagcgccacaagcagcagctgctgagccatggctgaaggggaaatcaccaccttcacagccctgaccgagaagtttaatctgcctccagggaattacaagaagcccaaactcctctactgtagcaacgggggccacttcctgaggatccttccggatggcacagtggatgggacaagggacaggagcgaccagcacattcagctgcagtcagtgcggaaagcgtgggggaggtgtatataaagagta

SEQ ID NO: 24849 - DNA, 159 bp, Homo sapiens
attttggattatgatttctcatttaattttcctgttagtcttctcatacattttaatagttgcataatattgtgtcattgatgactataaacgttcctgtgttcttggacatttagatttctgacttgttttctttttaagatgatgctacaatgaggc

SEQ ID NO: 24850 - DNA, 406 bp, Homo sapiens
caggtatacatacaactcacaattacacatagttgtcctctggtaactatttgaaacatactgcacttccagtcacatacacagtacttattaatatagatatgtgccaagctcttaatatggaaacagttactgggaagactccttttgatcaccctgaaaggcacatattaaaatgcaatgaaaatgtattcacatatattaaaatccccaagggtatgttaaaaaccccagccatatcttctaaatgacagtgctgctctggccatggtcttaataacaaggcagttcatggtaaactgccagcactgttcagggagtggaagaataaataaattcaagttctaagataccccaaattaaatgtgtcttaaagttcttatatctctaaatgatgagtcagcca

SEQ ID NO: 24851 - DNA, 290 bp, Homo sapiens
  misc_feature 199: b=c or g or t
accacattaaagtgaactgaggctggtgaggcgttaaattcatgggaagaatggaaaagttcttccatgtggggttatttcctccaagactctagggaaatctttctctttcaagattagtagcatttaatttatgcacttaggaaagggttagaagccttcgtgccagtatctcctagaacccatcaaagcccaaatbtgagttcacttgaattatagacagtgaaaccttttaattcttctttgatttttgctaaacaggaccagtactttctgacagatgaacatga

SEQ ID NO: 24852 - DNA, 271 bp, Homo sapiens
tggtaattgtttagagaagcagaaggacatttacaaactactcttgtccaagaaacacagtgacaggggacagtggtgtcatatttcataaagtgttcaggaagtgtttcagatttaagtaaaataagtcatttgtgacccactggagtgctgtttcagtaaggtgatgagggcaaaagacaagaagcattacttggttttatggaaggacccttgggttttaaaaggatggtactcgtggttaatctttcagatgtgatacagcctgctg

SEQ ID NO: 24853 - DNA, 210 bp, Homo sapiens
  misc_feature 135: r=a or g
aattctcctgccccagcctcctgattagctgggattacaggcgtgtgccaccatgcccagctaatttttgtgtttttggtagagacggggtttcaccatgttggtcaggctggtcttgaactcctgacgtggtgrtccacctgcctcggcctcccaaagtgctgggattacaggcgtgagcgaccacgcctggccgaaaaacccactcga

SEQ ID NO: 24854 - DNA, 177 bp, Homo sapiens
tctatatgaggtttgaaaatgtaaactgctatgcatagcttgggcaatagccctaaattgctatgacaactaatgaaccagctacgtatactggtattttaggtgcaagttgtaaagcaaaatatctgtgtattctgcttggttaacaaatgtatatttgtagccctttcctgcaat

SEQ ID NO: 24855 - DNA, 296 bp, Homo sapiens
tgggaacctgggaggatttaagctgtattctctgccatcaagatgcttacattctatttggggaaataggagcattggtgaagaggctttgcattttatttaagccgcaattactgtgcacatactctgtggagttgtagtaatactggtgtggtcttctctagactagggtgggggctgtgggaatagagaggaaaggcagaatgcaagattttaagcagcgttttataacttaatggatatgcatcagaattacccaggcaagaggaagattttgttctcagaaagcagagacc

SEQ ID NO: 24856 - DNA, 162 bp, Homo sapiens
  misc_feature 106: y=c or t
aatccagttatattttttatcttttaaggattggttctgaggagcactaccagtaaatattgcaaaaattacataaagctccaaaagctactctgtgtaaacttcytgagtgggaattctcaaccataatatctggaatatgactgataattctggatgtta

SEQ ID NO: 24857 - DNA, 302 bp, Homo sapiens
tcaccactctagaatggttcgatacccccatctactgctccctcagaaaaagcaaaagagaggagtcaggcgtggtggcgcgcgcctgtaatcccaattgctcgggaggctgaggcgggatcatcgctggagcccaggagttcgaggccagagaccccctctcaaagaaaaaaaaagcgatgaaacgagaaccctccatagtctgagcctcattaaaccgtccagttctcccaacctggacccctaccacggcctccgcctctattccgcattgacgcacactctcacattaacaggccact

SEQ ID NO: 24858 - DNA, 181 bp, Homo sapiens
tcaaattattgcaaagtaaaggatctttgagtaggttcggtctgaaaggtgtggcctttatatttgatccacacacgttggtcttttaaccgtgctgagcagaaaacaaaacaggttaagaagagccgggtggcagctgacagaggaagccgctcaaataccttcacaataaatagtggca

SEQ ID NO: 24859 - DNA, 322 bp, Homo sapiens
cacatttaaattcaaagtattttcttctaagggcctggacacatttcttttctccctgtatcgtgaattggaaaataccttaggatattaaaagttatctaagataaccccctttcttctgtaagttaaatactaaacggcttaagacgaaattttggaatatagagatgatgatgcagactgcagtgaattatcaaatatgcatctcactgttctccacattaaacatatttttgttgcgtaaattcatgttaagacgtctataacaattacactttggtaaaattgttggatgttaacatctctgatagctcccaataga

SEQ ID NO: 24860 - DNA, 147 bp, Homo sapiens
cgaatctacaaccaagtccacatggctaaaatttgtttgctccaatcggtaatccaatgaaggctgtgaaccagaattttgggtaaagcagtttccatggcagtttgatttttagaagctagatttccaaagaaacctggggccaaa

SEQ ID NO: 24861 - DNA, 366 bp, Homo sapiens
  misc_feature 366: s=g or c
atagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcctggagcagcccagcacctccactgggcccagaaggtcttgacttcggacacttacccctgtttcacaagtgtttataaagctgtttttgcttttgtttttctcctaaataatccttacttggtagttattaatccttctttgggggagggacagggcgaas

SEQ ID NO: 24862 - DNA, 145 bp, Homo sapiens
acacttatataactaatccaacataagaaggtttaaatttttatgtttgctcaatgaatgagtactcttaaaattgtgtgattgtgaaaccaagagcgttaatactgacatagatttgccatcaaacaaaacaccacctgatctc

SEQ ID NO: 24863 - DNA, 226 bp, Homo sapiens
acagtccaaaggctaggggacagagggaaagctccctcctatcgggccccagacgggtggcgctgatggagaggaggctaggataaggcctccaggaccgaagcgcgcacccataaggcccctgccaaaaagaccttcctgaaggcggaggaactgtgagagtgcctacgttggcccaaggcctgacccgacgatcccggggaccctagccctaacggccccgcac

SEQ ID NO: 24864 - DNA, 93 bp, Homo sapiens
acaatcaataggtatttttttttctggatacttattatgcctcagtccatgttataaggaaataacaaagcagtgaaccaaaaaagcccctca

SEQ ID NO: 24865 - DNA, 487 bp, Homo sapiens
  misc_feature 104: w=a or t
  misc_feature 105: w=a or t
tgtttaattgtacattttttaaatcctgaatatattgtgttttgttaacaaatgtaatcagtggaacccttcttacgttttgattattagcagttaaatacatwwtgtatacatgaagcttaagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtc

SEQ ID NO: 24866 - DNA, 342 bp, Homo sapiens
gagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatc

SEQ ID NO: 24867 - DNA, 402 bp, Homo sapiens
  misc_feature 155: k=g or t
  misc_feature 156: h=a or c or t
cagctggggctttgtcttctttattgctaggagaatgtagcaatagaagttctcatcgccctgtattgcacttttggttttaaggactggacccagagttcctgaaagccaaactccataagctgctcagtaagttccaagcacatagccggctkhgggatgcgattcggtcgaggtctgttgaatgaaggtagacgcagcaggcagtttgtccttaccagtgacctggaagacggtggcacttcctgagtgagctcacttaccttccctgaatggtgaggcatggatgaatattcctggtggtgccacgtgttagaggtggtaaagggtcaaatgtttacttttattaatattacattatggcttggttctctgtgtcagcgatttttctatgcctcgggt

SEQ ID NO: 24868 - DNA, 203 bp, Homo sapiens
tgcgtaccactgtggtttactgcacagatcatctcatcacccaggtaccaagcccagcatccgcagctattcttcctgatgctctccttcccctcccccatgccatgaaacaggtgtccagtgtgtgttgttcttcctgatgtgtccatgtgttctcattgatctgcttctgctaataagttagaataataataggcggtagc

SEQ ID NO: 24869 - DNA, 243 bp, Homo sapiens
  misc_feature 124: s=g or c
ccaaataaaaattttaaacaatttttaaagtttaaaaagttaaaatatagcacatctcaagaattttcttagtcaaccaattataacagaccatactctaggatcatcagttttggattatttsctttgatttgttgatgaagcactaaactgaaagcaataggaaattttctttatagctgtagtttctacctattgaaggccattagcttctgttaggagattgtattgaattggatactc

SEQ ID NO: 24870 - DNA, 319 bp, Homo sapiens
cttttgagaaatgtctatttaaatcctttgcctgcttcttaatgggattatttgttttgtttttttgtttttgtcatagagttgtttgagttccttgtatattctgaatattaatcctttgtcacatgtatagtttgcaaatattttctcccattcagaaagttgtctctttaatctgttgatcattttctttgctgtgcagaaactttgtagttttatgtagtcccatttgtctatttttgtttttgctccctgtgcttttaaagtattagccacaaaatctttacttagaccaatgtcctgagcatttccccaagca

SEQ ID NO: 24871 - DNA, 333 bp, Homo sapiens
tttcactgggaactaacacccggcgccgctcagacatctctattcccgcctctccgacccggtctcacttcgctcctgggcagctgcgcggagaactggggcactttgttttagtaaaatcggaggtgaagatggagatattcatcgaggttttcagtcacttcttgttgcaattaacagaactgacactgaatatgtgcttagaactgccaacgggctctttggagaaaagtcttatgatttcctcacaggttttacagattcctgtggcaaattctaccaagcaacgataaaacagctagactttgtgaatgatacagagaagtccatgct

SEQ ID NO: 24872 - DNA, 97 bp, Homo sapiens
taaacagctgatttcccttctttgattctttcataggagaaataatgtctcctggtcacctacctcaggagcatttatttgcttatcacaggagccc

SEQ ID NO: 24873 - DNA, 370 bp, Homo sapiens
attattggtcacatacaacaaaatagaattgtgaagtccattatagggctctgagcctgatttaaggtcacagaaaaaagaatttgagtctgtttctcagatctagaattatcaaatataaggaacttctcggcaaaacagggtgccactttcagctgacaaacttgtgggtgagaataaagaaaagtgagtctttaggtagataaagttgtcactcataatggtgtgtaacagtagaaaccttactttaccatctccacggatatgaggatatatgatcttcatggtgtgaacgtctaacttggctgagacaagctatcagtaaaagaaccaagatatagtgaagaatgaggatttcagaaccaggaga

SEQ ID NO: 24874 - DNA, 229 bp, Homo sapiens
ttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggcgc

SEQ ID NO: 24875 - DNA, 132 bp, Homo sapiens
tacctgtgcttatacagcattttccttagaggatcaatttgagtatatgaacaaataccagctagatttttgtacggtaacattattgataatataggagaagttcattgaggagaaaaacaaagggagcaa

SEQ ID NO: 24876 - DNA, 409 bp, Homo sapiens
  misc_feature 119: k=g or t
  misc_feature 368: d=a or g or t
gttatcctcaggaagccctgagcgctgagaggcactgttacagaaccgaactggggtccactcgctaggcctacctaggtgcctggaatttcccttcgaggaacgcaggagttttcttkattttcatgcttgggaaggctcattaggcccctaagagagggtcccttccccatctcaggactaaaatgcaatgaagatgttgctcagaggcagctggagagggatgggtctgtggaggatgccccgcagagtgaagtcgagatgatgcagccaccagggccggaggggagggacattccactttttaaatcagctttctgaagcatgatctccatataatcacctagaagcgtacagcacaatgatcdtgacagatgccagcatccttggaaccactgccaccaccaac

SEQ ID NO: 24877 - DNA, 123 bp, Homo sapiens
ctgtctactagattaagttaagagcaacaagaaaaatgagtggagttaatttttgcctctgaattttaaaactgacacgtaaaaagtcttatgtggggagtaaagacaaataacaagggctca

SEQ ID NO: 24878 - DNA, 358 bp, Homo sapiens
  misc_feature 219: k=g or t
  misc_feature 220: w=a or t
atttcagaccacaatctggttctaccaattttcttaattccagcgggatagaacactcctgtatttaatgacaggactatatacagctgtggagctctccatttcttggaatgccaggtttcttgaacttttcatcttgcaaaactgactctatacccactggtcaagtgatcttcaacaagggcactgagactataaaatggggaaagaatattttckwcaacaaatggtattgagaaaactgaatatctatgtacaaaagaatgaagttggactcttacattataccatattttaaaatgaagtcaaaatgggattaaagatctgaaactttaaaactcctaaaataatagggaat

SEQ ID NO: 24879 - DNA, 330 bp, Homo sapiens
  misc_feature 261: s=g or c
gtcactgttggccttagaagaagagcccaaaggcaacaagcaaaggcgctggtgtccagtcgccttctagaagcattttcactttcccttaaggtttcccttgatgaacatagaagtactgtatgtagaattgacccagtgctgccctggcaactttgtatattaggccaaatttacatttcttacctttatgagaggcaccctggtaggctagtggagttacacacaaagtctgatctcagctgcactgtccagaaatgsaacacggtccaatcaaataacattctctgagcctgtttctttagctgtgaaagaagaataacatacccg

SEQ ID NO: 24880 - DNA, 140 bp, Homo sapiens
agtgtctattgtatatgaccagcagtctaggcgttcaagaggatttgcctttgtatattttgaaaatgtagatgatgccaaggaagtaagtaaaagcccgttcctttgtaaaccatcagttctattgttaacgccaagtt

SEQ ID NO: 24881 - DNA, 275 bp, Homo sapiens
cgcaactcacagagctagtggtgacagagctggcatttgttggaatggcctccatttcagaacaagctcctagaagggtttaccaaaccagggcttaaattttttgaattatttattaatggctcaaaagtctgaaggcgcgaagggtagacagtgaaaaatctcccttctcttctgtccccagccacccaaatcctcctagggaagcagccggggtgatctgattctcaggtgtccttctcagcagtgtgtgtgttcccagacaaacccaggct

SEQ ID NO: 24882 - DNA, 337 bp, Homo sapiens
  misc_feature 179: k=g or t
  misc_feature 251: w=a or t
attggatgatgtcattttgtcattttcctgcttataattcttttggatttatcagcaggaaaaccgtaaaagaaatacaatttatgttttgaaattttaaaatggattccaagtttctgttgacatctgcaacttttcttctgttttcatgaatgtattaatcataaagtctattatakattataaatgcaatatgtcaatcaaatgaaggtctgcttttattccttccccttggtttctttatagccgcwtttgtttttatagattgccttgtaccttgtaattttgaactggatgccagatattgtaacaaaaaattctagggattccggagggg

SEQ ID NO: 24883 - DNA, 210 bp, Homo sapiens
aaattaaagaaacttaggttgttccttaaacccattctgtcgtctgcctttttatgattttcttgattttatcacgggagcatttatcgaatctagtttttttggtcatactttgcttaatggtatacaaaaataactacacagatgtgttataacttatcttttcagtcaagcaactttgaaaatgtacaaaaaataagagaccccaga

SEQ ID NO: 24884 - DNA, 377 bp, Homo sapiens
  misc_feature 371: n=a, g, c or t
  misc_feature 373: n=a, g, c or t
  misc_feature 374: n=a, g, c or t
ccattgtgttttggaatattttttcttaagcatatctgggatgtttgggccccacaaagctgcctcttcattcaggcagtggcagaacctcagcattccatggaataggatctgtgagttctgctacatggaataggacctccccagtgagttccccttcagttgccagttggaatcaatgtattacgtgtgtttgcttggtttcctttctgtctattcatgtctatcttacctgtcagagaagattctatcctagaagtcaggaactacctacctctgaattttctcttgagctatatttcacacccagccacagctgtctatatctaatgggatagtcctctctggtaaaaaacacagcatactttctncnntat

SEQ ID NO: 24885 - DNA, 155 bp, Homo sapiens
atatgaagaaaataaaattgcaatgggatagaagttgacaacagggtagaagcttctttagtcggggtctaggcaggcttctctgaggagatgatatttgaattgagatttgagtgataaggagatgtggagcagagaataccaggtagaggggt

SEQ ID NO: 24886 - DNA, 211 bp, Homo sapiens
  misc_feature 192: r=a or g
gacccatttgggcttgacaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaaagggaagtgtgcggggcarggcggcacactccaggagc

SEQ ID NO: 24887 - DNA, 215 bp, Homo sapiens
atactcttaaaatcttgattaaaaaattttttttaaaagcagtttttaaaaagaaaggctttgaggctcactctcacatacagggctgatatttagccaggagatgagaggactctgttcaaataataaaatccttccatgctgcttggtaaatagccacgggtcccagccactctagcccttccctgtaacttgctgcaaaatgtctgatcagg

SEQ ID NO: 24888 - DNA, 284 bp, Homo sapiens
  misc_feature 48: r=a or g
  misc_feature 49: r=a or g
ttttacatcattatgttaaagaacctgggggacattatgttaagggarrtaagccaggcacagaaagacaaataccacatgacctcacttacatgtggaatctaaaaaagtcaaaatcacagcaggtggggaaatgggggtagtagggagggcgacaaggaggaatgagaaaatgttggtcaaaaggtacaaagaagggcaggttgtggtggctcatgcctgtaatcccaccactttgggaggctgaggcaggtggattggttgagcctcgttcaagaccaaca

SEQ ID NO: 24889 - DNA, 417 bp, Homo sapiens
  misc_feature 87: d=a or g or t
  misc_feature 368: d=a or g or t
  misc_feature 369: h=a or c or t
  misc_feature 379: r=a or g
  misc_feature 380: v=a or c or g
  misc_feature 381: s=g or c
  misc_feature 415: s=g or c
  misc_feature 417: y=c or t
atgggtgagccggaaaggagacctgcagagaatgaaacagacacataaaggaaagaggacattctcacaagatgggtaggccggagdgatcacggaggagatagagtccctgcatgtgaagtggtactgagagacacagcaggaaatggaagtcaagattctgaacccctaaccccttccagctctgaagcttgaacaaaataaaactcatccagcatccagcccagtgcctggtgcacaggcatcttcaaggcacctggcaccttctcctccagcctcccagcagcatggctttcaccggcaagttcgagatggagagtgagaagaattatgatgagttcatgaagctccttggatctccagcgatdhaatcgaaaarvsccgcaacttcaagatcgtcacggaggtgcagcasgy

SEQ ID NO: 24890 - DNA, 360 bp, Homo sapiens
  misc_feature 299: r=a or g
agtggaagattgatcttgtaaaaggaattttgtgtgtgatcaagtttggctaaaattttaaggggattatttagatattatacaaattgaacattcatataaatagcacattgatgcagggtcagaatctgagcacctgtgtgaggcaggattttcttggaatattgatgtgttctttaacacaaatttgtaaagtttataaaagcctcatggaaatcttaccttacaatcaaactaattaaaatttggtagatttgcttataagattctattaaagctttagaattaacaatacagtratacaaaaataaaatttggttttctcttttaaataagatttttgtataatattaagagata

SEQ ID NO: 24891 - DNA, 243 bp, Homo sapiens
  misc_feature 12: s=g or c
  misc_feature 31: s=g or c
atcgcgacccasggcaaggcggcgagtcgcstcttcgagtcccacctgtccgaagcgggggataccaataactagtgcctcgtactacgcgacagtgaccctggatcaggttcggaatatacttcgttctgacacagacgtttccatgcctttagtagaagagaggcatcggattctcaatgaaaccgggaaaattctgctggagaagtttggaggctcttttctcaactgcgtccgagaagt

SEQ ID NO: 24892 - DNA, 137 bp, Homo sapiens
agcagaggagtatacaggacaagaacttgatggtctcgggaaaatggacaacatgactcaggtgaaaaagattgatcatcagatgtttcttatgtatcaacctgatatttaaatccatgaaggacagagacgacttt

SEQ ID NO: 24893 - DNA, 264 bp, Homo sapiens
gttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccctg

SEQ ID NO: 24894 - DNA, 315 bp, Homo sapiens
ccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagagcc

SEQ ID NO: 24895 - DNA, 145 bp, Homo sapiens
  misc_feature 29: n=a, g, c or t
  misc_feature 145: n=a, g, c or t
ggaagtggaaggggcgggccggaggtggngtagtagcaagttatttcccgcttcacttggtgggggtaagatctgggctcacgctgctcagtggcccaccctttctgcctgtaactgtggagagggcttccctgaaacgtgaggn

SEQ ID NO: 24896 - DNA, 404 bp, Homo sapiens
  misc_feature 228: k=g or t
  misc_feature 229: s=g or c
  misc_feature 261: s=g or c
  misc_feature 310: k=g or t
acagaatacccagtcagggagtttgtgagctggaaaacaaattttgttgtggacttgggagaaggtataggggctattttgactttctgaaacctgctcatgatcagagctctcaggcacctttccctcatcttcttgggcttcatccacgtgatgatggtgggagggctcctggtctgttgctggcctcctggaatgaggcccatgatgttgccatttagtggtcakstccccttggataattaattaaaacaagcgcasatttagctttagagttagcactgccttactctctaacttcgtttatcckttcagtcctgagtgagggcttgctgttatcccagtttatggatgaggaaactaaggctccaaaaggctgtgtggctgagtcagtaactggcaga

SEQ ID NO: 24897 - DNA, 186 bp, Homo sapiens
tgtgcagtgtctgtccactgacagagctgttcggaggcccggtgtgctagtgttgataaaatgttaagggagggcccctgtgatgcctagcatggcatcctgcctgaggtcagtgtttaaatgtttactgaaataaccaagacatgatgtttatcctggagttccagagaagatgttgtcccccat

SEQ ID NO: 24898 - DNA, 433 bp, Homo sapiens
  misc_feature 332: r=a or g
  misc_feature 333: s=g or c
  misc_feature 387: s=g or c
  misc_feature 420: r=a or g
  misc_feature 425: r=a or g
acttggaaatttcttttgggctgagccctcggtatcactgcctctggaacgcattctttaaagcctggaaggagggaagaaaatttgtaaagcttaatggaaatggagttttaataagagtacctattactgctttaacaagtctacattcttgttatatttaccacagccccaaagtcaatctttttgatgtctacagcagagaaggatattagcagattcataaatcacagtcttatttgcacttctgcttttaaagcaaacatttaaaaaaaggtgttctgtcttgattaaggccacttatgtccatgggtaaacaggctgtgtttgarsttcatcccccaagcattccacctcaggaacccaggtcagacctccaaccatgascctaagtgcttgcttaagacgtacttaacatarttatratattgta

SEQ ID NO: 24899 - DNA, 206 bp, Homo sapiens
  misc_feature 7: m=a or c
  misc_feature 8: n=a, g, c or t
  misc_feature 9: h=a or c or t
agtgcgmnhacaccacccttcgtggacacgccctctaggcgtaaggttccatgcgagcggtaagagtgcggcgggacttggaaatcgaatctgtgctctgtgagagatcctaggaaaggaaactgggagcccgggagaactaaaattcccaattaaaagtgaatttaaatctgagctgttcttagacccagaatttcttgcctgag

SEQ ID NO: 24900 - DNA, 118 bp, Homo sapiens
acaacttttactctttttgctcagctgatataaaatactctttgtcccattcttcttcaacttttagagctttatttcctctaagaagtttttttttttttttttttttttttttttt

SEQ ID NO: 24901 - DNA, 383 bp, Homo sapiens
  misc_feature 244: s=g or c
catatttgactctttatttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacscctagctcacaaccagttgaaggtggttttggtgtgaacactaagatgccccttcctggttgaattggggctggttcagcccccacctccctcccggccaggtgccattttgctcgtaaccccctgtaacagccctgca

SEQ ID NO: 24902 - DNA, 188 bp, Homo sapiens
  misc_feature 120: r=a or g
taataactttgactattaggaaaagtgaatctattctataaaccctctgaattaatgttcctaatccattgacatgcttcagactcattttcaaaagccactgatattaaacatgatttrttgagttatatatccttctcccatatggatgccacaagttatccagaatgcagttctaggctcctgcg

SEQ ID NO: 24903 - DNA, 217 bp, Homo sapiens
tcgaatttagtacctgaaagattcaaggttttttaaagtattcaaaacctctaactattccctaaagctttaatctctgaaacagagaaacttcctgattagaaaaacaggcgcctagtttggcctcctgtagcactgaactatgagagatattgtccaacatttttggtggtttttctctgtgtatattggataaattttggatgagtagggccaa

SEQ ID NO: 24904 - DNA, 186 bp, Homo sapiens
  misc_feature 102: s=g or c
ctaaaaaatacaaaaaattagccggacatggtggcgggcgcctgtagtcccagctactcaggaagctgaggcaggagaatggcgtgaacccgggaggcggasttgcagtgagccgagatcgcgccactgcactccagcctgggtgacagagcgatacttggtctcaaaaaaaaaaaaaaaaaaaaa

SEQ ID NO: 24905 - DNA, 111 bp, Homo sapiens
gccaacatggcggcgcccagttggggcgggttcgttcgcttcgcgttttggccagggcgggggtctgggctttaggcaggtagtatttagtttcacaatgtttggggacga

SEQ ID NO: 24906 - DNA, 306 bp, Homo sapiens
  misc_feature 80: r=a or g
  misc_feature 236: r=a or g
  misc_feature 292: k=g or t
agtcgatcaatgttttgcagtttattgaaagtagttctatatataacaatgttataagcatttctttagaaatggttgaraatgcttctaaaatgtgattatcgaccatggtatgcatgatcgttgtaattgttgacattccttttagaagttgtgaaatgttacaacttgtgcttatgtagacacaatcttctgtctcagtacagaggcactgacttcaataaagtctatttatrctaattttggccaaagccctttggtatctttgttctagtctctaaatatagttgtktttcaagtgtggag

SEQ ID NO: 24907 - DNA, 248 bp, Homo sapiens
ctacttctgtggtgaccctgaactgctccagaggacccagctctctcaagccaagtggtttccacactttgctgcacagtggaggcacttgtagaataaagaaaataggccgaccctccagatgttttagaaaacgattatgagagcttacgtgtattaaatgttgaaagaaatggaaatattatttatacctataaggatgataagggaaatgtcgtctttggattatatgattgtcaaaccaggta

SEQ ID NO: 24908 - DNA, 235 bp, Homo sapiens
  misc_feature 143: r=a or g
tactagaaaaacaacagtgaatttgaatcaagttctgcaaatacagaaatcactaagatataagcagttccgtgaagtttgcaaccacctaaaaggataataaagttttcattctttataacatcagcattgttcctactgarattaaaaagtgtggtcaaacacagtcactgaatcaaccgttttctttctgggcaaatgtggcatcttcattcactgagagaaaagggtcacc

SEQ ID NO: 24909 - DNA, 437 bp, Homo sapiens
  misc_feature 276: n=a, g, c or t
  misc_feature 290: y=c or t
  misc_feature 291: b=c or g or t
  misc_feature 292: n=a, g, c or t
  misc_feature 298: r=a or g
  misc_feature 318: r=a or g
  misc_feature 321: r=a or g
  misc_feature 322: w=a or t
  misc_feature 385: n=a, g, c or t
  misc_feature 412: r=a or g
ttaggaggtaaatagcaatttccaccatatttaaagtcttcaaagctcttcctgcctgatagggagactggaacaagaagcaaagtaggcgctaggtgaatttagaatggaaattaggatagccaagtgctcatattcaaaaggaggctcatcttttctaaatcagttgcctgggaaatcctaagcaaaaataacaaagctggaggcatcacgctacccaaattcaaactgtactacaaggctacagtaaccaaaacagcttggtactggtataanaacagacacacagybnaatgaracagaatggagagcccagaratrwaagccacacacctacaaccatctgatcttcgacaaagctgacaaaacaagcaggaggaaaggnctccttatttaataaatggtattgggraaagtggctggccatgtgcagaaga

SEQ ID NO: 24910 - DNA, 306 bp, Homo sapiens
  misc_feature 274: r=a or g
  misc_feature 292: y=c or t
taatgcatttcaatcatcaaaagccaattttctgagagaaactatataatggaggatgtattttagagtcaggctagcctgagttttaatcctagctctaccatttactagctgtgtgattttggacatgatatttaagctttctgatcttcagtttctgaatctaaaacgtgtgactattaataggaatccaactgggaatgctgtgcggttgaaattagataatgtattttaaatgcctggcaaagtgtctgacacagagtacacacttaargaatggagggatattatyatcatcacggtggg

SEQ ID NO: 24911 - DNA, 181 bp, Homo sapiens
agggggaagggcagagggtgaaggagagccagacagtgaaagagagccagagagtgagggagagccagaaagtgaaacaagggctgcaggaaagcgcccagctgaggatgatatacccaggaaagccaaaagaaaaaccaacaaggggctggctcagtacctcaagcaatataaagaaacc

SEQ ID NO: 24912 - DNA, 272 bp, Homo sapiens
  misc_feature 17: b=c or g or t
aaagggcagagcaagtbcactgtgggcactgtgtttagtcttgagtcagaggaggaggaataccctggaatcactgcagaagatagcaatgacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgcaatggatcc

SEQ ID NO: 24913 - DNA, 273 bp, Homo sapiens
cagagaattgttccactacactaaaaatcccatgtgctctgcttattcatccctccttctctccctctagcccctgacaaccactgatgtctttactgtctccctagttttgctttgcccagaatgttatatagatggaataatatagtatatattttcacattggcttcattcacttagatacatgtctttaaggttccttcatgtatttttatggcttgacatttcatttcttcttattgctgaatactattttattgtttgggtgtgccc

SEQ ID NO: 24914 - DNA, 255 bp, Homo sapiens
gcggcagtttccatggtgagatggtcaacaagcctgtacggagtctcgctctgtcgcccaggctgaagtgtagagtgcagtggcgtgatctcagctcattgcaacttccacctcctgggttgaagcaattcttctgcctcagcctccggagtagctgggaatacaggtgcaggctgccacgcccggctcatttttgtgttttagtagagatggggtttcgccatgttgcccaggctggtctcaactcctgagcgc

SEQ ID NO: 24915 - DNA, 248 bp, Homo sapiens
  misc_feature 162: r=a or g
  misc_feature 176: k=g or t
caaaaataagtatttgcatataacatacacacatcttcccatatactttaaagtatctttcaattacttataacacctaatacagtgcctacacatcatttcattcatgtggattcaacatagtacttgctgtgaagaatattcaagttttgcttatttggractttgtgaatttkttcttccaaatattgttgatccatggttggtttaatccacagatgtaggacacagagatacagaggggccgt

SEQ ID NO: 24916 - DNA, 356 bp, Homo sapiens
caactgtgatgctttttagtatgaacaatgatagttttctaaaatctgaaaatcaatacctgagtatgtgatgtggcaatgcattcttctagataagcactaaacaaagtatggaccctcaatttatgtctttaagatttaaagtgaagtaaatttctaaggaactgtgtcctttcctagcaggaataaacagtgaaaatttggtaagtatttaacttgaagtgcatgtaatagtgatgagagtaagtagccaaatttccgtaatataaggtaatgtttaagagtgagcaataattattgcatctcttttgcgacttcatgtagatgtgattaacattttttacaaatttgcctgc

SEQ ID NO: 24917 - DNA, 85 bp, Homo sapiens
cgatatgtcttacatattctctattaatataaagaaccaaattttgtctgctattttgtaaaaataaactacaaaagcctgaacg

SEQ ID NO: 24918 - DNA, 358 bp, Homo sapiens
  misc_feature 282: k=g or t
  misc_feature 350: m=a or c
taatagagatgggggtttctccatgttggtcaggctggtctcaaactcccgacctcaggtgagccaccgcacctggccagagtctttcttttcttaagacagggtctcgctcatgggctaccatgcccggctaattttttttttgctagagaagagttctttgttgcccagagtggtcttgaacccctggcctcaactgatcctttctctccagcctcccaaagtgctgggattacaggcatgagccaccacacctggccacacagtgtgactttctatttkgttcttttttgaaacaattttttttgttaatattattttacagaaaaaattttgagatgaagtttcamtctagtca

SEQ ID NO: 24919 - DNA, 377 bp, Homo sapiens
  misc_feature 295: r=a or g
  misc_feature 321: r=a or g
tacaactctacaaggtagataggtattaccactgtattataaatgagacagccaaggcttgctgtgataagtaacttgtccaaggtcacacaaaaaataagtgatacatttatgatgaaacctcagttctgactacctttgttctttcattatgacatgctgcctacctcttatttattataaacaatattggtatactgacacaaggatcagatgctttgtataatggttgtagacttttccaaggaatcttgtgactttcttctttttactttatcccccttagtggcaaaaraagagagattacaataaatacttgaratgcgtcctaattatctgttacgtatagtcatgattgtgagtttctgatcaagcca

SEQ ID NO: 24920 - DNA, 370 bp, Homo sapiens
ctcaaggaaatgtgtcgtgtgtttactgaggatagcgttgtatgtagtccacaatttcctctttccgggagaaattttgcacatgtatcagaagtctaggagctgtgtttctgatatttgcatcttctttattgtttagatactgtgaatccggcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtatttggaagcca

SEQ ID NO: 24921 - DNA, 126 bp, Homo sapiens
caaacaactagaaaccaaacaggaaactcactgtcagagcactcccctcaaaaaacaccaaggtgtttcaaaaactcagtcacttccagtaacagaaaaggtgaccgaaaaccagataccagccat

SEQ ID NO: 24922 - DNA, 431 bp, Homo sapiens
caactagaattacttatttcacatggaattgattttcaaatatacatctctaacataagtaaagtatctgatctttttctaagagcaagttttgattaggaaatgggtgaacatactatagacactttgaatacttaaaagggaatgatgtcattgagcaagaagtgaactaataaagaagtttggagtgataatccaaatttctcctaacatactatttggctttcaacttagtagcatttcttgggtagatttaactctagtcccttcatttctgataatagtagttttcaaacataaatctggattaggttttcaactcacttacttttggtaaatatgttcttattattgcatcttacagtttgatccaaaatcaataatttggaagcacatatagcaaactacctaactgacagagttcctaagga

SEQ ID NO: 24923 - DNA, 384 bp, Homo sapiens
  misc_feature 7: h=a or c or t
  misc_feature 8: d=a or g or t
  misc_feature 230: r=a or g
  misc_feature 234: r=a or g
  misc_feature 243: r=a or g
  misc_feature 315: r=a or g
caaaaghdatttaatagtataatatatatataaataaatatatatacagatatatttatcatggtatgtttgatgggatgactgacacaggaaatctgttaaagtcttaaaatggaatgagaatgttgttttaaaagaaaatagcaaaacaacaaaaaagcaaaccttaaaatgtgaagaaagtgtgaattttagttttgtcacagttaactgtgtcaaagagaattaaraaaraaaacttcrgattttgtttacatattttactacatttttgctggtataattccttagccacctatgtacatactgctttargaaatgttttttcctgtttatttctgtttggtttatattctggttgtctttttctttttgtaaagagga

SEQ ID NO: 24924 - DNA, 288 bp, Homo sapiens
caagataacgatgacttgtaccctccctgattctgttacagtagggcccgggcagatctgtgtttgttaaacaggccttgtttgtgcatgctttgctatgaatgaagttcctttaaggacaaagaaaagcacacttttcttcttttgagcatatctgctattactttaaatctgctaatttctaaaatgtagagtccttcaccaatcccagagactcaatttggaaatgaactgatttcaagccgttactgtcaataaagcaccccagcattttgtataagctctcaa

SEQ ID NO: 24925 - DNA, 177 bp, Homo sapiens
catgatggatgaatgatgttatctttcacatgtggctttcttgccttgtcctaagtgcctgctgtagtcgttgacattttccagcaaacaggaatgaggagaaaaggtcaaggacatctagcctttatcttcctgattcagatttggaaaacatgcctttcgttttctcccacctct

SEQ ID NO: 24926 - DNA, 197 bp, Homo sapiens
aacacctggtgagcttttaaaactactttaaatgcatagtggccattcatatgggtcgtgacttgtagatgtgtattcatagcagctttacttacgagagcccaaaactaaaaaaagtccatcattaggttaatgactaaggaaattgatatatacatacaatgaaatattcctcagcaatacaaaaggaatgaact

SEQ ID NO: 24927 - DNA, 302 bp, Homo sapiens
  misc_feature 90: s=g or c
cattttggttcttgtttcatagttttcttggggtcttactattgttttggtcaccctggtttgtttttgtttttgtttttgttttgagascgagtctcactctgtcacccaggctggagtgcagtggtgcggtctcggctcacggtgacctccacctcccaggttcaagtgattctcctgcctcagcctcccaagtagctgggactacaggcgcgtgccatcacacccggctaatatttgtattttcagtagagaccaggtttcaccatattggccaggctggtctcgaactcatgatccgc

SEQ ID NO: 24928 - DNA, 304 bp, Homo sapiens
  misc_feature 72: y=c or t
  misc_feature 300: s=g or c
  misc_feature 301: n=a, g, c or t
  misc_feature 302: n=a, g, c or t
  misc_feature 303: h=a or c or t
cattttggttcttgtttcatagttttcttggggtcttactattgttttggtcaccctggtttgtttttgttyttgtcttttgttttgagaccgagtctcactctgtcacccaggctggagtgcagtggtgcggtctcggctcactgtgacctccacctcccaggttcaagtgattctcctgcctcagcctcccaagtagctgggactacaggcgcgtgccatcacacccggctaatatttgtattttcagtagagaccaggtttcaccatattggccaggctggtctcgaactcatgatsnnha

SEQ ID NO: 24929 - DNA, 308 bp, Homo sapiens
taaagacatcattttgcaagcagaaggctgagtttcatttgaaacaggtgcttaggtggtggtatttgtgaatacttttcattccaagcaagaagactaaagaagtagcaagtatgaatgacttcagggtttaaaaaaaatgtcttccagtttcagccactaccatgataagcacagttgagactgcagcagtaaattccaaatatgtgtttctaatttgacgtgaaagatactaaaaatttatatttgtatatttaaatcctggctcatcctgtgacatagatttactgaataggaacaaaggccct

SEQ ID NO: 24930 - DNA, 432 bp, Homo sapiens
  misc_feature 392: w=a or t
tttaataatataatctatgttatatctactttttctttataattgtcttagttcattttgtgctgctgcaacagaatacctgacactgggtaatttattaagaacagaaatttatctctcatagttctagaggctgagaagtcctaagatcaaggaaccagcaggtttggttgtcttgtgagggctgcatcctctgcaggggaagaagaacgctgtgtcctcatatggcataaggcagaagggcaagccacccgaaagctgtgtgaagcctctttaataagggctttaatcccattcatgagggaggttccctcatagcctaatcatcttttaaaggcctcacctcctaatactatcacgttgacactcctgaattttggagggggacatawtcaaaccatggcattacttattgaacagtaagattagcta

SEQ ID NO: 24931 - DNA, 137 bp, Homo sapiens
tctctgtgttaataatgggtactgtacaattaatttccttttttaaaaaatatattttttgagacagagtttctctcttgttgcgcagggtggagtgcaatggcacaatcgcggcttattgctacctctgcctccgg

SEQ ID NO: 24932 - DNA, 198 bp, Homo sapiens
aagcatagggtgagctatgagggggttatgtgatgctcccatgccttctctgggcatacgacccccagagcaccatctgggtttatcagtctggaagctctccaaaccctgtcctttttggtttctatggagtcttcatcatgtaggcatgattaatgacatcattggccattgatgagtaggtcaatctccagcccc

SEQ ID NO: 24933 - DNA, 296 bp, Homo sapiens
  misc_feature 244: k=g or t
  misc_feature 295: n=a, g, c or t
  misc_feature 296: n=a, g, c or t
gggaggatcacttcaggccaggagttcaagatcaaccaacctgggtaacatggccagaccccatctctatttatatatatatatataaaacttagagtttttatcttcccctaaaagaggccgtgatatttgcagcagcctcaaattgctcttaaggggtttaggtgtgcagaagctttcctttccctacccagtaaccatgtgactactaacgtggtatattgatttattttgtttgctgtckatctcccctgccccactgctggaacagaggctccaagaaaacagggaccann

SEQ ID NO: 24934 - DNA, 129 bp, Homo sapiens
tgggaactgtcaaggtagttgaagtttacaagagtgggctctctctctagtcacttcgggaggaatgccatcatcatgacatcatcacgactgactgatttggtcagtctgtctttcatcaagtcagga

SEQ ID NO: 24935 - DNA, 183 bp, Homo sapiens
  misc_feature 103: r=a or g
  misc_feature 104: h=a or c or t
  misc_feature 105: s=g or c
gaattttgtagttcttttagagtcattattgaaaagaatgattaatataatacatttctttaaaaaggagctagagaaaatggggtagattaaactgcctgcrhsttctctcaaggaaagtccccgatggcagcttatcgccttgtgatttatctctacctcctaagagtagaatgcagctaa

SEQ ID NO: 24936 - DNA, 108 bp, Homo sapiens
caataaagcctctactttttcttcatagctcttacatcagttgtaaataaagaactatttgtctgccttttcccgttgtgtagtatgtaagtattagctcaggcataa

SEQ ID NO: 24937 - DNA, 243 bp, Homo sapiens
  misc_feature 229: w=a or t
ctggactctctattcttttccatcgctctatttgtctagctttactccaatatcacagtgtcttgattgcagatttataaatcttgaaatcaaatagtgtaagtgctgcaactttaccctactttgtcaaagttgttttagttatctaggtcttttgcatttccatatgaattttataatcagctcattattttacacacacacacacacacacacacacttgaatttwtattggggttgcgc

SEQ ID NO: 24938 - DNA, 350 bp, Homo sapiens
  misc_feature 37: m=a or c
  misc_feature 38: m=a or c
  misc_feature 309: m=a or c
gagaactctgatatcagcatggatacacatggaattmmaggcagtgacaacatttaaggcatggaaaggtaaaattagatgaggcaggttgaagattgataaataaatggctgtgatgggatgtgatatggtttggctctgtgtccccacccaaatctcacattgagttgtaataatcaatgtcaagggtggaccaggttgaagtaattgaatcatcggggcagtttcccccatgctgttcttgtgatagtgagtgagttctcacaatatctgatggttttataaacgcctggcatttcccctgctggmactcattctctctcctgccgtgctgtgaaaaggtgccttct

SEQ ID NO: 24939 - DNA, 325 bp, Homo sapiens
  misc_feature 128: s=g or c
caattcaaagtgaggctgagacttgaaactgctcccactacagttctgttttaactctacctctggaggaagaagtaaaatggggtagttgagcatgaacttgggacagtcagtcacagttagcgcascatttacccactgagtgcccttggataggttgctaacttctgggcttcagtaaatggggctatagctggagtgcccacgtactaggatcattgatgaatgtgagctaggtgaatatataaaaatactcaactggagcctggcacatagtaatacgtggtaatggtaagaatgttgaatgttcttcttttggggcccc

SEQ ID NO: 24940 - DNA, 152 bp, Homo sapiens
ttagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggctac

SEQ ID NO: 24941 - DNA, 198 bp, Homo sapiens
caactaccactctctgttctgttcactccgttccagccacacccaccttcttgctgttctttgaacatggcctggcatgctccctcttcagggcctttgcacttgttatttcctccacctagaatttctttcccatgtaactacctcacttgcttcatcatcagctccctcacctaaaccttcagtaaccctttcttc

SEQ ID NO: 24942 - DNA, 175 bp, Homo sapiens
  misc_feature 165: r=a or g
tagtatgatataaacttgtgattctgatgctaagcgggctcaatagcatcagtgataatgactgttgtagggtaatgccaacttgcttactgtgttggaattttcctccttaagactttggaggttctcttacctggcctgtcgtacacccagcaagcaccttcrcactgaccac

SEQ ID NO: 24943 - DNA, 78 bp, Homo sapiens
  misc_feature 8: r=a or g
  misc_feature 14: r=a or g
  misc_feature 25: y=c or t
catcccargttttrcttgtcaattyatatactggcgtttgttcctgatcctatttatttatttctggcatccaactct

SEQ ID NO: 24944 - DNA, 176 bp, Homo sapiens
  misc_feature 128: d=a or g or t
aaagattttttttaatctagacaatatacaagccaaagtggcatgttttgtgcatttgtaaatgctgtgttgggtagaataggttttcccctcttttgttaaataatatggctatgcttaaaaggttdcatactgagccaagtataattttttgtaatgtgtgaaaaagatgccaa

SEQ ID NO: 24945 - DNA, 190 bp, Homo sapiens
  misc_feature 52: w=a or t
  misc_feature 73: m=a or c
  misc_feature 94: r=a or g
  misc_feature 103: r=a or g
  misc_feature 110: r=a or g
  misc_feature 118: y=c or t
gagtctgggtcacttcttaagcagggaagaggcttgagagcttttttttttwattttccagggcacttcaggmaaccggggcctccagggggaraaaggcgaraagggaraggacggyttcccaggcttcaagggcgatgtggggctcaaaggtgatcaggggaaacccggagctccaggtccccgggga

SEQ ID NO: 24946 - DNA, 271 bp, Homo sapiens
tcacattctcagaacttttgcagttattattccattgtctctagtatccagtgttgctagtgagaagtctggtgccagtttgagtttgattccaattcttttatagatgacttgtattttcctttctgaaagcattgaggaatattctgtttatcttttgattacttgaaatttcaaaggatgtgtctgttgtgggacgtttgtcattcatcctttcaggactctaggacttttttaacctggagatttgagtacttctttagcttggggt

SEQ ID NO: 24947 - DNA, 135 bp, Homo sapiens
tatcccagcaccatttgttgggtagggtgttctttccccactttgtttttgtttgctttgtcaaagatcggttgattgtaaatatttgtgttaatttctgggttctccattgtgttccatttgtctatgtgcctt

SEQ ID NO: 24948 - DNA, 161 bp, Homo sapiens
cacttgctttcacacctacacctttatgtactttgttgtctctgtttgaaataccctttcttcctatctctacttgtcaaaatcattcaaggtcccacttaagttctaccttctcctagaatcttttctggtctctcttagactatctctccatcctgtac

SEQ ID NO: 24949 - DNA, 297 bp, Homo sapiens
attttttgcgacttattgaggttgtcttttctgtcattcaggaaagttttatggttttctctggaaaggtcttgcttgtttcttgttaggattcttgatacttttgagtctgtttcctcctttggtgtgtcataatggttattgatggtgtattgggaagttatagataatttggatgttgatcttagagctaacaatgatgctgagctttctaattctattgtcaattgattctcttgtatcgggttttttaagtaagcgaaaaggtctgcgcgtctgtgatggaagccggtccgg

SEQ ID NO: 24950 - DNA, 153 bp, Homo sapiens
taaaggaatttaggccgggcgtggtggctcatgcctgtgatccctgcacattgggaggccgaggcaggcggatcacctgaggtcaggagtttgagaccagcctggccaacatgatgaaaccccgtctctactaaaaatacaaaaaattaggcc

SEQ ID NO: 24951 - DNA, 110 bp, Homo sapiens
ccaggcacggtggctcacgcctgtaatctcagaactttgggaggccaatgcgggcagatcacaaggtcaggagatcaagaccatcctgggtaacacagtgaaaccccata

SEQ ID NO: 24952 - DNA, 290 bp, Homo sapiens
atcgttttatccagcttctttctgaccagtctgatcagtctgtcctcatccagaaacagatattcaagatcttctatgctcttgttcaggtaatatctgtgaagcagtttttatgcataaaaagttagtctgtcatttaccgtgttaaaaattaacaaagaatttcagcatttgaataatagttaacttgaaaatctacattaagtggatgattttctagcaaaatagaaattgcaaaaattataagtctaaacaagcatacttcctccccaaatacataaacaacccct

SEQ ID NO: 24953 - DNA, 355 bp, Homo sapiens
aggggataaaactggacaatctctggatgagccacttaacttctatgaacctctgtttcttcatctgtgtaataaaaacagcagcagtatctacttcttaggtttgttatgaaacttaaatgacagaacgcatgcacagcattgagtatgaagagaaagcgcctagtgaatgttagctggtttttttaccattattattattatttacaagtgcttactatatgccaaaaaccatgttagatgctcatttaatttttatgaaaatttgcataattttaattttttaacagtctttgggatagatattatatcacttatgattggagaagttaagtaatttgcacaaagccgtcac

SEQ ID NO: 24954 - DNA, 108 bp, Homo sapiens
tcttttccttgctcctgatattagggtgagaactctaaaatttcttccttaactgacacagttcactagtgaagccatgtggggccagatgtttgttttgtcggggag

SEQ ID NO: 24955 - DNA, 218 bp, Homo sapiens
cacttaatcctgtttctcatgtccagccagaaaaaagaacttcagtgaaggtaagataaataaatacatacacatatgtttttttggtagataagtgctaattacatatatgtaatgctttattaaatttctgaaatatttggtaactaaaattttctttttggaaattaataaatccagatacatattaatgttgatatgagtaaaaacaaatagga

SEQ ID NO: 24956 - DNA, 150 bp, Homo sapiens
gagaggagactgatcctaagttctagattacttttctagggccttctatatacagatcatggatatttttggaaaagttgtaaagtgtaaaccaagttcggactgtattatagagtctagtattttgcctttgtggtactcagacttgaa

SEQ ID NO: 24957 - DNA, 163 bp, Homo sapiens
aaagcaaccccaggaagcctggccccgaagaccgtgaggtatggtggggccttgctgtgctctggactggacaagaggcaccctgggctctggacacagccagatcttcagccaattgcatctccggcccagggcaggccctttatcttatagcccagtggtt

SEQ ID NO: 24958 - DNA, 418 bp, Homo sapiens
  misc_feature 353: v=a or c or g
  misc_feature 375: k=g or t
gccctggagacgctttccctgctgccggccgcgaccgcaacccgctaggccttcatcgcgagctacgcccggaccgagaagccccggcatggccacgtccatcggagtgtccttctcggtgggcgacggggtgcctgaggctgagaagaacgcaggggagcccgagaacacctatattctgcggcctgttttccagcagagaaatgggatttgaccgatacaaaatggtggtgcaagtagtgattggagaacaaagaggtgaaggagtattcatggcttctcgctgtttctgggatgctgacactgacaactatactcatgatgttttcatgaatgacagtttattctgcgtvaaaagcagcatttggctggttktctactactgaatgaatctttgaaaagctggtaaaagacatga

SEQ ID NO: 24959 - DNA, 202 bp, Homo sapiens
gtttagtaataaaaagcataaatctcttctgtaacttttataaaccacagggaggtttcaatccatgcattttccttcattactcaagattataaatctgtttttaaaatacatctaaacaaacagttgagaaacaaaagtttggcatgttgtcagatccccttaagaggaagaggttaagctgtaaagtagtggccctggt

SEQ ID NO: 24960 - DNA, 89 bp, Homo sapiens
attttaatggagtatctgtattgccttccccggggtggtgctattcagtgaggcaatgcaagggggagttcaatgaaactgggacatct

SEQ ID NO: 24961 - DNA, 148 bp, Homo sapiens
  misc_feature 41: s=g or c
cccatctcagcctcccaaagtgctgggattaccggcgtgascaccatgcctagccataatatattaactatagtcaccatgatttacaatagttctcttgaacttatccctcttatttaactaaatttttctgtcttttgatcaagct

SEQ ID NO: 24962 - DNA, 141 bp, Homo sapiens
  misc_feature 2: n=a, g, c or t
  misc_feature 6: v=a or c or g
  misc_feature 28: n=a, g, c or t
  misc_feature 42: r=a or g
  misc_feature 91: r=a or g
  misc_feature 141: s=g or c
anagavatttaatttaaatttgtaaganaaaagaaaactgaracagaactgccagtacaatgtttgttgcaattgtttccaaaactttgarataacgaaacccctattcaaatgtaaattttacccattcccacctgatas

SEQ ID NO: 24963 - DNA, 137 bp, Homo sapiens
  misc_feature 67: w=a or t
  misc_feature 68: s=g or c
aggtctccttcctgcccgaggaggccactgaggaggctggggtccgaggtggggcggaggaggaggwsgaggaagaagaagaggaggaggaagaggaagaggaggaggagcagcagcctgctaccaccacggccatt

SEQ ID NO: 24964 - DNA, 92 bp, Homo sapiens
agtttctcagagcaaccatggagtcacagcagttcttctgtcaccatgaaggggatctgctcagacgccatccttgttctagctacctccaa

SEQ ID NO: 24965 - DNA, 309 bp, Homo sapiens
  misc_feature 135: s=g or c
  misc_feature 136: s=g or c
tacagcaaagaaaggattcttctcaaagccatcgctccgcagcaggaacaccattttcaccctaggaacccgcgggctctgtcaatctcccccactgaacttgaggcccccatcctggtgcctcacacagcgcasscggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaac

SEQ ID NO: 24966 - DNA, 231 bp, Homo sapiens
attttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaagggct

SEQ ID NO: 24967 - DNA, 349 bp, Homo sapiens
  misc_feature 7: k=g or t
ttcattkgtatctggatctctgttatgtgccatttttcttctagcatcgagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcggaa

SEQ ID NO: 24968 - DNA, 276 bp, Homo sapiens
aagcaaagctcttagatcagttcctggagcatcacaaggccctgtatgtgcttgcaaaataaataaatagctccactttgggcaggtaaagtgaagtgttgagtaaattgtttcttcatagtgaataaagaaacggttatggaatgcccagcataagccttaaacacatccactcttccccctgggtgaagccaacaatgatactagggggatagttatcattcctgcctgcaacccagaactgaggaaagaggaccaggaagaataccagggctc

SEQ ID NO: 24969 - DNA, 200 bp, Homo sapiens
aactgggaaatcgtccggtgctgcaggtctcagccgaaggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtccg

SEQ ID NO: 24970 - DNA, 176 bp, Homo sapiens
  misc_feature 9: k=g or t
atttccatktttaaaagtaatttggttgtgtttatagttatttgtacaagtatttatcacagactctaaattgaaaaatatagtatgatctatatttgaccctaaaaatgttgcattaatttaacaaatatggcagatttttcataactaagtcttaagtcttctaaaaggaagca

SEQ ID NO: 24971 - DNA, 152 bp, Homo sapiens
cgataaatttttactcaaggaattccatgttgtgatttcttccactgtccatcaaggtcactttagatcctctaaagagctagagtcaaaagatttatcttcaagttagtcctttttaatgaaaccgatgcttattttaatccagttagccc

SEQ ID NO: 24972 - DNA, 180 bp, Homo sapiens
  misc_feature 144: v=a or c or g
  misc_feature 151: w=a or t
  misc_feature 152: w=a or t
tatggaaaaatgatttacttaatggaaacctccaaacttctttaagtttgtacccttcattaaaagtaggtcagggttaatattaagaggtactcttcccattgaaaatacatcttagaaaataagatttggaaaagctgttavcctgtgwwtgacccctgccaggagatcgtgccagat

SEQ ID NO: 24973 - DNA, 222 bp, Homo sapiens
  misc_feature 140: r=a or g
  misc_feature 141: r=a or g
  misc_feature 189: w=a or t
  misc_feature 191: m=a or c
  misc_feature 192: r=a or g
cagatttgctcagaaactctgcccaagattgggcagaagttactttaaaaagacttggttcagctggtcacggtggctcacgcctgtaatcccagcactttgggaggccaagccagatggatcatgaagccaggagttcrrgaccagcctgaccaacatggtgaaaccccatctctactaaaaatacawgmrttaacagcagagcgagactctgtctcaaaa

SEQ ID NO: 24974 - DNA, 338 bp, Homo sapiens
  misc_feature 278: b=c or g or t
  misc_feature 279: h=a or c or t
  misc_feature 280: v=a or c or g
actttcagtctcttttctgggggaaaaaaataataaacctagcctagccaggcgtggtggctcatgcttgtaatcccagcacttcaggaggctgagatgggtggaatcacctgaggtcaggagttcaagaccagcctggccaacatgtggaaacctcgcctcaactaaaaatagaaaaaaattagttgggcatggtggtgggcacctgtaatcccagctacttcaggaggctgaggcaggagaattacttgaacccaggaggcggaggttgcagtgabhvgagcttgtgccattgcactccagcctgggcgacaagagcaaaactcttcaaaaaacaa

SEQ ID NO: 24975 - DNA, 395 bp, Homo sapiens
aatgtaattttgtttacactaggttctagagtggataattattgattccttcagcaactttaaacaccttagccatttagatttttatataggattgttctgttgagtaaatgtttgatttgaatttaattttttcaggaaactatgttgagttattttaattctttgttatttttctttgcttttccccaggagccaaagtgaatgatgtggttccatgggtgttggatgtgattttaaataaacatatcatcagccccaacccacacgtgaggcaagcagcctgcatctggctcctttcccttgtcaggaagctaagtacccacaaagaagtgaaaggtgagccatgctgtatgtggtcagccctgttggaaccacagtattataagtagcaa

SEQ ID NO: 24976 - DNA, 183 bp, Homo sapiens
tttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacag

SEQ ID NO: 24977 - DNA, 241 bp, Homo sapiens
  misc_feature 191: r=a or g
cattttagtgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaargtttaacttttaaaaaaccatcttctgatcccttttattgtccgggccaa

SEQ ID NO: 24978 - DNA, 103 bp, Homo sapiens
aaggccgggacggttaggattgtcggaagtggccgattgcttggacagggccggcggagaagatcggagcaagtccgtggaagaagccaaagactgggacggc

SEQ ID NO: 24979 - DNA, 193 bp, Homo sapiens
  misc_feature 12: r=a or g
  misc_feature 13: w=a or t
  misc_feature 85: k=g or t
cacttaatacarwgaataaagggtaataatttaccacttttggattaccttttatttaagacataaatttttcaactcataagckatttaaaatcttttcacttaagatacctgttgaaattttgtttaggtatctggccaggaacagtcttcacggggacaaagaattttatctattccaattcggccccca

SEQ ID NO: 24980 - DNA, 306 bp, Homo sapiens
  misc_feature 49: k=g or t
  misc_feature 78: r=a or g
  misc_feature 84: w=a or t
  misc_feature 168: r=a or g
  misc_feature 169: s=g or c
  misc_feature 189: k=g or t
  misc_feature 192: y=c or t
  misc_feature 297: n=a, g, c or t
  misc_feature 298: n=a, g, c or t
  misc_feature 299: k=g or t
  misc_feature 303: n=a, g, c or t
atctttctgaacattcaccacactggtggacaaatcctttttgtgtgakgaagatgtggctgttgggagagtcaagtrattgawtgacgtgaatttcctggagtttccataagttcctgtaaatttagcctccaactgaaataaaccaactgaatgtaagacatcagrscctaaagaaccaaagttgtkatytctgtggaagaccagccaacctattctcacagctgaaacaatggatctggcctgcagagtgttaaggcattctccaagtttcaaaacaagagtacaccattttgnnkaaanaat

SEQ ID NO: 24981 - DNA, 127 bp, Homo sapiens
aatgattttggggtgaggggacattgaatcaggtctctgaaagaatctggggtttttagtataatatgtatgattccatctcatttcctttaactgagctcaaagttagaaagaaaatactgccctt

SEQ ID NO: 24982 - DNA, 158 bp, Homo sapiens
tagctgcaaatgccattaattcattttttatggctgagtagtattccatcatatatatatataccacagtttctttatccacttgttgattgatgggcatttgggttggttccaatttttgcaattgtgaatcgtgctgctataaacatgcgtgtgca

SEQ ID NO: 24983 - DNA, 153 bp, Homo sapiens
aatatgttcctgttttgtaataatagagaagaacgttactacctgtcttaaaaattgtgtgttcattagtattcatataaaccgttatggtggtaaaagaaagacaggttttaattagatataaggacttaagtaacctgcagaactggccct

SEQ ID NO: 24984 - DNA, 375 bp, Homo sapiens
  misc_feature 315: r=a or g
  misc_feature 323: r=a or g
  misc_feature 324: r=a or g
aattaagtactgagtcttttttattttattttagattcaaggggtacatgtgcaagtttattacacacacacacacacacacacacacacacacatatatattgcataaggagagattggacttctagtgtatgcatcacccaaataatgaccattgtaccccatagataataatttttcaaccaccaacttccttccagccttcccacttttgaagcccccagtgtctactctttccatctttacgttcatgtattaagtgctgagtcttagaccaatcatgactaaataactgcatgtcctctgttatatcarctaattarrgggtaactaataaagtgataatttgattccatgcaatggatacatctgatg

SEQ ID NO: 24985 - DNA, 77 bp, Homo sapiens
taggaccagaagcagagacaccacttttcaaaggacttcttggtttcagcataacctaagacagggaattgggagcc

SEQ ID NO: 24986 - DNA, 144 bp, Homo sapiens
  misc_feature 61: w=a or t
tatgtaagtatgtgtaagtagtgagtctgccatgcagggcagttactatggtaaaacatawtttggctccagaaactgaatttacagttggagtagctgactcaaaagttacttgcttaaaattaaaagtatgagaaacccccc

SEQ ID NO: 24987 - DNA, 159 bp, Homo sapiens
tacatgtgcagaatgtgcagatttgtcacataggtgtgtatgtgccacaggcgttggctgcacctatcaacccgtcatctaggttttaagccccgcatccattacgtatttgtcttaatgctgtccctccccttgccccccaccccccaacaggccctc

SEQ ID NO: 24988 - DNA, 143 bp, Homo sapiens
  misc_feature 41: s=g or c
  misc_feature 42: m=a or c
  misc_feature 93: s=g or c
  misc_feature 97: s=g or c
  misc_feature 108: s=g or c
  misc_feature 109: m=a or c
gcttttcagtgaggagtcagggaggtgtgtgtgagagagasmgagaaaagagagagacagagacggggagagagagagggagagagaagagasggasgagggaagaasmaaagacggagggaggtgaggaggaagggaggaga

SEQ ID NO: 24989 - DNA, 267 bp, Homo sapiens
ctctattatctcggcttctcgggaggagcctcatctagtcagtcacgcagaagtttctctttcgctcttcgcgctacacacccagattggcttccagcgcgcaggtaaaacctggctgtgccctgttgaaatcaattctgttgcagtcatatgcggtggaatctgttcttcttttgcatcctacgtaaccagaccaagctgtgggcttctcaaggtagcctccaggatgcacagagtgagagaggatgcttttccctaaaccaggat

SEQ ID NO: 24990 - DNA, 233 bp, Homo sapiens
caagatctcattcatttatatttcaagccttaattagtaggctgtatcctcttgtagctataagtagcacagagcttagtactgtacttaatttttctttcagtccttttcaatatatcagttctccccaaatgaaatacagtcttccagaagacaggatctccactttcttcttatccttggcattttccaacccctggctcactctgttatgattttgagcactccactgc

SEQ ID NO: 24991 - DNA, 338 bp, Homo sapiens
taataatattccttatttttttctgatggggtaattgagggcagctactctcagtaacattgaacccgatagcacatagtgaagactcattatctttatcaatgatgtgtcagttggaggtaaaaattaggtccttttcaatatccagtggtgactgtgctcctaggaagatcagccaaggatacacagtccgaaaagtttatagcttaggtaggtaggattaagtgcagtgcctctctagtacacacctggatgtgactcttgtgtccacatgtttttcaaacctggcaggaacaataaccccattcagaaatgacttctaaaaaggctatttttgc

SEQ ID NO: 24992 - DNA, 178 bp, Homo sapiens
cttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaatg

SEQ ID NO: 24993 - DNA, 176 bp, Homo sapiens
gaacgagcaccgactggattaggaggcgagagtggcctttttctggcagtcgttaatttaatggggccttgcgattaggctctggcaaactttagcaataggctccctagctgtttgacgtcggtgttgagcagaagatcaaggatccattttgtaggacaaagacgggaagagaa

SEQ ID NO: 24994 - DNA, 226 bp, Homo sapiens
ttctatactgcaggatttctgatgacattgaaagactttaaacagccttagtaaattatctttctaatgctctgtgaggccaaacatttatgttcagattgaaatttaaattaatatcattcaaaaggaaacaaaaaatgttgagttttaaaaatcaggattgacttttttctccaaaaccatacatttatgggcaaattgtgttctttatcacttccgagcaaat

SEQ ID NO: 24995 - DNA, 90 bp, Homo sapiens
  misc_feature 72: r=a or g
  misc_feature 80: m=a or c
acttctcaaagcatctccgtcgtgaacatggccctgccaccattcttcggccagggtcgcccaggcccaccrgcccccgmagcccccgcc

SEQ ID NO: 24996 - DNA, 182 bp, Homo sapiens
  misc_feature 5: m=a or c
  misc_feature 7: k=g or t
  misc_feature 8: r=a or g
  misc_feature 25: s=g or c
  misc_feature 34: m=a or c
  misc_feature 177: m=a or c
  misc_feature 178: m=a or c
ctcamakratgtcattttgtcatasatctctgamaatgaccttgaaaacttcccataaaaatcaacagaacttacgatgttcagagcataagaaataaatgtcaccttcaagattcatcaaaatgagcttagatgaaattttaattgccatactcaagccacttaaatagttaaccmmggac

SEQ ID NO: 24997 - DNA, 246 bp, Homo sapiens
  misc_feature 9: w=a or t
  misc_feature 27: r=a or g
  misc_feature 54: k=g or t
ccaggtagwccagcagcccttcctgaraaaactgtttcatcatcataatgcctktacttttttgtcaaaaattaatcgaatgtattaatgtgtttctatttgtgaactctctatctcattttatccgtttgttctttcactaataccacactgtctccattactgtagctttagggtaagtcttgaaattgagtagtgtctgtcctccaagtttgttcttctccttcaatatggtgttagctattc

SEQ ID NO: 24998 - DNA, 178 bp, Homo sapiens
  misc_feature 81: k=g or t
acggggtttcaccatgttgagcaggctggtctcgaactcctgacctcaagtgatccacccgcctcggcctcccaaagtgckgggatacatgcatgagccactgtgcccagcctatactaattgtttcttaagtacagccaactctggagctctggtctacatagctcttacccagcac

SEQ ID NO: 24999 - DNA, 209 bp, Homo sapiens
  misc_feature 69: r=a or g
  misc_feature 110: r=a or g
  misc_feature 193: m=a or c
caaggaagcttttagggattcgagaagaaaatacatgtgggatcttgccaaggtgctgcctttaggatrctgacccctgcactaccttagaacatgttgatctgtgagtrcccaagcccctgagggctcgatctcatggggcagatgaaattctcttccttagaggaaagggaaaggtgaggccccagaggamttatctcagctgtaca

SEQ ID NO: 25000 - DNA, 251 bp, Homo sapiens
atttctgatttgaaagggaagagtgcacaagattaactgcttctttggatgaatcattgttaataaaaagctgggcatttagaattttgccttataagcccttctccaaccataagattattttgtaccaaaaactttggtgttctctaccaaagcagttaaaaacttttagcctgctacttcttgtatttgtctactgacagccccttggtactatttaggttgggggaggggacctaaaataaatagac

SEQ ID NO: 25001 - DNA, 203 bp, Homo sapiens
gttgtaccttgtagattctcagtaagggggaagggagcatcagattgtggaacagcgtaaggtagtacgacttggaaagggagagaggatccaaattgtaccattttggaaattcacagtaataggaagcacagaacagtaggtaattggaccataggaaggcaggggtcaagggttatagaccaagttacaaagcagcgaag

SEQ ID NO: 25002 - DNA, 191 bp, Homo sapiens
  misc_feature 62: k=g or t
gcaacctccgccttccaggttcaggcgattctcctgcctcagcctcccaagtagctgggatkgcaggcatgcgccaccacacccagccaattttgtatttttagtagagatggggtttctccatgttggtcaagctggtctcgaactcccgacctcaggtgatcagcctgtctcggcctcccaaagtgctg

SEQ ID NO: 25003 - DNA, 155 bp, Homo sapiens
caacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggccca

SEQ ID NO: 25004 - DNA, 241 bp, Homo sapiens
  misc_feature 2: k=g or t
  misc_feature 25: r=a or g
  misc_feature 44: m=a or c
  misc_feature 74: r=a or g
  misc_feature 75: v=a or c or g
  misc_feature 198: m=a or c
  misc_feature 223: r=a or g
gktgttctaaggacatattgtatarttaaattttaaaaagagamagttactgagcccctatctctaaaaattarvaatagctgggcgtggtgctgcacacctgtagtcccagctacgcaggaggctgaggcaggagaatgactcaagtctaggagtgagctgtgatggcaccactgcactccagcatgggtgacaggmagagttcatctcttaaaaagaagaragaaaaatttcattaggt

SEQ ID NO: 25005 - DNA, 170 bp, Homo sapiens
  misc_feature 70: r=a or g
ggagatgttttcaagcccggctccggcggctttacaggcggctgcagcggcgacgaagacaacgacagcracggctacgccgaagcactcgttccgggggtgaagcctcctgcgccggccttgcctcggatccaggatgagaagactgataaaagaagaagctagctgag

SEQ ID NO: 25006 - DNA, 209 bp, Homo sapiens
  misc_feature 64: k=g or t
  misc_feature 68: k=g or t
aactcataggagtagctgtggacagaggaaccaacatctgccacctctggcattttctttcttktttkttctttttgagacggagtttcgcttttgtcccccaagctggagtacaatgacaggatctcggctcactgcaagctctgcctcccgggttcaagcgattctcctgcctcagcctcccaagtagctgggattacaggcccccc

SEQ ID NO: 25007 - DNA, 277 bp, Homo sapiens
acttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactaccccat

SEQ ID NO: 25008 - DNA, 446 bp, Homo sapiens
  misc_feature 9: r=a or g
  misc_feature 10: r=a or g
  misc_feature 11: r=a or g
  misc_feature 64: w=a or t
  misc_feature 238: w=a or t
  misc_feature 386: d=a or g or t
  misc_feature 438: w=a or t
atcttctarrraaaaaatagtataccttattaagagggtttcctggcatgttctttggactgtwaccaagtctttggcacacgagggtacttccttgatcgtctagccatttctgatttttgaacctgagacagccaacattgagttgatctctagatcagctttacagaatctaacatagtaacctcggtttcacttgtcctgggcactcctggctgctgttccatttttgtctttwccttttatatctactacacattgtctaaagagggcttattccccttctctttcctatccactggtcaccttactccaacatcagtggttttcaaccctggctgcattttagaatcacctggagagctttcaaaaccaccagtgcctadgtaccatcctaaggcagtaggtcagaatctctaggtatggggctgggcatcwatgttttt

SEQ ID NO: 25009 - DNA, 209 bp, Homo sapiens
tttaaggcaaaaacaacacttttctatatagtgtatgcaggacagattttagaaacttagattaaaatacaaatcccattacatttggttaaaatgaaaatctctgcttaatggaaaaaatactaatctttagcctattttgagtctataagatatatttcattttagacatgccttctaagttgttcacagatttttacctgctaatt

SEQ ID NO: 25010 - DNA, 418 bp, Homo sapiens
  misc_feature 160: r=a or g
  misc_feature 161: r=a or g
  misc_feature 204: m=a or c
ccatttaggcttgctatgtcttttgactgatgatcccaggttctttcatagttgtttctgtgtttggctcctgatcctttagacaagtcagccaattctggcagtgatagaacataatggtttcagagcctctcccacataagacaaaaatgactccccrrtgagttgctgaagagccagaacagatcttctctcacatgagtmttgacacttcgacaaagcatgaagtgaaggctcatataacaaaactgtgtttggttgagttggcttcaagattagtttgttataaatgactacttttctattgcttttactttttcttgtcatgagccgcctttcttcttaaatggtgtttagtactttgcattgttatgtgtgatctaccagttatataccatactttcaattctgtatatat

SEQ ID NO: 25011 - DNA, 110 bp, Homo sapiens
tggctgcgtactattccatggtgtgtatgtgccgcattttcttagtccagtctatcattgatggacatttgggttggttccaagtctgtgctattgtgaatggtgccgta

SEQ ID NO: 25012 - DNA, 206 bp, Homo sapiens
ctggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcaagccc

SEQ ID NO: 25013 - DNA, 293 bp, Homo sapiens
  misc_feature 9: s=g or c
  misc_feature 10: s=g or c
  misc_feature 47: w=a or t
  misc_feature 79: s=g or c
  misc_feature 180: s=g or c
  misc_feature 200: n=a, g, c or t
  misc_feature 201: n=a, g, c or t
  misc_feature 261: v=a or c or g
  misc_feature 262: n=a, g, c or t
  misc_feature 278: r=a or g
  misc_feature 279: v=a or c or g
ggtcgggcsscgacgcgcgcgggtctcgtttggagcgggagtgagtwcctgagcgaatggacccggcagcgggcgatasgggggccaggtgcctccacagtcagccatggcagcgctgcgctacgcggggctggacgacacggacagtgaggacgagctgcctccgggctgggaggagasaaccaccaaggacggctggnntttactacgccaaatttgccatacggatgggaacaagaaactgatgagaacggacaagtvnttttgttgaccatatrvataaaagaaccacc

SEQ ID NO: 25014 - DNA, 144 bp, Homo sapiens
actattaaaattgtattgggaaaagtaaaaatgtgaaaggagctttaagttagaaggtattcattctagatcagtctctaataagtcaccatcatcaagggaattcactttttgtttttttatttcaataggttttgggggaga

SEQ ID NO: 25015 - DNA, 148 bp, Homo sapiens
ctgtgagccttctgctttaaatctgatgtaagaaactcctgttaacaaatagtaagtatgggttaattagccctttgatcaaagcctagctttacattgtttaggatctttggaaaacaattggtttggttgcccactttccgtcgaa

SEQ ID NO: 25016 - DNA, 141 bp, Homo sapiens
  misc_feature 15: k=g or t
  misc_feature 60: b=c or g or t
  misc_feature 69: w=a or t
  misc_feature 71: m=a or c
  misc_feature 84: m=a or c
  misc_feature 86: s=g or c
  misc_feature 116: k=g or t
atcctcagtgaggakggccgccctgcatccgtcgccggccccggtctccaggggcctcabccgagtcawgmcccgctattgcgmasgatttgttgtaagaaccgccgggggacgakacaataaagaccggaagctgagttt

SEQ ID NO: 25017 - DNA, 327 bp, Homo sapiens
tactatacctatacttgacccaaagcaaattctcctcctccctaggggtgttctgctggttccctcaaatggacactccatgctggaagtgtgtgagttcaagctctgggagaactggcagttgcccacatatgttgttcagataacccctcttgctcagggcaaagaggcacattgaagaatgaatgtctgaaacagccttgataattcaagataaatacctctaaaatgataatcccagatgcttagttcaattttttgttattcaagattacataatgctgtgaaataaattccaattatttgagcattttagcaggaggctcc

SEQ ID NO: 25018 - DNA, 127 bp, Homo sapiens
ttggaaaatgtttttagatattcataagctttcggtatttaatactaatatttgtcaccagccaaacaaatatttctaattatcttggtaattagaccttagttattttatcatattagctccttat

SEQ ID NO: 25019 - DNA, 369 bp, Homo sapiens
tagctaaaaatgtgactggtttctaagatatttgaataacaagatgtaaattgtttactgtgatagctaagcctataattactatgtgatatcataggcaattaactgattttaacaccttttagagattcaaattagactctcagtgaatttgcaaatattcttttctccttttaagatatgattgtagcctttttaatacgtttttattgaggtaaaatatgtgtaaaatttactgtctttaccatttttatgtgtacagttcagtggtaataaatacatttatattctttccccttcattctttcctccccactaccctcctcagcctctgctaatcaccattctactcttatcttcatgagatct

SEQ ID NO: 25020 - DNA, 105 bp, Homo sapiens
tgcactggggagatgacacactcctcggtcattcctccgctggccccgggagttcggagggtgtctctaggctatgagtcttccccaagtggttccctgccacct

SEQ ID NO: 25021 - DNA, 198 bp, Homo sapiens
gtaataaaatcacaacatatattgaaggtttactatgtactagatgctatttaagtgctttatattaactcgttgaatcctcagaataaccatatgatgtatgttttgcaccctattttttaaattgttgttttttaaccttttaaaaaaagtatggattaactggacaagcaaagaaatttacagggaagtccacag

SEQ ID NO: 25022 - DNA, 106 bp, Homo sapiens
aaggagacgccattagagggaggcagagagggatcgttcttcgcttttcctccggtgcctgacgtggtgggctggggcccttcattctcggactttccctcagcct

SEQ ID NO: 25023 - DNA, 110 bp, Homo sapiens
actatgttaatatcagacaaagccgacttcaaaacaaggtatgttgccagagatcattaaggacatttcaaaatgatcaaagaattaatcatcaagaagacgtaacaggc

SEQ ID NO: 25024 - DNA, 316 bp, Homo sapiens
  misc_feature 105: w=a or t
  misc_feature 106: w=a or t
  misc_feature 125: r=a or g
  misc_feature 155: r=a or g
  misc_feature 276: r=a or g
taagtaaattgtagtatatttatacaatggaatgcaacacaatactgaaaaatgaatgaattacacctgtgcttaacaacttggatcatcctaggaaaataatgwwcgaacaaaacaaatcactraagaatatagtgtgattccatttatatagratcaaagaacacgcaaaattaagtaatatattgtttaaggataccaatacacataatacaagtctatgataaacataaaatttaggaatgagtgaatttggacacagagtagatatcacargtcaggataatgtgtgtttaaaaaaaaacgatggtggtaa

SEQ ID NO: 25025 - DNA, 194 bp, Homo sapiens
ttcccatcattgaatctgttaccttcacactcagatccttgattgctctttggattaaattaaggcatgcgaaagaatcacttgtcatttctaataaagactgggttgaaaacctgattgaggctggcatacctgtgaagtatgagtcatcacttgcctaatttttattctgcattatagtactagagcccgtt

SEQ ID NO: 25026 - DNA, 128 bp, Homo sapiens
cactattgcccccaaccccgggattttgggtggtctccacagccaccatcatacactcatcccgtgttttcttccaaaaagtcacctcagcagcctccccaggcgatacagagggagagcccagagcc

SEQ ID NO: 25027 - DNA, 56 bp, Homo sapiens
tagaattggggcttttgttttcaaaagagtgttctttatatattctggatattttt

SEQ ID NO: 25028 - DNA, 291 bp, Homo sapiens
taccctctctatatgtgtaacagcttctctgttttcacattcagtagtccatactgctatcttatcacctttagctctaacattaagaacagctgcacatatatcatcactgagtcatcaaaagattctccaataagacacagtagagtctctagccaaaagtgattgaggtcccttcatctctgctgtttgttcaatgtaaattagccatcatcctccctgtttgtttttctcatcttcccacatgggctcaacaccatccttaaaaagtgagtagtcacagccagagat

SEQ ID NO: 25029 - DNA, 249 bp, Homo sapiens
gagccatcgagcgcccactctggcaggcgtgactgcttcaccgtcgaaagagcgatggagactgcggcccaagttaggattaggacagcggtttttcagtccggagattccggccacaactatttttgtctgtttttatcgtaagccagagtctttgggtgcagctctgggacacctaaagggcctggagaaattcaggcggggccagtgctgtgggggtagatgttagacgtggaagggaccctagag

SEQ ID NO: 25030 - DNA, 105 bp, Homo sapiens
ttttctgtggtttcacagggacaattttatggtagctaacagtaatatgaagcccatctatgccagagggctttgctacactggccccatctgcggagagtccaa

SEQ ID NO: 25031 - DNA, 274 bp, Homo sapiens
  misc_feature 9: m=a or c
  misc_feature 56: k=g or t
  misc_feature 66: d=a or g or t
  misc_feature 73: w=a or t
  misc_feature 75: k=g or t
actcaagtmttgttgtgaagcctaaaaatattcacaaataagcttttaaactggtktcctttggadggaaggwakatacaaaaagattgtggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgcct

SEQ ID NO: 25032 - DNA, 431 bp, Homo sapiens
tgtgaacagacagttaacagaaaatagaatgcaaatggtctttaaacatacaaggatatgcataaaaagacaaatgcaaaataaaataaaataatggaaatacctttcttacctgtgagattggggaaaatccaagttaggcaatgcactctgttgagacaatagggaaacaggcactccaaaaattacaaatccctgtggatggtatttgttaactagcaaagttaaatgagtatatccttcaacctggcagacccagttctaagaatccatatgagatgcacttgcaagaatatgaaatagtatatgcacaaagatcttgattacagcactgtttctaatagctacagactggaagccagccaaatctccattgatagggaattgatggaaggaactagggtatatctatacaatgggatactacacta

SEQ ID NO: 25033 - DNA, 141 bp, Homo sapiens
taggatgtatacaagggagtgactcatttaagctacaagagcacaaaatgggtgatggatagtgatgggtagagatgggtagcgggcttagttgtttggaggtcccattgaggttaaaagctattaagagtataggtgact

SEQ ID NO: 25034 - DNA, 419 bp, Homo sapiens
  misc_feature 320: w=a or t
  misc_feature 321: w=a or t
aatacaaagaagggagaagaagatttctaaaccttttcagagtcttttagaaaatctgtaagatgatatggtccatctgccagcctagtttccagtatgacagatattttaatgatggtttagtgttaaattattgggaccaactatgtactgagtactggggaatagaaaaaaatacatgaacaccagagacccctggctgggaaatatttaatgttcatttatatggagggtttaggatgaagatttttggttaagtttctatgtacagttttacacatggggctgatttagttttcatgtacttgttggaggagtgwwctttaggttagaaatcattcctggagaacaaaataattcaacagaatactagaagcctttagttaaatatgtaacagcatgaatgaagatgatgggac

SEQ ID NO: 25035 - DNA, 167 bp, Homo sapiens
cccctcaacttttttacaagacagacattataatttatgtaacatgttcgtctgcttattagaagttaacctagcactgagatttatataaaaggttacatttattgcttattaaaactttactgtactttcacagattcttcagagcatggctaacccaacaagac

SEQ ID NO: 25036 - DNA, 255 bp, Homo sapiens
  misc_feature 191: m=a or c
  misc_feature 235: w=a or t
  misc_feature 240: y=c or t
cataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaccctatatgcttactgtgcacctagagcttttttataamaacgtctttttgtttgtttgttttggattctttaaatatatatwattcycatttagtgccctta

SEQ ID NO: 25037 - DNA, 248 bp, Homo sapiens
aaacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagtt

SEQ ID NO: 25038 - DNA, 321 bp, Homo sapiens
  misc_feature 7: y=c or t
  misc_feature 8: h=a or c or t
  misc_feature 20: w=a or t
  misc_feature 146: w=a or t
tttgtayhtcatgatggtawatgatagagtagtatctacatatcttttatgctttataacatacctttttcttagtttttttcagtgtttctaggctacctggtttatgagtttttttcagattgtctcaaatctccaagacattwtgcaatgtttcttgaataaaatctgtgtataaatggacctatacagtttaaacccatgttgtccacgggtcaattatatagctctgttacaacaaccattttgtcagtgcctcatgtatgtttgtgatggctgtcatttgggctctcaatttttgtcctcaaaacaatacccggc

SEQ ID NO: 25039 - DNA, 227 bp, Homo sapiens
  misc_feature 7: k=g or t
ctaatgktcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcgct

SEQ ID NO: 25040 - DNA, 147 bp, Homo sapiens
  misc_feature 115: s=g or c
aatctaacatcatacataatcttaggattattctgggaataatgttaaatctagtgatgtcagttggcataatgagaaactctgggtgtagatacagtttcaatcagttcatgascatttaattacttcaggaagcaagaacgacgt

SEQ ID NO: 25041 - DNA, 172 bp, Homo sapiens
ctaaacttgttacatttgaggcaaatatgtacagtatttttcccttttaaagatagtttaaaaaatcaaggtaataaaaaacggccaactctttcaggaaaaaaaaaatccggtattttgtactacttgagtttctctaatgcctaaaatatgcatttaaatcatcccacaa

SEQ ID NO: 25042 - DNA, 65 bp, Homo sapiens
tattttgcaaatcgaccaaactttcctaatattatgatcttaaaattcatagagtactttattgc

SEQ ID NO: 25043 - DNA, 128 bp, Homo sapiens
  misc_feature 114: y=c or t
gacgctcggtcggcgcgcccgggaagggatcgtcaggttttccctgagaggctgcggcgctgctgccagccctgttctgttgagaatctctcctacccgcattcaagtgctctytctaaagacctcgc

SEQ ID NO: 25044 - DNA, 307 bp, Homo sapiens
  misc_feature 7: b=c or g or t
  misc_feature 8: n=a, g, c or t
  misc_feature 9: n=a, g, c or t
  misc_feature 26: r=a or g
aacacabnnctaggcaccgacccttrgttagctcagcagccaaatgaagaggaggtcgctccacttctaccttcagaaggctgtctcctgcgaggaccagaagttgagccaaggcacatggaacttacaatagcagatggtaagaaccagggcagaaggagaactcctgaagcctccgaagaaggaaatcattacagggccctacagaagtaggtcatgtgctacagctgctcatagtttaagaggaagaaacatgggatctcaaacctggaacacgactctttcaaaatgcttgtgagcaaccgcg

SEQ ID NO: 25045 - DNA, 73 bp, Homo sapiens
gtaagttcattgattaaattctctgttgggagaacaaaacttttctcccttgacactttattatctttgattt

SEQ ID NO: 25046 - DNA, 156 bp, Homo sapiens
  misc_feature 103: b=c or g or t
  misc_feature 126: w=a or t
  misc_feature 127: n=a, g, c or t
  misc_feature 128: v=a or c or g
caacaagaagacttaactatcctaaatatatatgcgcccaacattggagcacctagattcataaaccaagtacttttagagctaggaaaaggcttagacagcbacacaacaatggtaaggagattwnvacaccccactgacagcatgagacagcgg

SEQ ID NO: 25047 - DNA, 121 bp, Homo sapiens
caatacgtctcttaatgaaatgtcagcttgtaagggcagagctgacaagtatgaaagagtaatggttctgtgaaataatagggtagagggaggtggtttgctgattaagttgctcattacc

SEQ ID NO: 25048 - DNA, 126 bp, Homo sapiens
catcatatggcttcccattgctcttatgatgaaaatataatccttagtggttctacaggtcctatgtaatctgatgtctgctgacctttccagtcccatttctcaccatgctagttcttgatcccc

SEQ ID NO: 25049 - DNA, 303 bp, Homo sapiens
tacatatttacctgtattgataagttgatacacagtttattttttgttactaaggtgttgaaggaaacctggaaattggcaccataaatgcatttccttgaaatgatttctttaagatgccataccagttacaagtccatacacctagaggataactaatgtagcatactgaggtttggataaacctggtactttagagataaagtacaaattacactcaaataatgtattttaaaaactcagtcccaattttagttccaattccaattccttctttttaccatgagcaaaactgaggttctc

SEQ ID NO: 25050 - DNA, 125 bp, Homo sapiens
tctttaaattgaaaggtaataacaacatgaaactatgaaaatataaagactctggtaaaaaatacatagatacagaatcccttagtattgtaatgtttgaacataaaccatttttaagcctgcat

SEQ ID NO: 25051 - DNA, 278 bp, Homo sapiens
aaaaaggagcgagcggggagttctaggcccaggacagcacctatttcctgctggtgtaacagagcaccttctctcactactctggccataccacccccgcgatagaggagcaacacagctgtctctgtgcgctccggatcagcgcttcctagatttctagccggatcgtttggagaagggctctgcatcttatttccggtggcggtgaggtgcagttgccatggtgattagagaaaggccgagatctgtccagctgcgaatggcgatcagtccacgcc

SEQ ID NO: 25052 - DNA, 235 bp, Homo sapiens
  misc_feature 7: r=a or g
atagcargctatatttctctctggaactttaccacccttccgctgcctctctaaactatagtagcagaaccactgttaggcttgcaatttacatagtcttagattaaccaagactcaaaaacaaacaaaaaaaacaattccaagcatttagaggtgaaaaggtctttaggattatcctgtccagttgcatcacgttaccaatgagagtacagaagcctaaagaggaggatggcgg

SEQ ID NO: 25053 - DNA, 144 bp, Homo sapiens
tgtaattatattacctgtcaatcgctacttttcctttcttaccaaaattcacacaggtatgaaagcaatatgacattcaggctccattatgtgtatttgtgcacatcacttcccacgataagggagaagaaaagaaaccaccgc

SEQ ID NO: 25054 - DNA, 223 bp, Homo sapiens
atcactagcggctttaatattgagcttctatatcgttgtgtccacctcactttttaaggctgttcatacctggcaatattcacttactctgctatttttaaaaactattttaaagttttaagcacaatgttgactcttctgtaatttcctaaaattatattgttttcctacagacagctcaactttccttgatatgtaacactctaggaaaataactgccttc

SEQ ID NO: 25055 - DNA, 118 bp, Homo sapiens
acatgcatcaggaccagagattcagaatggacagtttagaagaacctcagaaaaaagtctttaaggctcgaaaaacgatgagagtgagtgatcgtcagcaacttgaagcagtgtacaa

SEQ ID NO: 25056 - DNA, 153 bp, Homo sapiens
ttcttatattgtgaaatactcttccaaatgaaatgtgcttttgatggtttcatggtattacactgtatgaatataccatcatttattcagtgattcccttaccttagcaatgttaagcctgttggtgtaatatgcaacaattaaggtccagtt

SEQ ID NO: 25057 - DNA, 93 bp, Homo sapiens
aaaaaatctttgcctattcccaaaatattctcctatttatcttctaggaacagttttacctttcacagttagagctataattcttctgatttt

SEQ ID NO: 25058 - DNA, 220 bp, Homo sapiens
attctgggcccctcggccgcgccttcgcggcgggcgatgttagtgggcttgggcgttgggtgaagtatccaggttgggcgcttccagcgctttctgtggcgggggaatgaaggcctaggtcagggaataggaaggtgtatcgccgccagagtgcggaacaccctcgccttgagggttcccacagtgacttgcaaaagtctagtgagacccgagaatgctg

SEQ ID NO: 25059 - DNA, 194 bp, Homo sapiens
  misc_feature 7: n=a, g, c or t
  misc_feature 8: h=a or c or t
  misc_feature 73: n=a, g, c or t
acagganhaaatgagacaggacatgcagaagctcttagcttgctgctcacacccagcaaatagtcaacatatntttttccttctttcacctgcccattacccccaagaaacactctttaattacacctaggcctcttgactgaaagttgaacccagggttttccctaaaggaaagagagagaaggaaggaagga

SEQ ID NO: 25060 - DNA, 246 bp, Homo sapiens
agtagtgacttctgtggtccctgacttgcaccctcaccctattattggagttgtgcttcatttctctgtgtggaaagagtgaagtattgggaaatatgaccctggtcaccaaaccaactcagagacagcaagtgctttggcaaaggaaagggctggcacagagaacagagtcgatttctcattgtcttcaccaatcttctgaacccgtgaatactttttgcatgatgatttgaagcagccagcagt

SEQ ID NO: 25061 - DNA, 312 bp, Homo sapiens
caaggtttaaagcaaaaattaaaatttagaaaacttgtatccactgccgtaacctgccagcttcccagtactttaagacttttctggggaactcaatagtaatgttatgtgcatgtgaattaatgggtgtgacatttttgatgtgtaattacatggctcaacgtttggaagatctgcaaaagtcggtgaaccacagttttccaaatgatacgaaatcatgtacgggtaaaagatttgttcaaagtacaagataaaccaagtaagagtatgaaaagttcattgataaggtttcagacttttacactgccaaaa

SEQ ID NO: 25062 - DNA, 155 bp, Homo sapiens
  misc_feature 143: s=g or c
atctgaggttggaaataaagagaaagtgacattggagcggatagaaaggaagaaacggcgtgggatctgggaatgaggcagtgggtggagagagaatggggagacgacagaggatgaagggcagctgagtgtgtctgcgagasaaggaccaaagc

SEQ ID NO: 25063 - DNA, 392 bp, Homo sapiens
  misc_feature 298: k=g or t
  misc_feature 299: y=c or t
  misc_feature 363: m=a or c
  misc_feature 364: n=a, g, c or t
  misc_feature 365: k=g or t
  misc_feature 390: s=g or c
aacagtaaagtgatatagtattcagagaagtaattactaatgttatttatttagaaaacatatatgcccttcagactattgtatccgtttggttgctttccttttataaaggaaagtcttcaatacaatacaataattattgaaaaatgagtagttttatcgtttgtctcaccataatttaacaaatacttgggtatagagttgaactggtttatctactgtttacacttttgaacggcattcaattaaggttagttttagtaaagatcttagaatctcagatgggacttttcagctkyaggaaattggaatgtgtccctggactatgcccatgccagagtgccaagctaaaagaatgtaggmnkcctctgaccaggcccttcaggggascg

SEQ ID NO: 25064 - DNA, 201 bp, Homo sapiens
  misc_feature 7: m=a or c
tgattgmgggattgtgtagaggtgattttgaagatggaagacttgtgcactgaagaaaatgagaaaaatgagaagaaatgaaaagaataaaatcaatgatgggaaaagttgaacatataaagattaaaggagaaaaacaaagaagccgtcatgtaaaaatagtatttgttgggcttatttttctaaaaagcagtgcacata

SEQ ID NO: 25065 - DNA, 126 bp, Homo sapiens
  misc_feature 7: y=c or t
  misc_feature 118: r=a or g
acatgaytctgcctcagctcgggaatgggcagcctccagctggggattttctagccggagctgggaggttcaggctgcgggaagtcgctggagggagagctgggatcgtggctgcaargggtggcg

SEQ ID NO: 25066 - DNA, 102 bp, Homo sapiens
catttaaatcaatctgataaaactgataattttaggataatcatatttagtttattttaaaatgtacgtagtctacattttaaatctctgatataagattgc

SEQ ID NO: 25067 - DNA, 278 bp, Homo sapiens
  misc_feature 7: m=a or c
  misc_feature 137: d=a or g or t
  misc_feature 212: s=g or c
  misc_feature 213: k=g or t
tatttgmtttttttgagatggagtttcgctttgtcacccaggctggagtgcagtgacgcaatctctgctaactgcaaccttcacctcctgggttccagcaattctcaacctcccgagtagctgggattacaggcgadtgccaccacacccggctaatttttgcatttttaatacagacgggtttcgccatattgcccaagctggtcttgaaskcctgaccacctggctcagcctcccaaagcactgggattacaggcataagccacagtgcccgacga

SEQ ID NO: 25068 - DNA, 147 bp, Homo sapiens
agtaaataaccagtatcattggaatacttttaaacatgtaactatgaaaggaaaaaattatatatacataaacatacacattgtgttttctgttaacctttgtcttattctcattgtggtgaaaagattaattttttagcagctttg

SEQ ID NO: 25069 - DNA, 125 bp, Homo sapiens
ttaatgtttcatctgcttgctttattgattaatgcaagtgatgtaacgtgtcacttgtaagcatcatatacttttacaaatcttaaagcctttgtattttaattagcacgtttacttcactcctg

SEQ ID NO: 25070 - DNA, 312 bp, Homo sapiens
  misc_feature 90: r=a or g
  misc_feature 98: r=a or g
  misc_feature 134: w=a or t
  misc_feature 140: r=a or g
  misc_feature 150: m=a or c
agtcttgttttatgaggatgtctgcattaaagcagtaaaataagctttccattttattcataatctaatgtgtgtgtatatatgtatgtrtgtatgtrtgtgtatatatagatgtatatatatacacacacagwgatatrtacatatggmtgtacttttgcatagatcaaacagccaaacacctggaagtattagatacaagtttaaaatatcttttataggttttatataaaaatgtctgagtatgattttgtgtgaaagttctgataccagttgtaatagagtcaaatttatgtgagcaataaagaagaa

SEQ ID NO: 25071 - DNA, 163 bp, Homo sapiens
gaaatagcgaggaaagagaagaaatccgggagctcgcgggcgctctggttgcaatcgcgcccccctcatctgtccccgccgttccccttcggaagctgccccaggcacacttccccgcttctttccagtctcctctcctctggttctcccgacacccggacca

SEQ ID NO: 25072 - DNA, 283 bp, Homo sapiens
  misc_feature 2: n=a, g, c or t
  misc_feature 248: n=a, g, c or t
cnaaaattattcacagatcttttttttgctgaaatcattttaaataaagtctgacggggagggagagcatcagcataaatagctaatgcatgcagggcttaatacctaggtgatcagttgatagcaatatgctttgataagatttgccatagtgaggtacgtctttcttcttcaaagtaagaaaagtgtggttagataagagaataggcacattatcagatcaattttagatgtgtctgaaagctgangaatctggaaatagattcccttaaatatgtgcatg

SEQ ID NO: 25073 - DNA, 149 bp, Homo sapiens
tcataagattgttaatctgctgggtcaggcaaatacagaagagtttttcactttattcttgattattttacttatgatcatttccaatttagttggggtaataacctgatcagttatatacattgcactcattcattcttcagcaaacc

SEQ ID NO: 25074 - DNA, 56 bp, Homo sapiens
aaagccctgaagggtcaaaagaaatacaaaagcaaaggctattttctttttttttt

SEQ ID NO: 25075 - DNA, 117 bp, Homo sapiens
  misc_feature 13: m=a or c
gtcgctagtggcmgctggggctgggaggggtgtgctagagaggcacagcttctctgggcgtggtttttatcctgggggaaggatcggtggaatgtgaggggaggtggaagagatggc

SEQ ID NO: 25076 - DNA, 181 bp, Homo sapiens
caagtaaattcttctatgtaacaagaattatgccaagtaacttgcttgtgttatcttaatcagtggttctcaaagtctgttttttagaccagcagcatcagcatcacctgggaaactgataaagacacaaatcctagggcccacccacagccctcctgcatcagaaactctagaggtgtcc

SEQ ID NO: 25077 - DNA, 320 bp, Homo sapiens
  misc_feature 2: v=a or c or g
  misc_feature 3: s=g or c
  misc_feature 146: n=a, g, c or t
  misc_feature 228: y=c or t
  misc_feature 276: h=a or c or t
  misc_feature 320: s=g or c
gvsaggctcctgggcgaccacgcccaatccttcctttgccgccccgctggtatgtcccggacccccaagcaggtagaactcaccacagcggggtggactccaccacaataaaggttaaacggcactgaccatgctgagccacagcnggtgaagatggcggtggcacactgacgtcacttccgctccgagcctccggccgggtggggctccagggcttgagtttcaggyacgtaggacaaagaaattctagtttcctcctgggtgggtgccggacghtgcctggggttggctcagggagcgggatgcagaaacgggcagcs

SEQ ID NO: 25078 - DNA, 214 bp, Homo sapiens
atagagtgtcagttggtataagcccttggagagcaaaacagagatattcaccaccctcttatcccaaccattccacatactattctacgtaaatatcttgcagagagattccagcactagtgctatagaatacatttacaggaatgtttattgcaacattgtttaaaacaagagaaaaaaacagaaacaaagtaaatgttcaccaacaggagaa

SEQ ID NO: 25079 - DNA, 142 bp, Homo sapiens
tatgtgaatgttattactctcagtgaattgttattgtttgcaaaaatgcactgggcagtaacattttgtgataaatcctataagatataagtcattgagatgtctaagatgctttttattttaaccccagttaataaccacc

SEQ ID NO: 25080 - DNA, 143 bp, Homo sapiens
aggaggcactgtcttccaagagctgcggagggcaccatccaggccccagatcttgacctggctcaagtgccactgattctggaaggctcctaatgctgagggtggggggatggggtgggaatgaagccaagccgctggaccct

SEQ ID NO: 25081 - DNA, 418 bp, Homo sapiens
  misc_feature 180: s=g or c
aaaaggatgagccttccttgggccttcggatctggtggggctgccactttgggaagggccccgggcttcggaagaaagcaaaactagccttgtggcgaagaaggagcccagctggccccaggctgttaagactaaggggtcgagggaaaagaggcagagcctgaaaccaaatctgcggasaagccaaggcctggggacttgccagagggaagggttaagccgtttccaaggcaacggaccaggaagcgcgcaagacgtccgccgcagtgttttgtggattaactcttcattgattatatacaacaaaaaatagttatggcgactttcagaaacaatcacatgaagactaaagcatctgtcagaaaaagcttcagtgaagatgtgttccagtctgtaaagtctttattgcagagtcaga

SEQ ID NO: 25082 - DNA, 221 bp, Homo sapiens
caattttgctatatatattctaggcatagttttggaggaaaacacatagttacactgagtacagtaatacctgctatagttctaaaaaataatttgtccttattctgctctgctgccacagtggttcttcccatgtggtgagtgagaaggaacagtggagaaacagcagagccaggtcagggaatgctggtgacatttagcctcagtgttcggggcgcgag

SEQ ID NO: 25083 - DNA, 213 bp, Homo sapiens
  misc_feature 160: s=g or c
ctgtgtgtctctgtgtgtgtgtgtctagctttctctctcagatcacatgctgtaggggaagtcagctcccagccatgtcttgagtagcctctggagcaaagaaattgtgacccacagccatgttcctgggccatcctggacaagaatccttcagcgtcascaagtgtcagatgccataaccccatggtaacctcctgagagaccctgagcttc

SEQ ID NO: 25084 - DNA, 101 bp, Homo sapiens
cactgtagctttataaaataccttagtatcagctaggtccaagtctccaggcaggactatcaaaatggactccttcttcctatcagctctagaaccccaga

SEQ ID NO: 25085 - DNA, 234 bp, Homo sapiens
  misc_feature 2: d=a or g or t
cdaccaagagcctaccaatttggaatttattccagaaaatgtttaaaatgaatatcactatttgtcaatatttatttttatttaaatatttacactaaatcacacctaaattccatgagggtagtttatttcagatgggatagcctcagggaaaatttgaagttctattaaattttgtaaaaaaaaagaaaaacatattttgtgtttaggaacatatatgttacagccatcaca

SEQ ID NO: 25086 - DNA, 208 bp, Homo sapiens
  misc_feature 31: s=g or c
  misc_feature 32: m=a or c
ttggaatatgggccttactatgaaataggasmaattatttctttcccagttactaataagggagacttcattggttaagggaattttgtgggtagaattgctaagactagaaatctcattgttggttcaaagagagaaataagttaaccacgtgttctcacctgaatataggatgctttgctttacaagcttaaataatacccggata

SEQ ID NO: 25087 - DNA, 354 bp, Homo sapiens
ctagtctaataaagttagttagtggctttatcactttaaatctttagtgtccaaaagtggtgtttaaagtaatagcacatcagaaaaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaaccttg

SEQ ID NO: 25088 - DNA, 352 bp, Homo sapiens
  misc_feature 153: r=a or g
ttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcraaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatga

SEQ ID NO: 25089 - DNA, 185 bp, Homo sapiens
tgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacag

SEQ ID NO: 25090 - DNA, 256 bp, Homo sapiens
tgtaggttgcctgttcactctgatggtagtttcttttgctgtgcagatgctctttagtttaattagatcccatttgtcaactgtggcttttgttgccattgctttggtgttttagacatgaagtccttgcccatgcctatgtcctgaatggtattgcctaggttttcttctagggtttttatggttttaggtctaacatttaagtctttagtccatcttaaattaattttttataaggtgtaaggaagggatccat

SEQ ID NO: 25091 - DNA, 216 bp, Homo sapiens
  misc_feature 2: n=a, g, c or t
  misc_feature 7: s=g or c
  misc_feature 9: s=g or c
  misc_feature 15: s=g or c
  misc_feature 50: s=g or c
  misc_feature 51: s=g or c
  misc_feature 66: s=g or c
  misc_feature 160: k=g or t
gnttcasastgctasacgcactgctgccaccgccaccgaattggaaacgsscgcccaggctccgtsatcgccttcgcccgccgaccgggccagccggctctccgacctccctacagaatcgcaccccagtccctccctggcagctcggcttccctcagckccaactcttctcttccgctcctgcctcctgtcggatttttaatttctgcgcacccc

SEQ ID NO: 25092 - DNA, 300 bp, Homo sapiens
acttacagccttgggagagattctgagtcagaggcatccagctaaattgacccacagacacggtaatgtacaaatatttcttcttttaagttgctaagttttggtggtagtttgtaatgcagcaaattgaagagggatgctgccaaaacaaatacagaaaaaaacagggaagtggcttggaaacaggcagtgggcgaaggctaggattccgaagagtgtattggagcaagactaaattgcactgcacagattgtgagtggaaactggaagggagcgtgcttattatgtagtgacacaaaa

SEQ ID NO: 25093 - DNA, 292 bp, Homo sapiens
  misc_feature 138: s=g or c
aactcgcggggattgttttccacactgtggaagctttgttcttttcgttttttgcagtaaatcttgctgctgctcactttttgggtccacattgctttcatgagctgtaccactcaccgtgaagatctgcagcttcasttcagagcctagcgagaccacgagctcactgaaaacaaacaactccagacgcgctgtcttaagagctataacactcaccgcgaaggtgtgcagtttcactcctgagctagtgagactacgaagccactggaacgaagaaactccaaccacgcct

SEQ ID NO: 25094 - DNA, 116 bp, Homo sapiens
tcattttaacaaaatactgatccaattttcattattcttgagaaatgtcagctttgccttaatgagtatttgctttaaatttctaagaatttatatcataactagagacccaaatc

SEQ ID NO: 25095 - DNA, 131 bp, Homo sapiens
cttgtggatttgtagctgtttaaaatttcaggtgaatttcagtagctattgaattaatttagacttcactttgtttttaagaaaagtacaattttttctttttggtaaaacaaaagtaatcagggaaagga

SEQ ID NO: 25096 - DNA, 96 bp, Homo sapiens
  misc_feature 38: s=g or c
  misc_feature 39: s=g or c
cctccctccccagccttccccgcgagcggacgcggcasscctctgtctcgctttttcttatttttcccccctttcccctttctttttttttttttt

SEQ ID NO: 25097 - DNA, 316 bp, Homo sapiens
tagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaag

SEQ ID NO: 25098 - DNA, 107 bp, Homo sapiens
  misc_feature 2: n=a, g, c or t
tngcagtttcctcagtgatggaatatcatgaatgtgagtcattatgtagctgtcgtacattgagcaaataaacttacagatcttaaaaaaaaaaaaaaaaaaaaaaa

SEQ ID NO: 25099 - DNA, 152 bp, Homo sapiens
  misc_feature 22: n=a, g, c or t
  misc_feature 23: w=a or t
  misc_feature 100: n=a, g, c or t
  misc_feature 133: n=a, g, c or t
  misc_feature 134: h=a or c or t
ttcttccttgacttgtctcacnwctcgtgtttccttgggtttgcctccattactaagtcttcatccagcccctatgtcattggttctcaaagtgtggtcnccagaccagcagcagcagcatcacctgggaacnhgctggaaatgcctgaaca

SEQ ID NO: 25100 - DNA, 371 bp, Homo sapiens
  misc_feature 2: r=a or g
  misc_feature 7: n=a, g, c or t
  misc_feature 8: n=a, g, c or t
  misc_feature 234: s=g or c
  misc_feature 370: n=a, g, c or t
  misc_feature 371: v=a or c or g
trcaagnngatgaagaaggattctcaaggggcattttcagatttctgccatggaggggatgctcttcgcgaagggagagtcaggatggactttcctcatttggacagccgctctggtttaaagatctgtacaaacctctcagtgccacaagaataaataatcatgcatggaagctgcacaagaagtcatctaatgaggacaagatcctcaacagggaccctggggacagcgaascccaacggaggaggaggagagtgaagccctgccataggaggagaacacagcccacctcaggcctcctgcaaaaatacatagaataaacaacaacagttactaaatgaatgaaaattgtgattccgatgaagccagnv

SEQ ID NO: 25101 - DNA, 119 bp, Homo sapiens
tacttttattaaaatggtgtgcattcatgcaaaaggccaactggcttttgtgaacaatagatcttttctcccctttattttgttctcttgacacttttgtgaaaattacctagcctgat

SEQ ID NO: 25102 - DNA, 108 bp, Homo sapiens
  misc_feature 7: n=a, g, c or t
  misc_feature 38: m=a or c
cagccantcagaggaaactgttttctctttatttgctmatatgttaatatggtttttaaattggtaacttttatatagtatggtaacagtatgttaatacacacaaca

SEQ ID NO: 25103 - DNA, 260 bp, Homo sapiens
ccccacattacagtttataaactgaagttgggcaaaaataggaaatgtgcctaaggtcatctatctagagacggagcttatatccaaactcttgtcagcctgactccaaaaatggctctttttccactttcttgcatcctgattacaagtatctcttcaagcatcaggtcttctttttcatcatttcagtgttattctcagcccccaaaggcatccttaggttactaaaaacttaaagagaatttatttccccaccccac

SEQ ID NO: 25104 - DNA, 106 bp, Homo sapiens
cgaaaagtaaataacattggactaagtttccaacctttcccttggtctaggacattaaccttctctctttagctgcctaacccttatgtatccttctgggcccata

SEQ ID NO: 25105 - DNA, 156 bp, Homo sapiens
caaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactct

SEQ ID NO: 25106 - DNA, 107 bp, Homo sapiens
  misc_feature 20: y=c or t
ttgtttgggtcagagaatgycaaaaggttggaccttgaaacctcggctagcagagaaggaggtggggataggagaaggctgatgaatgtggagaaaagaagatggag

SEQ ID NO: 25107 - DNA, 209 bp, Homo sapiens
  misc_feature 61: n=a, g, c or t
  misc_feature 113: n=a, g, c or t
ttataggcatctttctccatttttttgccagcttaccacaagtgactctatagaaaacatncagctacttgggaggctgaggcaggagaattgcttgaacccggaaggcggangttgcggtgagccgagatcatgccactgcactctagccccggcgacaatgtgagactccatctcaaaaaaaaaaagaaaaaagaaaacatccccgt

SEQ ID NO: 25108 - DNA, 183 bp, Homo sapiens
tttcatgtgattctggaaagatttgcaacacctgtttccaaagaaagcaagaaatatattgcatatttttctccccaaaatgtattttgtccaaactgaattggacacagagaacattccttaagtttggaataaataaactttctgaaaactgctcaggtaacaaagtagtaaagagcccga

SEQ ID NO: 25109 - DNA, 299 bp, Homo sapiens
tctgtgcaaaactaccacattctgtccccaaaatgtggaatgcatccaaataggagtcttctgcctcttaacttaaaagaacataggaattttgtttttggtttctttatcatgctacagagagtgaatacactggaattcagacaccgactctgagctgctaggaacctcatttgtccatgtgcaaacgctgtattccaaggcctgtgaatggcagcctgaggaagttttgcatgcaggctgtgttttcgagcaggactaacaactgggaaataagcaaaaaactgcatcgatcccca

SEQ ID NO: 25110 - DNA, 202 bp, Homo sapiens
ccctaacagatatgcatattccttccagatgcctcagtgctacaccacagtgggcctggtcccaggacaggaatgcggttcaaacccagtggcttgaaacttcctgagaaactgtagcatatccagccccctaaaatgtacaatgtaacttgttcagtccaacaaaaacaggttccttatgtttctgccttctccagccaaa

SEQ ID NO: 25111 - DNA, 232 bp, Homo sapiens
ttatcatgtgttggggatggagtgtgtttagtgatgtttgtatatgttcattaagtacctactgagtataaagtgttgctgcactgggattatggtaaataggcaagggagaataagaaagtcttcaggaaaactactctgaactacctttaccctaaaattattgctgcctacagctatagaaactcaaaaggaagacactaataaatcccagcagatcgaggggccactg

SEQ ID NO: 25112 - DNA, 136 bp, Homo sapiens
agtaggacgtaaagtaggaattgtaaaacggaaatactctttatataagaaagctctactgtatgtcagaaagcaatgtaatagatagaccaagcacagtggctcacacctataatgccagcactttgggaggcca

SEQ ID NO: 25113 - DNA, 73 bp, Homo sapiens
tttggggtttgcatttagatcatttagctgatggctaaatagcaaaatttatatttagaagcaaaaaaaaaaa

SEQ ID NO: 25114 - DNA, 312 bp, Homo sapiens
  misc_feature 27: n=a, g, c or t
  misc_feature 28: v=a or c or g
  misc_feature 40: k=g or t
  misc_feature 41: k=g or t
  misc_feature 96: r=a or g
  misc_feature 116: r=a or g
cgttattctttaatactcacagagccnvcttatattgctkkctctctctatgatcaacataataatggaaactgagaatcataacaagtgtaagaractcacccaggaggtaagarataatataaatatgattaggattttttctgattctgtagtctatgttaaaccatattgatctgtgctgagctcaaaaagtaaaggcactttgaaggcatgaattggaacactgcaaagatgagaaagccatcttcacttcctgcctttgatattagttttaatacatgagtaagtgtgaataaatcataataaata

SEQ ID NO: 25115 - DNA, 164 bp, Homo sapiens
aagaataatcctggaattaaaaatttaccaaacttatgaagcatccattatttttatttatttatttttttgagacagattctgttctgtcacgcaggctggagtgcagtggcatgatctgagctcactgcatcctccttcctgggttcaggccattcccccac

SEQ ID NO: 25116 - DNA, 97 bp, Homo sapiens
agaacatcccgttctttcgtagctctggtgctgcggctccgctctcgtcgcaacgagatctttcgagatcttctccgcccccgctaccggcgccctg

SEQ ID NO: 25117 - DNA, 269 bp, Homo sapiens
tatctttattgtcagtaagtgtggaaaaaaacccgacttgtatgtgtattcacagtttgataggcatattttgaagtcattgttttccatcaatattaagtatcatccatttctatgttctctagcaaaagaaaattcttagtgtgatacagctttactctttgtttgactttgtacaaggtccacaaaaggaggaggctcaaaagattggacactttaccctgacattcagcacattcattttatctttcgataaagataaccagaac

SEQ ID NO: 25118 - DNA, 115 bp, Homo sapiens
caattaatgcactttagatgttaaaagtatttgggctaaggttattgttgcctgatatgaaataatatattcttattctcattgtttgaaacctgtctttgaaattagcaccggg

SEQ ID NO: 25119 - DNA, 274 bp, Homo sapiens
ttggatatgtatgtatctttgaaaatatatgtaattatgtgcctatgtgttttaatatatataaatggtatacttttatggtaagccaacttctgtaatgaattgctcccatatttcagtgatttaacaccacagatttatttttaacttattctacatggcacgggtgtttctggttggacagctctcctccactgtccactccagctcccaggcttcttttattttcagatggtgatagcctcatcccagcatcataaagtttccggtcatc

SEQ ID NO: 25120 - DNA, 143 bp, Homo sapiens
cggtgatcataaaggagcaatttaatcttatctttcattttctaggaagaaagtataatccagaaaaaaacactcagttacctaagcctaaagtgcagggttgataaagaatggtagaagatgaggttgtataacagggatga

SEQ ID NO: 25121 - DNA, 433 bp, Homo sapiens
  misc_feature 3: n=a, g, c or t
  misc_feature 4: s=g or c
  misc_feature 103: v=a or c or g
  misc_feature 374: b=c or g or t
  misc_feature 375: v=a or c or g
  misc_feature 396: n=a, g, c or t
  misc_feature 397: n=a, g, c or t
atnsacagaagatctagttgagtcctactttgaaaggagtattgcttctgactgtggaattggattctagctgtgtgtgtgttatatcctgttactgttgagvcacagaggcgggagtcggcgggggaagatatgtgctgagattagtcagcctgccctccctctcccccaagaaactcaggccccatctggggagagtgagaacttaagaaacttgagacagggaaggagagccgggagcagccaaaacctgctaagtctcagaagactggtttctgcacaagggaatggaagaagtgactggagcaaatccagtttgctgatgacatgcaggagttcaccaaattccccaccaaaactggccgaagatcttbvtctcgctcgatctcacagtcnncactgacagctacagttcagctgcatcctacacaga

SEQ ID NO: 25122 - DNA, 160 bp, Homo sapiens
gtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacgt

SEQ ID NO: 25123 - DNA, 172 bp, Homo sapiens
caaagatcagatggttgtagatgtgtggtattatttctgagggctctgttctgttccattggtctctctctctgttttggtaccagtaccatgctgttttggttactgtagccttgtagtatagttggaagtcaggtagtgtgatgcctccagctttgttcttttggcttga

SEQ ID NO: 25124 - DNA, 267 bp, Homo sapiens
atatgtactttctcagctcctcccccatccaatgcatgttcggtgttaagataagaagagcaagcctgttttttaactgtaatggacattactatatccctaactattcaaggagagtcttagctcatggacatgtacaacggagtcacttacattaagccttaagccacatctgtaaattctcactgttaacagaatccctgtggtcctggggctgtgtgttgcaccttgttctagctatttctcaaagatttaattcagcacgag

SEQ ID NO: 25125 - DNA, 313 bp, Homo sapiens
  misc_feature 115: k=g or t
  misc_feature 258: k=g or t
cacgaatggactaacatagaaaattggtactgggagtggggtattactattgctataaagatacctgcagatgtggaagtgactttggatctgggtaatgagcagagagaggttkgaagagtttggagagctcagaagaaaacaggaagatgagggaaagtttggaacatattagacactagttaaatgattgtgaccaaagtgctaatagaaatataaatagtgaaggctaggcttacaaggtctcagatggaaatkgggaagttattgggaattagagtaaaggtcacctgtgctatgctctagcaaagaa

SEQ ID NO: 25126 - DNA, 180 bp, Homo sapiens
  misc_feature 7: m=a or c
cagagamtgaaggcatttcaaccataccaagccctgtgacctcaccagttttgtcccgccgacactatggagaatctataacaaatataggcaaagcaagcatattaggggctgctagcattggaaagggacttggaggaatgttgttctcaagatttggacgttcatctacaacacagt

SEQ ID NO: 25127 - DNA, 187 bp, Homo sapiens
aaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaagtggacgg

SEQ ID NO: 25128 - DNA, 139 bp, Homo sapiens
aatgataaaaacacaactggactaattctgaaagtaaacttggatttgaatagagtttctataaactgagtactaaacattttgaaagattaacaataatgagaaaactaaccatgaatttttcttgttatcagggtat

SEQ ID NO: 25129 - DNA, 196 bp, Homo sapiens
  misc_feature 90: s=g or c
  misc_feature 91: s=g or c
  misc_feature 92: y=c or t
  misc_feature 93: s=g or c
  misc_feature 106: r=a or g
  misc_feature 116: w=a or t
  misc_feature 120: k=g or t
ttgatttaatttcacatgttttggacatttaaagacaaagttacagaactttatagctcaagtccctttactctttagagattgttggassysgtgatggatccargtccccaggwtatkataatgtattttaaagcctagagaaatgttactaatgattaaaacatttattgagcattttctgtttgcccggccg

SEQ ID NO: 25130 - DNA, 142 bp, Homo sapiens
catatatttaagagttttctttctgtcatttatgaagaataaggaatgtattatggaaaagagggtgatcttaagcaaccctgtaaaaaatggtaaagatttttactcagtgtgtgctgaaacactaaattaaactagcagc

SEQ ID NO: 25131 - DNA, 238 bp, Homo sapiens
  misc_feature 194: s=g or c
  misc_feature 195: k=g or t
  misc_feature 226: n=a, g, c or t
tttcagagaagagccttctaacttgtttacacaaaaacgagtatgatttaacattcatactagttgaaatttttaatagaatcaaggcacaaaagtcttaaaaccatgtggaaaaattaggtaattatttcagattgatgtctctcaatcccatgtattgcgcttatgttacaagttgttgtcacagttgagasktaatttctcctaatttcttctgcccgaaggntaagtggtgcgt

SEQ ID NO: 25132 - DNA, 114 bp, Homo sapiens
  misc_feature 10: h=a or c or t
tatactgtahgaagcgatatatttattatatactgctaaatgtatattcaaaaggctaccattttatgtttttcatatcagtcgtttcctctattagctttttttttccttttt

SEQ ID NO: 25133 - DNA, 397 bp, Homo sapiens
  misc_feature 23: w=a or t
  misc_feature 28: w=a or t
  misc_feature 29: r=a or g
  misc_feature 31: h=a or c or t
  misc_feature 283: b=c or g or t
  misc_feature 284: n=a, g, c or t
  misc_feature 285: n=a, g, c or t
  misc_feature 392: n=a, g, c or t
  misc_feature 393: r=a or g
  misc_feature 394: m=a or c
tattcatctgactttagacattwaggtwrahtctaatttttccttaaaactgttcgtgagaatctttttgtatgtgtctccttgtggaactctgcaagtacttagtcaaggagtccagtaagtgaaagggctgggttaaaatttttatagatgtggccacattaccatccagagtggttttactagtttctgctcctgatagtgtatatacgtgcctaatttactttgttctcactaatacttaactattttcagtacttgaaaatgtgatattattaaaatbnngatttgtgccaatctggctgaatttccccaattgctatttagtactaggttgagcagcttctcatatgattattcactgaccttttacattttatcctctgggaatnrmgcg

SEQ ID NO: 25134 - DNA, 411 bp, Homo sapiens
  misc_feature 8: m=a or c
  misc_feature 249: n=a, g, c or t
  misc_feature 280: n=a, g, c or t
  misc_feature 291: r=a or g
  misc_feature 342: k=g or t
  misc_feature 353: n=a, g, c or t
  misc_feature 357: v=a or c or g
  misc_feature 381: r=a or g
aaagaaamaaaataaacaaattgttctttatgaaaatttaaaaaatttgatgcatcaaaagacagtatcaacagttaaaaggtaacccagagtatgggagaagatatttgcaaaccttatatctgataatggatcaatatcaaaatatataattaagaactcaacaatagaaaagcaacatgattttaaaatgggcaaaggacttaagtagacatttttccaaagaagatacgccaataagcacatganaagatgcttagcatcactaatcatgacgganatgcaaatcaraactacagtgagataccacttcacacaaattaggatgactgctatttaaakagaccccaganaatvagtgttggggaggatgtggggaarttggaagccttgtgcactgcgtggacgtgt

SEQ ID NO: 25135 - DNA, 436 bp, Homo sapiens
  misc_feature 13: n=a, g, c or t
  misc_feature 339: r=a or g
  misc_feature 372: r=a or g
  misc_feature 402: r=a or g
  misc_feature 412: r=a or g
cagactgattttnacttaaggtctccagaccgtttaagtggctcatagtccatcagtaggcttcagagaaattcagaatctactgaaatgctttgcaattttcataggcttttggacatgtgcttttttctggagagaatattcatagcttttgttattattcaaatggattcctgacacctgaagacttagaacctatatagtaaacaacatttggaagtcttacatgggaaagcttagagatctgaactctagacctcacctcccaacaatcctcaaattcctccagaaagctagaacacagttgaacccctttgacttgatttcattatctacgaragtatttgtaaggggatattatacagaaacgcrcctctgctttcaagaagtgttatgcaaatraatgctaccrtacaatagttcctttgtattttta

SEQ ID NO: 25136 - DNA, 186 bp, Homo sapiens
tcagtctaaatgttttttgtttgtttgtttgtttatgagatggagtctcactctgtcacccaggctggagtacagtagcatgatctcggctcactgcaacctccacctcccaggttcaagcaattcttatgcctcagcctcctgagtagctgggactacaggcgtgtgccaccatacccggctcgc

SEQ ID NO: 25137 - DNA, 316 bp, Homo sapiens
  misc_feature 263: r=a or g
  misc_feature 267: r=a or g
acaggcttggaagaattaaaatgagagctaatcaagtccagtgatatcagcatttgatttaaacctggactgtcttcagtttagcactggttagaagcaagaatccagagtcagataaactagatttaagtactgcttccatcactcactagccttgtgaccttggacaagttatctcccatttctgtgcttcaatttgcttatctgtaaaacaggtaaggaataattacagtacataaaattgagtttttgtgagggttgaragarataattatgtaaaacgcttaacacaatccttagcatataggggcgtcag

SEQ ID NO: 25138 - DNA, 283 bp, Homo sapiens
ttgtatttttagtagagacggggtttcaccatgctagccagggtagtctcgaactcctgacctcatgatctgcctgccttggcctcccaaagtgctgggattacaagcatgagccaccacgcctggctgacgcacaaaggttcttagttttgatgaagtccattttttccttttgttgcttgtgtctccacttatttttttaaattatgagcatatattaataaaaatttaagataaacagttgaggcactgagaagctgactggcagttttgtgtgggtaat

SEQ ID NO: 25139 - DNA, 324 bp, Homo sapiens
  misc_feature 127: k=g or t
  misc_feature 134: k=g or t
  misc_feature 224: k=g or t
  misc_feature 297: k=g or t
  misc_feature 301: k=g or t
  misc_feature 319: k=g or t
taattcccgtgtcagtcttgctagaggtttttcaattttgtttttcttttcaaagaaccagcagtttgtttcactgattttcttttactcttttgtttttctgttttcaaattcattgatgtttgtkctttatkattttcttctgtctgcttgattctcagtttatactgctcttctttccctaggctcttgacatagaattttagatcatttatttgaatttkttattttttaatgtatatatgtagtgttataaatttccctctcagcactgcttcagctgtgtcccacaaattktgakatgttgtattttcatttkcatcc

SEQ ID NO: 25140 - DNA, 174 bp, Homo sapiens
aaatggtttatacccaaaggacaggcaataacaaatactggtgagaatgagaagaggaaatcctcatatactgttggtaggaacataaattagtcccccactatggagaacagcttagatgttccttagaaaactaaaaagagagctaccataaaatctattaatcccacaagg

SEQ ID NO: 25141 - DNA, 190 bp, Homo sapiens
  misc_feature 17: r=a or g
  misc_feature 180: r=a or g
tcatattttagattgarataaacagatttacttgtttttccttgcaaagtaaaaaagttttaagggagagtctgcaactgtgttttgaccctgagcatgtggcttgatagccattaagattaggagtgttgagagcagctattgtcctgatgactcagcaggaacccctgtgttagattrtaccgttttc

SEQ ID NO: 25142 - DNA, 311 bp, Homo sapiens
tcatcgagttatttaagatagtgtctgccatttatgatttaaatgttttattttgcctctaaagatatttctgtatattcacataaagtgtttatcagtccacctgtttttattttctctatatgtggatttatttctaaatttttcaactgagataaaattcacataacataaaattcaacattttaaccattttaaagtctacaattcagtggtttttagtatattcacagtgttttacatgttgattttgacttggacttttatttttgaaaggaaggaagaatattaagccacaatccagagaccct

SEQ ID NO: 25143 - DNA, 468 bp, Homo sapiens
  misc_feature 253: m=a or c
  misc_feature 260: n=a, g, c or t
  misc_feature 261: b=c or g or t
  misc_feature 361: k=g or t
  misc_feature 381: k=g or t
tctgaaggtttatgtctatgtaccatgttggactttaaagagtcatgaagtgtgctagtaaaaactctaaaagtgagattcaggagcccttggtctcatcctgcctttacctctgagtaaccatattacctaggctcatgccccatacctgggcctcaatttctgtatccttaaaaatagggtaaacagaccagatattctctgatacccgttcagctttgaatttcttatcttttctccaagtagatagtamaatatgnbgttgatgttgatatgatgacctctttcatcttctgcttcctatgttattatcttcatagtagatcttgtatcagtattgaatctccccaatcctcttccktctattttacttcgcctgtkttactttaatgatactaccactactgctgctgctactactactactactgtctaccatttattgagacctactgtttcagaacagga

SEQ ID NO: 25144 - DNA, 470 bp, Homo sapiens
  misc_feature 413: s=g or c
cagaaacctggtaaaacattattttgttttacacattgagggtgtgtctatgagagtgtttccagaagagattagtgtataaatctgagtgtactaggtggagactatctgccctcaatgttggcgggcaccatccaatcagccagtggccaggagagaacaaatacttaagacaaaatgggctgggatcggtggctcatgcctgtaatcctagcactttggaaggtcgaggtgggtggatgacctgaggtcaggagttcgagaccagcctgaccaacatggcaaaaccctgtctctgctaaaaatacaaaaattagccaggcgtggtggtgcacacctgtagtcccagctacttgggaggctgagacaggagaattgcttgaacccaagaggcagaggtcgcagcagtgtgsccgagatcacgccactgtattcagcctgggtgatagctgagactctgtctcaaaaaa

SEQ ID NO: 25145 - DNA, 206 bp, Homo sapiens
cattttactgtgatgagaacaatgaggctcagccaggcaggcctccgacaaggagaaggtgcctcatttgctgggatcatgggcggttctgggtgtaggtgagacctttagggagcattttatactgttgcgggcctggcctctgcaggaggtcactgttgggaagtgacttcagcgagcccagccggccctgagccaggggccca

SEQ ID NO: 25146 - DNA, 380 bp, Homo sapiens
tgtcttttttaacatgatatgaattacttctatgaaaggtgaaggaatttttagtatactcatcctcagtagaatcttcaaggacagccacgtttacactgggattcttccataaagtgattcccagtttgataggagcatacagatgttctttcatttttgtccattcgtttttctccagccaaagtagattatcttctgccctctagtttgattggcaggtaacatatgaatgctttttcttcatgaggtgagagtttttccttgtatatggagaactgagataattgctcataaccctgaattatgggggcccaatgtcacagtgagaactaggaggctggacgtgacttggtgacagatgatacgtaagaagcagc

SEQ ID NO: 25147 - DNA, 166 bp, Homo sapiens
acagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaaac

SEQ ID NO: 25148 - DNA, 423 bp, Homo sapiens
catgatgaagaagatgaacaggatatattgctggcgcaagatttggaagatatgtgggagcagaaatttctacagttcaaacttggagctcgcataacaggttgtgatccttttaggccagccagaaggaagggaaaaggggtatttggattcccaaataaaagacagttgcttggcccctgctttgtgttttaagtaacaaataatttcatattcttttctttgttgctcacatctaccataatacgacttaaaaagtctgtcttattttcgggtgagaggtaagggtattggaatagccttttctctcagttaaactttgtgaatgttatctgtgtttaactccaagtttgagactgagagtggggcaaatgaagcctttttccactaattcctgtgttttatgtgaatccctcttaaagc

SEQ ID NO: 25149 - DNA, 267 bp, Homo sapiens
tggataatgagtctcaaaccactagctcttctaataatgaaaaaccaggagaacaggaaaaagaagaagatattgctgtgttggcagaggagaaaattgaacttttgtgccaggaccaggttttggatccaaatatggaccttcgaacagtgaaacacttcatatggaagagcggtggagacctcaccctccattaccgtcagaagtccacgtgaaggctgggctaatgctcctggatattcatttacgaccttcctctatggccca

SEQ ID NO: 25150 - DNA, 125 bp, Homo sapiens
taggtggaatgttaatttataactattgctacatttacaaagtaggctgtgttccagtcatggaggtcgtaaagtgtaactggacaaagtaagctctgttttccattatgtagaaaatctcctag

SEQ ID NO: 25151 - DNA, 283 bp, Homo sapiens
ctatgtgaatacttaaatatgtctttaatggattgtggggattttagtcttttcagattttttctttcctttatatgagaattatttagaggaagttaaacttatatgaagaggaagaatacttgtaactatatatttctcagaagaaattattgggcacttttggctgttttgatggtattgggaaaagggaagattattctattaagttttcatataaaatctctttatttttgtttttcaaagtttctcagctgtccttaatacttatgatccaatagcg

SEQ ID NO: 25152 - DNA, 441 bp, Homo sapiens
  misc_feature 430: r=a or g
attttcctgttctggacatttcatataaatggagtcatgcagtatgtaaatccttcatgactagcttaacttaccataatgttttgaaggttcgtccctgtaacgtgtatcattattactttctttttatgactgaataatattctaaagtgtggtaaggatatgacatcttgcttacccattcatcagctgacagatgtttaggttgtttccattttttggctactgtgaataatgcttctgtgaagatttatgtgcctgttttagtgtggaaatgttttcatttctgtcaggtagatctgaggagcagaactggagattatacgctaacattatgtttaaccatttcaggaactgccagattgattttcacagcaactggaccattttacattcccactagcagggtaaaagagtttttatttctcarcatccttccca

SEQ ID NO: 25153 - DNA, 104 bp, Homo sapiens
ttaagtctttttcaccacaaatttaagcagtggatgatgggtggcaggaaaggtattgctttatttctttcaagttcatgttgattataaactgtagcccctaa

SEQ ID NO: 25154 - DNA, 227 bp, Homo sapiens
tttggactttctagatgcttcttaacccatgatttaggtgagtaaacttggaaaaatgtttttgcaaaacttgatgatcaagctgaacgtagaacgatattcctaatgggtgtgtttgccttttttcccccttttgagacagggtctcactctgtcacccaggctggagtgagtggcatgatcatgcctcgctgcgtacttgacctcatgggctcaagcgaccctct

SEQ ID NO: 25155 - DNA, 430 bp, Homo sapiens
  misc_feature 293: d=a or g or t
tatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtaaacattgtgcagtadaaggtccttcacatgctatggttcatacactggcatttcatgaagcagtagggagcagagttaaccccaccaagagcactgcagtgcggccttccttcccagcccccgttccagcacctctttccatttcccgactt

SEQ ID NO: 25156 - DNA, 169 bp, Homo sapiens
ctgggattacaggcatgaaccaccttgaccagctgatagtggcttttaaataatgttgggagctacttaaatggctggtgtgcttcctctgtcacataataaaaacaaataactgttgagccactgcacctggcctaaagacttttttcaaagcataagcacagtaccc

SEQ ID NO: 25157 - DNA, 165 bp, Homo sapiens
ctttcttttgaaccagcagacagatcaaataatgataattctctggatatggggctttgaaggagctccaaccctgttctttcctctccaattgctgctaggctgctggttttcaccttgattgtgaggagaggtggtgtgaatagagcaagttaaaatgccact

SEQ ID NO: 25158 - DNA, 426 bp, Homo sapiens
  misc_feature 350: s=g or c
  misc_feature 390: r=a or g
aacttcctcatcatggaaacttccactgggttcggcgctgaggatgccaaactccatttcacaaggaacatgtcaacagctgggcttggggtttgaggaacagagccgctgcgattggaacagagcccggccaccctgttccaccactgtccactccgtagctcccagcctgccgccgcgcggtgcccgaacacgagagggcacctcctcccagatccggggcgcagaagccccgcggaggcaggtagaagattctgaggccctgggcgggaactagtaagccacaatctggaagagtcttttaccaccatgtggaggagaactagagcactcatgttgaagctattacsggagaaaagtaatcaacttcttttgtgttaagtcactgaraggcaagtgttgatttgttgcagtaattggtgctcc

SEQ ID NO: 25159 - DNA, 106 bp, Homo sapiens
catgtattggctcaaggtataaaatagtgtaaataatgctagttgacattacatttcaaccaaatgaaagtattaacttcataaaacaaatatattgagagcgtgt

SEQ ID NO: 25160 - DNA, 329 bp, Homo sapiens
cgttggccgggctggtctcaaactcctgaactcaagtaatttgcctgcttcggcctcccagagtcctgggattacagtcgtgagccatcgcgcctggccgtgatagaaactttcagctgaggagtctatatgccatactactctatgtggcatctttaggtctctgtgaaatcatgttgatgtaattgattaacaaaaataatttagaaaatacgtcaggcacagttgatggcttctcaatatctgctttgcatttttaaacaaatcaagaatgtaattttaacttttgcttatggtcattcttatgactacacggaaagggatggact

SEQ ID NO: 25161 - DNA, 417 bp, Homo sapiens
  misc_feature 372: s=g or c
agtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagcsatccctgcattcctagtatgaaacccacttgatcacatcatggca

SEQ ID NO: 25162 - DNA, 209 bp, Homo sapiens
caaatattaatttggaaagtaggttgttgaaagaggaagaactgcgaaaagaggaagtccaaactctgcaagctgaactcgcttgtagacaaacagaagttaaagcattgagtacccaggtagaagaattaaaagatgagttagtaactcagagacgtaaacatgcctctagtatcaaggatctcaccaaacaacttcagcaagcacga

SEQ ID NO: 25163 - DNA, 198 bp, Homo sapiens
  misc_feature 20: k=g or t
  misc_feature 161: r=a or g
attagccgggcatggtggtkggcgcctgtaatcccagctactctggaggctgaggcaggagaatcacttgaacccgggaggcggaggttgcagtgagccgagattgcaccactgcactccaccctgggcaacaagagcaaaactccatcacaataaattarataaataaataaataaataaacctcataaccagctta

SEQ ID NO: 25164 - DNA, 161 bp, Homo sapiens
  misc_feature 137: r=a or g
tgaccttcggcagtggctgggggactgctttcagtgcctgctgttcgtgactcagaaacagaagaaaaacactgagaaaaagcattaaaaataagccaaaataagactattggtaaacacctaaatttttgtaagaraatttaaaaattaaagcagcaaag

SEQ ID NO: 25165 - DNA, 169 bp, Homo sapiens
  misc_feature 102: r=a or g
ctgggattacaggcatgaaccaccttgaccagctgatagtggcttttaaataatgttgggagctacttaaatggctggtgtgcttcctctgtcacataataraaacaaataactgttgagccactgcacctggcctaaagacttttttcaaagcataagcacagtaccc

SEQ ID NO: 25166 - DNA, 137 bp, Homo sapiens
gacacacacaaacacatttcaaacatgttttatgtttaagctcaatattcaaacacagaaatataacatctattcttaatatgttttatgtaagtacagcagcagcattattaaatactgtatttctatggtgaaat

SEQ ID NO: 25167 - DNA, 238 bp, Homo sapiens
ccaggcaggtctcaaactcctggcctcaagtggtcctcctgcctcagcctcaggcatgatccactgttcctggccttggctatgtttttgagagacagggtctcattctgttgctcaggttgggatgcagtggtgagatcatagctcactgcactcttgacctcttgggctaaagtggttctcccacctcagccccctgagtaactgggactacagggatgtgccagcatgcccagcc

SEQ ID NO: 25168 - DNA, 236 bp, Homo sapiens
taacattacagtttgggctcttggtgcccaatgattgatttatctatagtatagatttatttctcacagtacctcttggaatgctcatttttaaccccaatagttaaatttgccttggtaagctacaaaaacaggcaccaaagcagcaatgttttttagttttctgttgaccataaatctcgtttctttacaagtagtaattctaaacagagtataccttaaccagccagatgcac

SEQ ID NO: 25169 - DNA, 399 bp, Homo sapiens
ttgaactgatttcataagcaatgtaattgtttttgaataggaggagcactgtatgacgaaaaaggcaatttaaggagatatgtttgccatgctgctctggatgctgtggcagtggagaagtaactcggtggggaggtcagctaggaagggtgtgtttaattgatctgtgtagtggctaattcgtaggacccgcttgggctcagctgctgacctggaaataagaaagtgggagggaattatgacagggcttggtggttgaccagacaaagacaaaggaatggtgtaaacactgaagagtggtctgatggttctgtttgctgaagaaaaaaaaagtggttaaaggactagtgaaatcaaagaaggtgatttcaacctttccttttactgagtttgaattgt

SEQ ID NO: 25170 - DNA, 234 bp, Homo sapiens
cataatagctggtgttaatcttgtttatcaaaagttaccttgtctgtttattacctttatgatgtaaaaggtgaacgttaacacaggagggagctggtgagtgatttgtgttaactttcatgcttgagattgaaataacaacattcctttctttcttccttggggagctgtaagcagtgttgcctagaaaaaggctgctttgggaggaaaatggaaggattaggggaggaggcg

SEQ ID NO: 25171 - DNA, 77 bp, Homo sapiens
  misc_feature 35: y=c or t
  misc_feature 37: w=a or t
  misc_feature 49: k=g or t
  misc_feature 72: s=g or c
tagggatgtttaccctatagtgtttaccctgtagygwtacatcatctgktctatgacagtcttaattttaascccac

SEQ ID NO: 25172 - DNA, 132 bp, Homo sapiens
actccctacccctggggcccagctcagaaccgggcagacacccccttcaaatgtcttcgcacgtaggttttgcacagtgtttatctgctggtgtctcagggatttgacagtttccttaatattcccacacat

SEQ ID NO: 25173 - DNA, 129 bp, Homo sapiens
gcagtagtgaatgtggaaccaagcctgtctgtatatctggtagctcttttcttgctttgttttttcttaccagtattctgcctaacgtttgcttctgtgatggttatattgcctagcaagcacacccgt

SEQ ID NO: 25174 - DNA, 235 bp, Homo sapiens
ccttaactcagttaaatttcaccacagccctgtgaagtctgcactactgtcccctggatttttatctgttttgtatattcccatatcccagtgcttggcacataaaagacactcaatatttgttggacaaatgaatacataaatgaataaatctcatatggctagacattttggctttccagataacatcatgggagttggtcctgtggtagatcctgtgtcaacagcaaggaca

SEQ ID NO: 25175 - DNA, 183 bp, Homo sapiens
cacaaaagtaataactgcagtaaaaatgtttttgtcagtgtcttagtccatttatgttgctatataggaatatctgaggctgggtaatttataaagaaaatgttctgcaggctgtacaagaagcatgacgccagcttctgtttctggtgagggcctcatagagcctcatgacagaaggccaaa

SEQ ID NO: 25176 - DNA, 100 bp, Homo sapiens
tcatttcattagattgcatatttttagttttctataaaatttgcagccattttccaaataaagtaagttataatatttttcaagtttaaaatggaccagt

SEQ ID NO: 25177 - DNA, 178 bp, Homo sapiens
  misc_feature 7: r=a or g
ttacaarctcagcagctgccactgaagaaacaggtgataatgtagcacaaaaagataccgtaaaacacaggacttctaaatacttagtaaggaagacctttttgaaagccttatcctgaaaacatctcttcttgctaaaagctagggaatcttagaatcttattaaaaacgacaccat

SEQ ID NO: 25178 - DNA, 177 bp, Homo sapiens
ggtagttcttaactatattgttgtacttttaaaccacattaaagactattataaatgcctatcactgctactgttagaggttgctctatactatctctgatctttcatttgttgcagtttgcaacacagtagttgagaataagtggtttagtatgatttgcttaatagtacccttac

SEQ ID NO: 25179 - DNA, 141 bp, Homo sapiens
agtaaggccaaaaattactgattgtgaacaaatgaagcaccaagtgaataaatgtacaaatagacaagtagccagtaggaaaaaaaacaataattgttacctaaagaatgaaaaccaagtggaaaaggccgccagggtcca

SEQ ID NO: 25180 - DNA, 223 bp, Homo sapiens
aaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtgtaacgtggtgtgacatggttccctttaggctgaagacagtgggagcct

SEQ ID NO: 25181 - DNA, 150 bp, Homo sapiens
acaacaggtggtatacaatgaaaatgtcaatgttctcctagttttgtttctttgatcaccatttcatccctccttccggtgcctgcagctgccctcagccttcaaagtgattctcactggagagagaggatgcttctctccctggaccag

SEQ ID NO: 25182 - DNA, 146 bp, Homo sapiens
ttttttcactttttgaaaaagatgttttgggtagtagtttaatatctcagggtgctctttctaacatagtaaaaaatgaagaaaaatgtttagattaaaactctgtagtctgatgacttagaaccatccttgacccttaggcccgg

SEQ ID NO: 25183 - DNA, 139 bp, Homo sapiens
  misc_feature 115: m=a or c
aagatagcttatcatatagacttgtttgccaccattcctgggcctatttcttctcctccttgaaatttttcaatctagaaattctgtgccaatggcacaagtccccatgaatgamagctaacataccccaacacctacc

SEQ ID NO: 25184 - DNA, 135 bp, Homo sapiens
  misc_feature 117: r=a or g
ccagtctccctgcttccattcttgctctactcatcctccttcccagttctccatgcagcatcatgagttatttttgtaaaatgtgtatcagaacacagtatggtgctaccttgctgraaaacccagacccctcga

SEQ ID NO: 25185 - DNA, 320 bp, Homo sapiens
ccccagaagcaatctgatagtcttaaaactttgtcctttctaagtcctttgtattcattttagagctcttcaggaaactagagaattttggactttggttgacaaaagcggtctgaactgtgttcgtagctgggaacatgaaacacaaaattctgggtttaatcttctgaagaaatctataagtagttactggcataaatggtattactatactaacaaatttaaaagcctataatgtattaaaactcttttttactcgattacttttatttttttgagacacagtctcgctctgttgccccggctggagtgcagtggca

SEQ ID NO: 25186 - DNA, 164 bp, Homo sapiens
  misc_feature 118: y=c or t
caatctttttggatatagactcagaagtgggattactgactggatcataagataatgctgattttagttttctgaggagccatactgtttttcataaagctgtattaattttcatttyccaccaacagttcacaagggttctcttttctctacaaccttgcccg

SEQ ID NO: 25187 - DNA, 147 bp, Homo sapiens
  misc_feature 1: r=a or g
raatagtttacttctcattaataattctagcttttaaaagtatattttgtcttaagttaaaaataaatagttcaggtaagtttagggcttccttaattacagtaaagaattaactttttcttctttttttcttaatcagtgcaagat

SEQ ID NO: 25188 - DNA, 150 bp, Homo sapiens
  misc_feature 100: y=c or t
caaattattgactaacctagtattgtttacagagaacaaattattgactaacctagtattgtttacagagaacaaattattgactaatgcagcattgatygatgcttttataagacagctattcctagagtcattttccttacccctact

SEQ ID NO: 25189 - DNA, 106 bp, Homo sapiens
  misc_feature 2: s=g or c
  misc_feature 4: y=c or t
asaytgccgagggtctggcggccatgaccccaggcattctgggacactggactgtgtgcccagaacatttttctgccatgagaggtaaagccagggattgttcaga

SEQ ID NO: 25190 - DNA, 76 bp, Homo sapiens
attgtccgcggctgaggtgaggcctttgctcaggctgtggggccgccgtagctgcggggcttggggggtcaggaga

SEQ ID NO: 25191 - DNA, 154 bp, Homo sapiens
  misc_feature 31: k=g or t
ggtaatttgttctactggccaaagcctcttkcagcagtgccttgccatcatgcttaaaagtttggctagtatatcttgctggatggagccttgaactccggcaaggattgaaccatctgacttccaaatttgccttcccctctggactcccact

SEQ ID NO: 25192 - DNA, 118 bp, Homo sapiens
aaagagagactatatttatattcttagatagtttgttccacaatttttcatttcatgcttccatatatattaccctgaactttctatcaccacagataaagattttgttttgccccgc

SEQ ID NO: 25193 - DNA, 142 bp, Homo sapiens
aatatctagttttttaaatttttaattaatttatttataatttactgtgtgttcccagctaactctattttttttttcacttgctcataaacttctggaaaaaaataagcatgaatcaaatggtaatgcccaatatccaccg

SEQ ID NO: 25194 - DNA, 344 bp, Homo sapiens
  misc_feature 7: n=a, g, c or t
agtcaantccatttgcagcgtcgctgaaagtgagaaccgaatttgattggggaagtgaaatgattatctctgcccctcttgaggagcaaaggaaaaaatgagctcaaaaaagcttttctgttgacatcattgtccagtcctcctgtgactgtaattattaatataagcaggcatagagtagttcttggggtgacgcttctactgagagtattgtgggtagggatgtattttattgcactcaagtgcctataaccataacaatatgttataagcatataatgtttactttctgaacattggtgaagcaaccatcctgctatagaacaaccaaaactgtaaaagat

SEQ ID NO: 25195 - DNA, 364 bp, Homo sapiens
  misc_feature 56: v=a or c or g
tgttaacatgagtttatcacattctgttttatatcagggttagcaccatgcttccvttcaattgccaggaaggttttgagtggcaagcacagtaccagcgttaatggcctctgatctccctgtaacaattgacttcattcaaagaactgtgtttacccgatgtgggtaggacaccagctcttgtgttccatctggctgcctggttctttgcaatcttcctagcgcattatttgcattttctggcatgacggaagaagtgaaggctttgaagaaaaacaaacctgtatttgattcctagctctaagtctatatctgggtgactgtgtgtacaccaaccttagattcaacatctgtcgaagataac

SEQ ID NO: 25196 - DNA, 182 bp, Homo sapiens
  misc_feature 57: w=a or t
  misc_feature 166: r=a or g
accgcttaattactagtttgtggtctatatcatagaagttatttcccaccccatttwatcttgacaaccgtgtttgcatttctgtaaaacttctacaacttctggtgtcagaactgtccagaagatggtactgttaactgttatttcctttgatgttttgattttraagtttagctctcaca

SEQ ID NO: 25197 - DNA, 169 bp, Homo sapiens
  misc_feature 72: n=a, g, c or t
aactacaggaagatgctgtcaaccaggaaggcatccttaggaagaggctccaagaaaccagccaacggctgnaggatgtggaggagcaggtagggtggctcatggctacattagattcaggggacatctcctcagatgccctgcaaaccatgaaataaaaatggaggat

SEQ ID NO: 25198 - DNA, 154 bp, Homo sapiens
tcattgtatctgtatcaatcccaaaaggtagaaaaccaagtatagaaggttatattctttaaggaaaaaacggaatacaaaatctattttacatatacatccttttctatatacttaagttgtacaaccaattctaatgacaagatgcatttta

SEQ ID NO: 25199 - DNA, 279 bp, Homo sapiens
tgagtctggagtttaccagagaagtcatcagtgtatagatggtatttaaagccatgaaactgatggagattggcaagagaggacaggcaatggtaagcctgagttgtggtgcattttaacattaagagtttgacgagatgagaaggaaccagcagaggcgaaggaaaaggattggctattcaattaggagaaaaaacaagagtgtattcttttggggaaagccaagtacagaaagtatttcaaggaaggagtgatcacttttgtcagttgctactgatt

SEQ ID NO: 25200 - DNA, 268 bp, Homo sapiens
  misc_feature 50: r=a or g
atgggcatctaccagatgtacttgtgcttcctgctggccgtgctgctgcrgctctacgtggccacggaggccatcctcattgcactggttggggccacgccatcctaccactgggacctggcagagctcctgccaaatcagagccacggtaaccagtcagctggtgaagaccaggcctttggggactggctcctgacagccaacggcagtgagatccataagcacgtgcatttcagcagcagcttcacctctatcgcctcggagtgaa

SEQ ID NO: 25201 - DNA, 202 bp, Homo sapiens
caaaaacaagcaaaacaggaggaggcttagtctactataaaaagaaatgggtcagttaagaggtgagatttgcattcttacctcaagaacttcaatatctgaattgacgaataagaatttgtgtggattggacagaggaaatccttgctgcaattttgctaaaatatagaacaagacgtaaaacaattgggcacaagcacga

SEQ ID NO: 25202 - DNA, 300 bp, Homo sapiens
cataattgtgagaattatccaaatgtgacatagaggctcgaaatgagcacatggtgttggaaaaatggcacccatagacttggtagatgcaggattgccacaaacctacaactggtaaaaaacaatatctacaaaatacaacaaagcaaagtgcaataaaatgagatacacttgtacaagaccaacaagtgaaaccacgaagaagggtacacaaccaacacatagccttcctttgtccaagcgaaagacacacattctaagaagacagcacatcagcctggacaacatggtgagaaccct

SEQ ID NO: 25203 - DNA, 272 bp, Homo sapiens
  misc_feature 124: m=a or c
tcatttactctttctcatgcattctacttttcagtcgataaggaaaatgttttccaggccaaacaaactagactgagatcatatgcttgtcaggagacacaaaccttccctcaaggcagctggmacttgaatgggtaaaagttattgttgttgatattccttagcttaataaggtccccaaagtggcattgactttgagttctactgacttttcatgtgactttaggccttaattttcccacctcaaaaatgggatgaatgaagccccaatt

SEQ ID NO: 25204 - DNA, 217 bp, Homo sapiens
aagctaatttttgtatttttagtggagacagggttttgccatgttggccaggctggtttcgaactccttacctaagatgatccaccccctcggcctcccaaggtgcttggattgcgggcgtgagccaccgcgcccagcctcaatttacatttttgtttatagctcttgcttgtaattcatttcaaagacattcagatttgattctctatgccacaaa

SEQ ID NO: 25205 - DNA, 172 bp, Homo sapiens
tctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccatttt

SEQ ID NO: 25206 - DNA, 166 bp, Homo sapiens
cagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggaac

SEQ ID NO: 25207 - DNA, 87 bp, Homo sapiens
ttacttttcagtctgtatgtgtctatatgtttcttgtaagcataatatttttggatcattttttagttcgttccatcaatctacctt

SEQ ID NO: 25208 - DNA, 230 bp, Homo sapiens
  misc_feature 2: b=c or g or t
  misc_feature 23: k=g or t
  misc_feature 140: n=a, g, c or t
  misc_feature 141: s=g or c
abagaaagaagataccgagaaakaaaggtatacgaagcaaggcctggggaaaagttttccaaatgttgccaagtaaaggatgttttaagcattattgttggaagcatttttagaaaatgtcctaagccaggatttcagtnstggaaaaggcctccagcactgtgtatagtcagtttctttctcctcatagtcaagtgcgtttttctgattccaaaggtagtatgtgattg

SEQ ID NO: 25209 - DNA, 301 bp, Homo sapiens
  misc_feature 7: v=a or c or g
  misc_feature 8: m=a or c
  misc_feature 208: s=g or c
gaacatvmcatgctggactcccttgttcattcccggcagagaagcgctcccctcaccccccacagagccctgctatgccgggcactcagaccagccaggggtggggggagcctgtgagtaaagtcgagaattggaggtgtggtgccaccctgaccacagcacctttcttctccctgaggccacctcctcaaatactcttcttggccasagatgagggcccagctgtggttggcagatcttttgggagataactggatgtgtggggttgggagagttgccatgggtcccagtctcagggcgg

SEQ ID NO: 25210 - DNA, 262 bp, Homo sapiens
gtctgtcaaattaaattggaaaaagtaaccaaacagtgagatacaactccacatgaaacttgaaattgtaatttccgtttatttaatgatatttttatttatttgtgccttttatgttgaaccccaatgcattgaaaaaattcagtatgaaacagtacatattttatttatattacaggtgggagaaaagtccaattggtcatggaatttgatagacttttccccagccaactgctacagtgtattataatcccgactgcct

SEQ ID NO: 25211 - DNA, 294 bp, Homo sapiens
  misc_feature 162: k=g or t
  misc_feature 163: s=g or c
  misc_feature 164: m=a or c
tatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtksmtcatgcctgtaatcccagcactttgggaggctgaggccggtggatcacctgaggtcaggagtttgagaccagcctgaccaacatggtgaaaccctgtctttactaaaaatacaaaaatttaccaggctgc

SEQ ID NO: 25212 - DNA, 323 bp, Homo sapiens
aattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcggctgttgtccagctctaatgatgtcctagagcagaagtgtttcttctgatgtctcattttaacaagaggatgatgtctgtgtatgtctctgtgttttagagaggctggcaaatgctgctaagaggatctgc

SEQ ID NO: 25213 - DNA, 109 bp, Homo sapiens
cttcatttaaattagtttagactattgtaggaatggaaggaaatgattatatttactagaattagtgagatcagaaagcatatcagaatgttgatgatatcaaggagac

SEQ ID NO: 25214 - DNA, 96 bp, Homo sapiens
atgggtttgttgtagacagcttttattaaattaagctgttccttgtatgccaactttgctgagagttgtttttttttttttttttttttttttttt

SEQ ID NO: 25215 - DNA, 261 bp, Homo sapiens
  misc_feature 217: b=c or g or t
  misc_feature 218: v=a or c or g
aaacagcctgttgacggcttaaaataaacctgccttttccatttagcattttatcaaatgaatataatttcatttgctgatgaatttagttcagcttcaagagaatttttcttttcttcatggggaggctgaagaatcagaactgtcataccaaagaatgaaaagcaagcctagggagaacaagacagtctgatgtttacatggggttaacttattbvatcagtgaaatcagaaaaggatcattctgcattcgtggactgt

SEQ ID NO: 25216 - DNA, 301 bp, Homo sapiens
  misc_feature 300: m=a or c
  misc_feature 301: h=a or c or t
tttaaaataccatgaaactgaaaatgtcaggaattgattatccagcagaagaagtcaaggttatgagagaggaaactaagttgatataaaattagtaatgaaaatatgggcttttactacttgattatattcattttatccatctgtacaaaggcatggaagatgaaagatcgtagtgagccgagggtggtaatctttactctggagcatgggtcagggagtggggagggaaataagggacagtgctaaaatcatggtctgccacctaatttcgaagttttgggaaaaccccacctaccmh

SEQ ID NO: 25217 - DNA, 169 bp, Homo sapiens
taaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaaga

SEQ ID NO: 25218 - DNA, 121 bp, Homo sapiens
  misc_feature 19: s=g or c
tctcagacgcgccgcgcasaggtcggagcagcctccccgggaggatgtccagcggcagcgctcctcgctccagcccttggggatcttccgctgaggcattgaaggcaggaagaaggggcaa

SEQ ID NO: 25219 - DNA, 59 bp, Homo sapiens
  misc_feature 7: n=a, g, c or t
  misc_feature 8: n=a, g, c or t
  misc_feature 33: n=a, g, c or t
caacttnnccttaacaacagccaacagcccctnccaagagtaggctttttttttttttt

SEQ ID NO: 25220 - DNA, 181 bp, Homo sapiens
caaagatcaaaaccaacacacattaaattaacccctttaccttgaactaagataaatagcctctggaaaactgggctccgaagtccatgccaaagaatttgaactttatcctataagagatgagaagcattaaagggtttaagaaaagctagtagtttagttgagtaagaaattggtgggc

SEQ ID NO: 25221 - DNA, 107 bp, Homo sapiens
taattttttgacatattggtatttctttaaagggaaatgaggaatgcacatcagtgattgattgtcaaacctcaccccctgatttcctacctaatctaccccccctg

SEQ ID NO: 25222 - DNA, 316 bp, Homo sapiens
  misc_feature 46: w=a or t
  misc_feature 260: n=a, g, c or t
  misc_feature 261: n=a, g, c or t
  misc_feature 302: w=a or t
  misc_feature 304: k=g or t
  misc_feature 307: n=a, g, c or t
taaggggcatgttctgattcagtaggaagccagctttggtttatgwaagtcaaaggcaactccaggagagtggaagtttagttctcatgataactctcactgctgggaaccctactgggaggccaaagagatgccccttttttgttaagttttggatatgttaggtttgagaaatgtcaagtagccagttagatacatgagtcaggaattcaatgtgtcagggtgtgtggagatgggggttaaagctagatatttgaganngatcagtttataaatggtatgaaaagccatgcgacaataawakgancctacgccc

SEQ ID NO: 25223 - DNA, 359 bp, Homo sapiens
  misc_feature 9: w=a or t
  misc_feature 10: w=a or t
  misc_feature 11: w=a or t
aacttgctwwwctgtgtctgtgttagtagcactggtttgcatatagaagggaatttaattttatcagatgcatttacattcattttctctctgtattggtaccactgatagcagaaattggatttctttagagcgagcatatgttttcttttaaaaacaagcattaaaaatcttgaaatagtaagataaaaagaaaactggccattttcctactattctactatttatatataaccctgttaacattatggtgtatgtttttttaaatatttaatatattgatatgagaggccgaggttggtggatcacctgaggtcagtagttcaagaccagtctggccaatgtggtaaaaccctgtc

SEQ ID NO: 25224 - DNA, 284 bp, Homo sapiens
  misc_feature 7: n=a, g, c or t
  misc_feature 8: n=a, g, c or t
ttttttnnctatgaaaatggctgcagacactgggggagggagagggtggccctgatcccgatgactctgaaacatgcttggccttccccagagattcctgctcccagcccaggcccagacggcaacagaagctcatggaatggcagactctggacatgctcctagagatgggaggtcaagatgatcaacgttcagggtcccttcatctcagagggtctcgagtcacctcatttaaaggtgggaactggggatcctggaacctcccctgcaccccagatgcttct

SEQ ID NO: 25225 - DNA, 169 bp, Homo sapiens
  misc_feature 7: r=a or g
tctgaaracatgtagagaagatgagttgaggacagcttttctaaggcaatgtgatgtctttgcttcttatttctctttctctgcgttgttagttttgaagagtggaggagctaggggctccagaaagaatcttacacatgtgttgaagacattgatgtcatagggggcg

SEQ ID NO: 25226 - DNA, 136 bp, Homo sapiens
tttgttttgttttgtcttgttttgttttgagatggagtcttgctctgtcacccaggctggagtgcagtggcgctatttcggctcagcgcaacctccacctccctggttcaagcaattcccctgcctcagccctccc

SEQ ID NO: 25227 - DNA, 172 bp, Homo sapiens
tagtttaattaaaactctctcccctctttataagagaatagcccttttgtttatcgggaatcactttttttttaattgtagtaaaatacacataatgtaaaacttacgactttaaaatgtacaattctgtggcatttagtacatttacagtgttgcgaaactatgaagacac

SEQ ID NO: 25228 - DNA, 407 bp, Homo sapiens
  misc_feature 116: m=a or c
gccttcttacaatccattgttcacgttacttaagattcaatggctgccacacatactcaagatcaaggccattctctctgagtgcaatgttcccttcggagaggcagctccttcamattcttaacacctggccccaactgggacttcactttggtgagtagatacctgggtttttatttcgagacattagatagaattaattccctggtttctttcagtctgttacacagatcagtggtccttacttctgagggtcttgaggaacagaattcctgtaaccatctttggcagcctaatttagtccttttctgctaacaagctgtaataactttttgtttcaagtaaatataaaacatattttgcaaagtactcacatctattaatctttaactctatgccatcctaca

SEQ ID NO: 25229 - DNA, 271 bp, Homo sapiens
  misc_feature 110: m=a or c
  misc_feature 117: m=a or c
ttttaaagatagaccaaacaaatgcaaattgtggactaacagttttaaccaatataatctttttaaaaagctaatttaaataacagcatatgtctgaaataaacatgtamtacttcmaaaattatattttagaaataagattttatccacttttaggaagagtctacagtccatgtaggccgcatgttgaaagaaaatcactgtcttgttgcactacacatgtgtaagcatgatataaaaaacagtggtatacaacagttatgtgatgcac

SEQ ID NO: 25230 - DNA, 126 bp, Homo sapiens
catattgcttagcttgttaataatgattctgcatgtgtgctgggtttgggtaattctttaaaggaagttttctagatttgcacttgatgtttgttttttaaaaactgattatttatggccgtgact

SEQ ID NO: 25231 - DNA, 228 bp, Homo sapiens
acatactccaggcgggccggggcgcgtcaatatggcggcgcagggctccccctcgagctctccgtcagacgactctaccacctcggggtctctgccagaactgccgccgacctccaccgcgacttcgaggtcgcccccagagtcgaaggggagctcccggagctcgctgcttcagtggacctgccccgaggactcattgcccctagccgtgttttatgggccgcccga

SEQ ID NO: 25232 - DNA, 261 bp, Homo sapiens
taagaatggttgagtgcaacatcatgtattaatatcaaatgaaagacaagggtgctgtatctttgattatttatcaaaaaagtataaatcttttaaggaaaatgttagaattttaaagtttttttttgattgttgaagcatttatcttgttgatttcttacaaaagaaaaaggacgatgtcagtcaagcagcactttttcagaatatacagaacataaataatatgatgtggttgagtgttaacataataaatcatataca

SEQ ID NO: 25233 - DNA, 261 bp, Homo sapiens
agaatggtttaagtagtctgttgctcataagcacgtgtctgcagtctgtcacttgcaaggccttggtgatcaccatgcagcacttgtgcgcacacacacccccacaagtcttttttcctaataatccattttccacattgccatgagggtaaagggttccaatcaaaaccaccattaaactgcatagtttctagtcttccctcagccctgatgctaattatgatagtttgcatagacataacttaaacttgtgattctccc

SEQ ID NO: 25234 - DNA, 145 bp, Homo sapiens
tttcatcattcttgtctcttcggaagctaacaccatgctataataggcactaaatagatgtctaaaaacaccttaagtatttgtctagaaatctggtgcattgttcagaaagaaccaaaattcaaaataatttcaaagggcctag

SEQ ID NO: 25235 - DNA, 203 bp, Homo sapiens
  misc_feature 8: b=c or g or t
  misc_feature 23: b=c or g or t
  misc_feature 87: s=g or c
  misc_feature 91: s=g or c
  misc_feature 126: w=a or t
  misc_feature 127: r=a or g
  misc_feature 152: r=a or g
  misc_feature 168: w=a or t
  misc_feature 200: w=a or t
tgcgtacbactgtggtttactgbacagatcatctcatcacccaggtaccaagcccagcatccgcagctattcttcctgatgctctcsttcscctcccccatgccatgaaacaggtgtccagtgtgwrttgttcttcctgatgtgtccatgtrttctcattgatctgcwtctgctaataagttagaataataataggcggwagc

SEQ ID NO: 25236 - DNA, 155 bp, Homo sapiens
  misc_feature 2: n=a, g, c or t
  misc_feature 3: w=a or t
  misc_feature 73: r=a or g
  misc_feature 84: n=a, g, c or t
  misc_feature 90: w=a or t
  misc_feature 141: w=a or t
cnwtcttgatgtgtcctttgtagcacaatagttttaatttttataaagtccaattttcttttatgtgcttatrctttgggtgtnataacwaagaatctattgataaatccaaggtcacgaagatttacccgtgtgttttcwtctaagaattttat

SEQ ID NO: 25237 - DNA, 196 bp, Homo sapiens
catattatttcttcagcactatgtaccaggcaccattttaagcatttaacatatattaattcattagtacagcagccctatgagaaaagtgctattattcctattatttcaaagatgaaaaaactaaggcacaaattcaattgctgagaatacacagccggtaagtggcagacagtatgacgttgaaaaccatgct

SEQ ID NO: 25238 - DNA, 185 bp, Homo sapiens
  misc_feature 97: y=c or t
  misc_feature 98: s=g or c
  misc_feature 100: n=a, g, c or t
  misc_feature 106: s=g or c
agttgtgggagtggaggaggaagaggcggtagggggtacgggggctggtcccagaagatggcggaggcgggggatttctggtaggtcctactttagysgnaagatstggtaccgttgaagcgtcagtctttgattcacagacagttgagcttttcagctgggaagcctttccatttttttttttt

SEQ ID NO: 25239 - DNA, 209 bp, Homo sapiens
  misc_feature 139: v=a or c or g
  misc_feature 140: k=g or t
  misc_feature 160: n=a, g, c or t
  misc_feature 173: k=g or t
cgagggagttttctagaactgaattgaatctttaaataaacttgaaagggcattaattcccactttggccaacccaaagtacaaatttttaagtgtttactgtaagtatcgttaggcagtagttactaactccaacacvkaatagcattggtagaaagcntataaatgcagtkatttagcctcgactaagatttttctgatacctagtt

SEQ ID NO: 25240 - DNA, 160 bp, Homo sapiens
  misc_feature 88: k=g or t
  misc_feature 158: n=a, g, c or t
aaaatgaccactgcccaggccagaatctcagaggaggccacaggtccccgcccagacaggctgttctcaacactctctactgcaaackacacacagttttacgtcgccagaaagaccccaaatttctattcaaaaagaccgtaccagtttcagttccngc

SEQ ID NO: 25241 - DNA, 56 bp, Homo sapiens
  misc_feature 32: r=a or g
gatatttcaatccttgtttttgtgtgccagtraataagatgtctctcatatttttc

SEQ ID NO: 25242 - DNA, 217 bp, Homo sapiens
  misc_feature 41: s=g or c
  misc_feature 51: v=a or c or g
  misc_feature 57: n=a, g, c or t
  misc_feature 102: r=a or g
  misc_feature 127: r=a or g
  misc_feature 185: v=a or c or g
  misc_feature 207: v=a or c or g
  misc_feature 217: s=g or c
agctcagtttctcactccgaagtggcagcagccagagaggsagtcggtgtvgacgcnaggagccgggcgcttagaacagaggcttgcacaggtggagatgtrgaagtctgtagtgggccatgatgtrtctgtttccgtggagacccagggtgatgattgggacacagatcctgactttgtgaatvacatctctgaaaaggagcaacvagggggagcs

SEQ ID NO: 25243 - DNA, 75 bp, Homo sapiens
  misc_feature 27: s=g or c
  misc_feature 57: y=c or t
  misc_feature 64: b=c or g or t
tttttaaaaaaattaatttcagttagsacatatacagatttcattttataagcaacyatcagtbgcaaaagttgt

SEQ ID NO: 25244 - DNA, 65 bp, Homo sapiens
  misc_feature 10: k=g or t
  misc_feature 22: s=g or c
cagagaagtkaaatgtcttgcstcaggtcattctgcgtatacataaacacatacttgacaaaaat

SEQ ID NO: 25245 - DNA, 58 bp, Homo sapiens
  misc_feature 4: k=g or t
  misc_feature 10: s=g or c
agcktccatsgctgggcggtcaacaagtgcgggcctggctcagcgcgggggggcgcgg

SEQ ID NO: 25246 - DNA, 85 bp, Homo sapiens
  misc_feature 52: w=a or t
acatttaaagtatcattctttgtggtaaggccctaaaccttaattaaagacwtttcatatacctacctgaaatctgagtgactgc

SEQ ID NO: 25247 - DNA, 84 bp, Homo sapiens
  misc_feature 19: w=a or t
  misc_feature 20: w=a or t
  misc_feature 34: r=a or g
cacagtaggtaaataagtwwgaaggtaccaagargggttttttgacttttgacaccttatactgaattttttacaaacagcaca

SEQ ID NO: 25248 - DNA, 207 bp, Homo sapiens
  misc_feature 114: n=a, g, c or t
  misc_feature 197: w=a or t
acctgaaaacgatggcatttgttcttattaatgtctttaaaatatgcaaggaccataagtttttcctcttgcagatgaggaaagtaaaaaataatacgaacatgtaattcagcntctcagattcaagccaatgttttttgcatcaacttttctatattgtatgtatgtatataaatacatagattaaggaaataggwaactgaaaca

SEQ ID NO: 25249 - DNA, 191 bp, Homo sapiens
gcaacctccgccttccaggttcaggcgattctcctgcctcagcctcccaagtagctgggattgcaggcatgcgccaccacacccagccaattttgtatttttagtagagatggggtttctccatgttggtcaagctggtctcgaactcccgacctcaggtgatcagcctgtctcggcctcccaaagtgctg

SEQ ID NO: 25250 - DNA, 258 bp, Homo sapiens
tatgttaattattatgcatcaattaaaatttttaaattaaacacatattgtacacttaacattagtgaatttgttggctgggcacagtgcctcatgcctgtaatcccaacactttgggaggctgagaccggtggatcacttgcagtcaggagttcgagaccagcctggccaacatggtgaaaacccatctctactaaaatacaaaaattggctgggtgtcatggcacgcacctgtaatcccagctgctagggaggcca

SEQ ID NO: 25251 - DNA, 161 bp, Homo sapiens
  misc_feature 101: k=g or t
  misc_feature 106: r=a or g
ctcgaattcatttgctttccttaacgagagaaggttccagatgagggctgaaccctcttcgccccgcccacggcccctgaacgctgggggaggagtgcatkgggargggcggccctcaaacgggtcattgccattaatagagacctcaaacaccgtcccaa

SEQ ID NO: 25252 - DNA, 151 bp, Homo sapiens
tgcttcggttatattattaaaaacagaaatttcagtggcttttaacttaggaataaacaagagtaaaggtgagaaacttgaaatgcaagtttatcaatctccctttgtcatatagaaaattgattagaattgttagcccagtaaagtgcat

SEQ ID NO: 25253 - DNA, 122 bp, Homo sapiens
agccaggagaactagatgctttctgtctacaatagcttatccttacagtaagctctgtaagagagctatcatctctaccattatataaatgaaaaaaacaggtcacagaaacagctcgccca

SEQ ID NO: 25254 - DNA, 149 bp, Homo sapiens
tttatgagcatatgtgtatgatgatatataccttctttaatattaataccattaatacatcacatcattctttatttagcaaacatttattgactgacttctctctgccagggagtatgctaaaacagatatttacagaaatggggcgg

SEQ ID NO: 25255 - DNA, 182 bp, Homo sapiens
tctaaaatattttattggttttcctttatatctcaacttttgatgggtgtccttgaagaactttcatgaaaaaaatgtaaatgtgaatgattcattcattttgaacatatgtaactattttaggagattttcaggagattttaccctacatggagtacactgttcttagcagggaatgtgct

SEQ ID NO: 25256 - DNA, 147 bp, Homo sapiens
  misc_feature 52: r=a or g
  misc_feature 61: k=g or t
  misc_feature 62: n=a, g, c or t
  misc_feature 63: n=a, g, c or t
tcagcctcccaagtagctgggattacaggcatgcgccaccacacccagctartttcgtatknntagtagagatgggatttcaccatgttggccaggctggtcttgaactcctgacctcaggtgatccacccgcctcagcccccgcca

SEQ ID NO: 25257 - DNA, 306 bp, Homo sapiens
  misc_feature 2: n=a, g, c or t
  misc_feature 203: m=a or c
  misc_feature 276: m=a or c
angtctgtcaaggctatacagaaactgtccaacacttggactttgcactgttgctgaatgtggttattagctccgagagttttttttttaatattttggggttttctttataaaggatagatcatctacaaatacttcttgcttttcaatttagatgatgtttcctttcctgcccaatttatctggttaaaacgtctgatacmctgttgaatagaagaggcaagggcacatgttcatgtcttgttcctgatattgggagaaagcatcccgtttttmaccactctggccaggacagcctatctgtgc

SEQ ID NO: 25258 - DNA, 91 bp, Homo sapiens
  misc_feature 80: r=a or g
cggcagcgatgctacaggcctaagttattgtttgcataaaaagaatcatgttccctgtgtacatttaagaaaaaaacaaraaaacggaaat

SEQ ID NO: 25259 - DNA, 71 bp, Homo sapiens
cattgaataccagggttcttccaggccagcctatgaggagttctacaactgccgcagcatcgacagcggat

SEQ ID NO: 25260 - DNA, 163 bp, Homo sapiens
  misc_feature 161: b=c or g or t
agtagtcggtcccgcccacccggtgcggtggcccctggggtttcagtccaaggggagggaccagcgctccaagaaggtgaggctgctgggatgggtgactccgccgtcactgcaaacacgggacgtcccgtctactcccttacgcctgcttggtctgaacbct

SEQ ID NO: 25261 - DNA, 192 bp, Homo sapiens
  misc_feature 97: s=g or c
  misc_feature 100: m=a or c
ataaaaattgtggataaatgactagcattttaaagtctcaactttttatgtaaaactctggatttccaacttctctttaaaattctcaaggcctggscamctttattttagaggaatgactcttttaaagtagggcatgagtacttcagttttccagagtcccactgtgccctatcacccattagtgcccat

SEQ ID NO: 25262 - DNA, 173 bp, Homo sapiens
caaagatcagatggttgtagatgtgtggtattatttctgagggctctgttctgttccattggtctctctctctgttttggtaccagtaccatgctgttttgggttactgtagccttgtagtatagttggaagtcaggtagtgtgatgcctccagctttgttcttttggcttga

SEQ ID NO: 25263 - DNA, 220 bp, Homo sapiens
  misc_feature 216: s=g or c
gactaggtcccagccggactgcagaggcctctctggttaccccttgcaccctggcgcccccggactcggggtgggtggcggcgaggagcgtgcgcccagaaaggcaagcagtcagcgctaggggccggcaggtggagagaaccctgcctcccgcctcccccgatcgccatgactccggcttcgcgaagagacctggttgccgccgggcgctcccasctgt

SEQ ID NO: 25264 - DNA, 187 bp, Homo sapiens
  misc_feature 163: n=a, g, c or t
aaggatgttttttcctcattacctcagtaacagtttccaggtcggaggaactggaacgcatgcaggtggaatacagtccctgacaatgcaataataatttcccaacttattccccttgccttgctcgtcctctactatgcactcagcagcagacgaatttttngaaaataactgaaaacgcacacca

SEQ ID NO: 25265 - DNA, 191 bp, Homo sapiens
aattaggcatgcctgtagtcctagctgttccagaggctgagggtgggaggatcttttgagcccaggtggtcagtgctgcagcgagctctggatccagccactgcactccagcctgggcaacagagtgagactctgtctcaaaaaaaaataataaaaaataaaaataaataataataataaggctgggctag

SEQ ID NO: 25266 - DNA, 265 bp, Homo sapiens
cagtttccctttaattaatgatttaaaccctagttttccaatagtttccctcttctttttccttttcactgctatccatattcttcctaaacctcatacatgtgcacgatatgtatgtgtgtgaacacacatgcacacagagaccaaagatactttatttatttctaaacatatacacatatttattttataaaatgatggcttttaatttataatacagatttataatgcaaacttacttccatgtgaccattgctcccatcac

SEQ ID NO: 25267 - DNA, 364 bp, Homo sapiens
  misc_feature 44: r=a or g
  misc_feature 46: w=a or t
  misc_feature 47: w=a or t
  misc_feature 81: k=g or t
  misc_feature 99: w=a or t
  misc_feature 223: w=a or t
  misc_feature 224: w=a or t
  misc_feature 225: w=a or t
  misc_feature 226: y=c or t
  misc_feature 268: w=a or t
  misc_feature 269: r=a or g
  misc_feature 293: k=g or t
  misc_feature 303: n=a, g, c or t
  misc_feature 304: n=a, g, c or t
  misc_feature 353: r=a or g
ataagattagtataaagagtatatagattgttaatccccaccarcwwgactttgaacttaagtcagacttaaagatttgakaaattatttgtgtcattwactagacgtgatttttagttctgtttgattatatttcctacacaaacttcttatttaacaggatagcctactaaattaaatgtttcttatttcacttaactcatttgattaaactgtattctawwwyatttggggtttttccccctattcagttttaatcttggaatawrcatttgtaaattgtgatgtcattkagactatatnnatatttgacttggcaacattaacatgtcctaagacttagtgcagagaarcttggcagtac

SEQ ID NO: 25268 - DNA, 312 bp, Homo sapiens
  misc_feature 96: k=g or t
aaacaaaagctattagaagtaaagcagaaacctatcactgcaaggagtgacttgtaaataactgatgatcaagggctgtcttctctcaagcatggktccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcagtgcctaaatcccaggcccccttctcagggggcgtggccacacca

SEQ ID NO: 25269 - DNA, 123 bp, Homo sapiens
agaagctgttgtctcctctctggggacagcagctcctgcctttggaggccaaagccccagatctctccagccccagagctgaaaacaccaagtgcctatttgagggtgtctgtctggagacag

SEQ ID NO: 25270 - DNA, 198 bp, Homo sapiens
  misc_feature 58: m=a or c
  misc_feature 88: m=a or c
  misc_feature 91: m=a or c
  misc_feature 94: m=a or c
  misc_feature 103: v=a or c or g
  misc_feature 104: y=c or t
  misc_feature 108: y=c or t
  misc_feature 109: r=a or g
  misc_feature 136: h=a or c or t
  misc_feature 176: v=a or c or g
acccaggatcaagtggtggaaggcttgcaaggtggcttcagccagattcatatgcggmtcctcagaaaacatctttgatcctgaatamggmtgmtattcgttvyggtyrgcctaccaccataactgttcaaacaahagaccagtatggggatgtggtacatgttcccaatatgaavgtggaagtgaaagctgtccccg

SEQ ID NO: 25271 - DNA, 270 bp, Homo sapiens
aagttgttgcatgtgtcaatggttgttcctttttatttctgagtaatgttccatgatatgaatgtaccacagtttgtttaaccattcacccactgaaggacgtttggattgtttctaagttttgactgtggcaagtaaagatgctatgaacattcatgtacacatgaatttgtaggcatatgtttttattttgctgggagaaaagcccaagaatgcagttgctgggttgtatggtattgtatgattgtttttcttttaagaaactgccgg

SEQ ID NO: 25272 - DNA, 186 bp, Homo sapiens
  misc_feature 104: k=g or t
taacatgccttcctcactaagtttagtcatttatagtttttatttaaagtgagagatgtgacacaagaccatatagaggccactgttcagttattaatttccakataatggcctaacttcaatattattgtgtctgctgaataggaaggtctaaggagaggagaaaaatgggagaggcagggggac

SEQ ID NO: 25273 - DNA, 280 bp, Homo sapiens
gatagttcgggagcagccagggcaggagaagcagcttcctcctgtcccacctgcacctggaatgagcaaaatgatttcaaggaactgaacacttggattactgggattcaggagaaagagtttgccatgtgttcaaaagcagcagagatgcgggtgggggctaagcctcattccaaagcagatccattttaaatcacacggaacgaacagcctgatctcacaatagactgttccttctaagtacaccgtgctgtgattttggaaaactcagggcccaagt

SEQ ID NO: 25274 - DNA, 331 bp, Homo sapiens
  misc_feature 2: n=a, g, c or t
  misc_feature 102: k=g or t
  misc_feature 104: k=g or t
  misc_feature 108: m=a or c
  misc_feature 137: n=a, g, c or t
  misc_feature 310: w=a or t
  misc_feature 311: n=a, g, c or t
  misc_feature 312: n=a, g, c or t
antcattcttttgcctggagttttgtgaggtacccgcttgctttatgggaaaaggctgctccggaactgccctactttagactttttcatggttatcaatckgkacamagaatcaccaaactgataaagcaggaacnagagggcaaatcacgctgccaagacaactgtgtaattcgctcgaaaaagaaacgaagacaatgtatataaaaatatgcaagaatcacaggaaacccacatatccaaccacctagatgaagttgttgctgctgttagcatcactcatagaaagaagttccaaaacaagctgctwnngacagcactattccagcca

SEQ ID NO: 25275 - DNA, 171 bp, Homo sapiens
  misc_feature 146: d=a or g or t
  misc_feature 147: m=a or c
  misc_feature 148: s=g or c
atagcagccggtgatggcggcagcggctgtggtggctgcggcgggtccgggcccatgaggcgacgaaggaggcgggacggcttttacccagccccggacttccgagacagggaagctgaggacatggcaggagtgtttgacatagdmstggaccagccagaggacgcggac

SEQ ID NO: 25276 - DNA, 204 bp, Homo sapiens
  misc_feature 131: s=g or c
  misc_feature 132: s=g or c
cctttttcgtccatgtcctagcagagactacagagcagtacagaggctctcgctgaaaccagtcccaggctccacagagtcagatcacggcttcacaccagtcgttctggtcacttaggcgttcgcgtgassctcaaccccttaccgccacctcatcgtcactctacaccattctgagcgcaaaaatgttttgattgagacagt

SEQ ID NO: 25277 - DNA, 119 bp, Homo sapiens
aatacataatttgtgaccatttaagatgctgatattttctggaaaaggatatagatagtagtagtgacccgcagagcctcacaataatgtctaaagatataaactgagtagatccctac

SEQ ID NO: 25278 - DNA, 131 bp, Homo sapiens
tattggtttcatatgtgctactactgtactaatatatcctgtgcattataaaatccatgtaaactatagacatcttacagagataagataatattaagaatgcttctcatatttttcacatacctgtcctg

SEQ ID NO: 25279 - DNA, 235 bp, Homo sapiens
taagaaattgctttataacaaaaaggaaaagcacaaggaaaggtttttcacaattcaaacttcagatgtagtaaaatctgattgtgtaaagttagaaattaaacaaaatcctctttggcatggcaaaaaaccataaaccacacgtaataaaccaggaggaaatagttgcaagatgtatttctgataaaatgctaatattgctaatatatagaaagttactacacgttgaggagag

SEQ ID NO: 25280 - DNA, 193 bp, Homo sapiens
  misc_feature 71: k=g or t
  misc_feature 83: w=a or t
gaatcttttagtgtcaagtcagagaaaatctggctcaaaaccggctaaacaaaaaaagaaatttagactckcatgtagcggawaaacctggagctgtcaaagctttggagcaaggcttgattacatggctcacctatgtcatcaaatgaaatacttttttccatttttcttcttggcttcctatgacatcaac

SEQ ID NO: 25281 - DNA, 209 bp, Homo sapiens
taatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccgt

SEQ ID NO: 25282 - DNA, 283 bp, Homo sapiens
  misc_feature 276: r=a or g
  misc_feature 279: r=a or g
aacaagagactatttctcatttgtgaaattagtgaagattaagaaagagataatgcttccctgtggatttctcagagcctttattttccctggaggtattttaattttctttgaatagttcatgtgtattgattgagttaattctcaagtacattatttcctttttgctgctattacatgaacagattctgggctcacactgagctgggttaaaacccaagctgtgtaattcactctgtgtgtgtgtgtgtgtgtgtgtgtgtgtgtgtgtgtgtrttrgcga

SEQ ID NO: 25283 - DNA, 294 bp, Homo sapiens
  misc_feature 277: h=a or c or t
  misc_feature 279: k=g or t
gtatttttagtagagacggggtttgtccatgttggtcaggctggtctcaaactcccgacctcaggtgatccgcccaccttggcctcccaaggtgctgggattacaggcatgagccactgcacctggccttgatctcattatttgttattggtctgttcaggttttgggtttcttcatgattcaatctttgtaggttgtatgtgtgttggaatttgtcctttctaggttttccaatttattgacatgtggttactcatagtagcctctaatgatccthgkgaatttctgcagttg

SEQ ID NO: 25284 - DNA, 240 bp, Homo sapiens
  misc_feature 93: w=a or t
  misc_feature 96: r=a or g
  misc_feature 115: d=a or g or t
  misc_feature 116: r=a or g
  misc_feature 125: n=a, g, c or t
  misc_feature 183: k=g or t
  misc_feature 205: r=a or g
  misc_feature 229: m=a or c
atattggcatttttcaacccagtgtcactagatgtcacacacatttgtggtgctttgatgtttgcaagtctaacctctgaacataaatttggwcarataattggaacaaagggadrcagatactngatatgaaagccataatgacggtgacttgtgtcgtgggggaaaacataaggtcatttkctccctctactcacaatactaraaaaaaaatggattcaagttaggmtttcagggccg

SEQ ID NO: 25285 - DNA, 119 bp, Homo sapiens
gccaaaccagtgagcaattattaggcgcttggcacgtgcgccagcgctgtgaatccagtgggcagatactgttagactggagccaaatgaaaacagaaccacatcttgaaagggctaag

SEQ ID NO: 25286 - DNA, 125 bp, Homo sapiens
  misc_feature 113: n=a, g, c or t
aatattgtttgtctaggaaatggaatatgaacatatgtacatatatatttattttttaattcaagaataacatgtaaaattagaaaaatactacctgccactaaaagtgtacntctaggagacgt

SEQ ID NO: 25287 - DNA, 148 bp, Homo sapiens
aggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgc

SEQ ID NO: 25288 - DNA, 258 bp, Homo sapiens
  misc_feature 71: d=a or g or t
  misc_feature 159: n=a, g, c or t
  misc_feature 218: k=g or t
  misc_feature 219: y=c or t
ttcagatgaatgacacttgagtattctatttaagtgttagagatggtttaaagttaagttttatacattadagcctttagcacatgcatttttgtattttataaagtatttaaaattttgctggtttttaacattttagtagatgatatgcctaatganatccatttgccacgtttctagtcatatgccgtgtatttcatgtttctgctgtatatatkyggaactgcaatcttaaaggatatagaatattgtgggctg

SEQ ID NO: 25289 - DNA, 261 bp, Homo sapiens
  misc_feature 3: h=a or c or t
  misc_feature 219: m=a or c
  misc_feature 255: r=a or g
cahtgtctcttccagacctggaattgaccctttctctaaggagctttggtttatttattaggcaaagatatttagacactacagtttgggtactaggggtacgcattactattaagtatgttaccatcactaatccttttcagttgtcagaactgggagtgaaaaaaaaacatacatatatatatatgtatatgcacatatatacacatgtataaagamatttagagctcatactgatactttgcatttaatttrgggccc

SEQ ID NO: 25290 - DNA, 139 bp, Homo sapiens
tatctgatgttttctgaatattaccttacaaatgctgctttatttataactaaagaatagggaccctgtcttttaaagctttatatttcctcaagtaaatgtttttcgtattaaatccattaataatatctagtggcgt

SEQ ID NO: 25291 - DNA, 167 bp, Homo sapiens
aaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtagct

SEQ ID NO: 25292 - DNA, 223 bp, Homo sapiens
tgtatgatacagtgtgtcctggctggatttttcctgttagcaggcagaaagaatccctcctggattccagaataataaatacagtcatgtgctgcttaatgacattttggtcaacaatgggccacatatatgatggtccaaagcactatactgtacatcatctcattggaaaaccttatgaaataggagggcaactatcatcataatcatcttccttcccccc

SEQ ID NO: 25293 - DNA, 197 bp, Homo sapiens
cacatagagttaaatatatattagtctaaagacaaactttaggtgtaagaaaattatggaataagtgtgtgtgtgtgagtatgagtttgtacctattttcagaagaaaagaacaatatgggaatgaaaatcattttaataaggtggctactataaaaccaaaaacctaaaaactgaaagcaaatgtaaaaaaaaaaa

SEQ ID NO: 25294 - DNA, 364 bp, Homo sapiens
  misc_feature 71: v=a or c or g
cttggatggccttgatacttgtggatgtttattggtgtctgtgcattgaagagttgtaatctaagtttttvgtcactccagctatgtgtgcattaggtggcatcccaagcccagtaacactatgacttttgcagactcatagaggtcttgtggtcttggataagatctggaagacttctctggattactaggcagagaattttggtctcttcccttactttctcccaaacaaacaagcagagtctccttctctgtctactgagctgcctagagcttgaagaggggtgacataagcatccctgtctctacccaacactgggacaatgctgggtcagacctgaatccagcacagtactgagtctca

SEQ ID NO: 25295 - DNA, 251 bp, Homo sapiens
taatgtagattcattggaatgatttcttctcttattcaggtttgccttctgatgtattattcttttaaaccttcattgcataaatactaaagtgaatcattttcttaaaatattttgataccacgtttgacagatctgttctttataactagctctttgttgttctttgataaagctcccaataggtagaaatgtattaactctgtatttctgttacattaatttttataaagaatttcataggtccctcc

SEQ ID NO: 25296 - DNA, 141 bp, Homo sapiens
  misc_feature 4: s=g or c
  misc_feature 93: r=a or g
  misc_feature 97: k=g or t
  misc_feature 99: r=a or g
caasagaagattgagtttttatctcaccatgccttgtgtgtagatcatttccttattggattctgtgtagtgtttgttgtttacttaatgacracakaractcagatagtagtcatagttaaatatttttagaggaccaca

SEQ ID NO: 25297 - DNA, 204 bp, Homo sapiens
tctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagttccc

SEQ ID NO: 25298 - DNA, 216 bp, Homo sapiens
  misc_feature 188: n=a, g, c or t
cgtatgataaaaaccgcatttcaggccaggcgtggtggctcatgcctgtcaccccagcaccttgggaggccgaggtgggcagatcatatgaggtcgggactttgagaccagcctggccaacatggtgaaaactcatctgtactaaaaaaacaaaaattatgtgggttggtggtgtgcgcctgtaatcncagctacttgggaggctgaggcaggaga

SEQ ID NO: 25299 - DNA, 207 bp, Homo sapiens
ataagagcttaaatcaaatattttatcagaaaaataaaatctgtaatgccttttagttcacatgatttagtaatctttgggaaataaaaactgtttttacaatgcaaggtgtgtaaaggaagtgaaatgtgtttttggtaaaagataagaagtcatgagaatgtggatttttttctgcctagattaaagggctaaaggattgttata

SEQ ID NO: 25300 - DNA, 141 bp, Homo sapiens
ttctgtctttagaagaatcgtaaatttcagtgtcctttatttgactcagtgggatatagctgttataagtaatagggcacagatgtgcagtagagtcttgtttaatggcatttcactgttcattccctttaccaccgtact

SEQ ID NO: 25301 - DNA, 351 bp, Homo sapiens
  misc_feature 148: s=g or c
  misc_feature 345: n=a, g, c or t
  misc_feature 346: s=g or c
cgtttcgcttcgaagattgtttcagaagcgttgggcggcgggcgtccctgagagaaattagtaagcctcctcatgcggctctggtttcggtctttactcctgcgccttactcgaaaggggcagggtttctgctgtcggtcggagggasgatgacgcgccgggtcggggttttagagacggagagtgagtgcggattccgccagatgggggtcgggaactccgggccaggccctgacgtggattgtgtttgccgcctcctttaaccttgccctcatagactgggggggttagtgctccccgcttccagcgattctcgccgcctcctgctcctgtgtagtaactggnscttct

SEQ ID NO: 25302 - DNA, 224 bp, Homo sapiens
cttgatgggttgtatgtgtctaggatttcatccatttcttctaggttttccaagttattggcatatagttgttcataatagccttgagtttaacatagtttaacaataatgtcttaaaatcctttggatgtctgtggtatcagttgtaatgttttctttttcatatatgattttatttatttgagtcttctctcttttttcctagttattttggctaaagggtc

SEQ ID NO: 25303 - DNA, 68 bp, Homo sapiens
gcagtaatatttaggctgactggcccatttagtaaatgaaggggttccagtttaattttttttttttt

SEQ ID NO: 25304 - DNA, 199 bp, Homo sapiens
ttaactttcctgctctctgagacaattatttgacaacttctttagtttccctctcacattcaattacttttatcctctttccccattttaaactaaggacttagtttcatgcttacttaaaaaataaatacgatttaaaactcttatcttcccattactaaacccaccaacatacatttgtcctttccctcatactctc

SEQ ID NO: 25305 - DNA, 204 bp, Homo sapiens
ttgaggaagaaccaagcacattgaccagctaataggacttcactgaatgtccactttattttgaaagccagtttgggattgtgggggaggggatgcaaaataaatagaaaatatagtctcttcccataagtagcttatggtttagaagttcagttctctaatacaaaggataaccaaggacccatgcaatgcaaacagagacag

SEQ ID NO: 25306 - DNA, 297 bp, Homo sapiens
aagaaagcatgcagaaagagaacgtcaacagaaaaatcaaaagaaaaaaagagatgaagaagaagaagaagccagtggccttaaggaagaacttatacctgaaaaattagaaagggtagaaaatccattagaggaagccgttaagttccttatacctcttaagaaccttgttgctgataacattgacactcatctgttagcatttgaaatatattttagaaaaggaaagtttctgttaatgctgcagtctgtcaaacgagcttttgccattaacagtaataacccatggttacatgc

SEQ ID NO: 25307 - DNA, 394 bp, Homo sapiens
  misc_feature 2: w=a or t
  misc_feature 102: w=a or t
  misc_feature 360: w=a or t
twtagaataatatatattgctaattcacctttccaaaatgactcaactcatgaagcattgctttttaagcctgtaaccctagaagacattttctagtgttgwttagtaagatcagcatcagaaaagagtagatcatcatcattgatgactactatgggagtttacatgaactatttctttttaaaggactgtatttatggctacttactctcatttttctaattattatgaattttagatcttggcctaagtttaacacctttaaaattatgtagagaatactgataagtgtcagggttcatttatcatcatctcacttgggtttctgcgggtcacttacagttgacacaacggaacaawcggtcagtttactctatagatagcaaaagcctcg

SEQ ID NO: 25308 - DNA, 131 bp, Homo sapiens
  misc_feature 114: k=g or t
  misc_feature 115: r=a or g
  misc_feature 116: k=g or t
  misc_feature 117: r=a or g
tattcatttgctttttaaaaacattattgtgtttgcttattatatgccagagatttttatgcaaggtgctactcatataggcatagactctgtacttcatggagcagaattagkrkrctaaacataggttt

SEQ ID NO: 25309 - DNA, 190 bp, Homo sapiens
tgcaaaaaagcactgtgccttctgtcattgaatcctagaacactgagatgagaaaaacactgtagatgtataggttagatatatagggaatgttattattttttcctttttttggagagacggtctcgctccatcacccatgctggtgtgcagtgctgcgatcgtggctcgctgcatcctccgcccctcg

SEQ ID NO: 25310 - DNA, 290 bp, Homo sapiens
catagaactgtacaacacaatgagtaaattctgcagcatgcacattaaaaaaagaaagaaagaaaacaaataggatgtattatcccaaaatggggtggaaacagtgacaagtgaacctaaccatcttacaaatgtaatatataaacttactgaaggtgatgcagtcaaaggatctagcctatattttggaaaacagtattttgaaaggacaaaatctgcaaagaatgaggctaactctaaaaagaactatacatagacattgtattttagttgatttttttcaaaggagt

SEQ ID NO: 25311 - DNA, 213 bp, Homo sapiens
acaaagttaattatttgtagatgagagattagaagccccctgaccttattttattatacttatgtaagtatatcaaatttgcatgaattccagataatgtctcggggttttagatgtattacttagcttaattagcatcacagccagttggagtggattttatgtatattttaaagggattcagtaaacagattgagaaaagctagggagtcc

SEQ ID NO: 25312 - DNA, 406 bp, Homo sapiens
  misc_feature 242: d=a or g or t
  misc_feature 244: n=a, g, c or t
  misc_feature 315: h=a or c or t
  misc_feature 317: w=a or t
caggcatatttgaaaggaggcatataggtttcaagggcattcttgggagtttctgatagggaataggttcagaaagaaaagaagagggttctatctccagaggagttaggggccaggtattcagaagggccctctctttgccactgcaatcaatcagatgttcacaaattatacctttttaatgcatcactaggctcttagaaagcaggtgaaaactgtaggctgaaacagaaacagtgggdcnttaagcagcaaacgctaaaactagcttggaacatggaatcttaggttccccacaaagtaggagtctgaathgwagctcccatattaaactggaattcttgaagagggttaaaatggtcctgggttggtaatgccccatgggtaactgcagaaagcaagtgca

SEQ ID NO: 25313 - DNA, 222 bp, Homo sapiens
ctatctgcaatgcagtgttctcagtaggaaatgttcatctgttacatggaaaaaatgttgatggtgcattgtaaaattaaaaaacacaacttgcagaaccaaatatatggcatcagtacatttttgtaaaactacaaagatacttacctagtaatatagtatagaaaacaattctgaaagctgtgtccactaaaagattaacagtggttatctctgggtgtg

SEQ ID NO: 25314 - DNA, 273 bp, Homo sapiens
aactggtgttaatttaagttacctgggatgtttctttgaatttgttttatagtttctgtagcatttggcaattgctgttagaaaacactagctagaaatcccctccccaccaccctttttaaggccagttaactatactacagtcaataccgtggtgagcaaaaatgtaaaaggtggaaggagaaaacttactaaaatagtatgttttcctattataagggacagacttggtattcagtatttgtcaaatattacatgtgttattcaggagat

SEQ ID NO: 25315 - DNA, 109 bp, Homo sapiens
atgaggcgcgctgagtttgacacgtctcccggtagtgcgcccgccctttaatccttacggagaagcgggagtttcggctgcaggttttggctctgccggcgcgcacgac

SEQ ID NO: 25316 - DNA, 260 bp, Homo sapiens
taaaaaggcattttaactttgtacttgaaaactaaatgagcgatttcatgtgttttagctgaggcattgaagtagcgggtgcttacttatttgtgggaaatcatgtattcatactgaagaataaactccgtagctgatttggtaataacttttactgttacagacgatttcgctttgaccccggtggcagagcacttttactccacattccacgcagctaaatgcaggacttcccagactcttccctccccagcccagtc

SEQ ID NO: 25317 - DNA, 81 bp, Homo sapiens
agcacacggacttactttcttctaatggtttcatgatattctacagtctaagttgttgatctattcccctactgctagcaa

SEQ ID NO: 25318 - DNA, 151 bp, Homo sapiens
aaagccagcccacacacctcgggactccgctcagaatctaaagaggtgagatccttggattatctcggggctgcttcatgaactctgaccagaagaaaagggaaggaggaagcagaaggccgcaggaaccagcccgagacgctatgacccc

SEQ ID NO: 25319 - DNA, 189 bp, Homo sapiens
acatatttctttcattatttttctgtaaacatgcttattataaaccatttgaataatttgaacaagcaagaatgaaaatcacctgccataacacctatggaaaaccattgttacattatttacattacttatccaactgcttgtcttacctacaacctttgtttaaatgactctaaaatccaacccgta

SEQ ID NO: 25320 - DNA, 229 bp, Homo sapiens
  misc_feature 2: y=c or t
  misc_feature 98: k=g or t
  misc_feature 101: r=a or g
  misc_feature 104: r=a or g
  misc_feature 105: w=a or t
  misc_feature 120: w=a or t
cyttctaaacaacctcatacagcccagttacataatgttggctgtcacgggcattgtacttttatctgatattgtttcctctaaattcagctttccakgtratrwttaaaatcttgtgawaatgtttagatttttaacacagaccctgtcataaaatctgtacattagggtcaaaaggtaaaagtaacaaattctgccatattgtaaatttccagtgcaggctttaatt

SEQ ID NO: 25321 - DNA, 240 bp, Homo sapiens
  misc_feature 230: y=c or t
agttcaatgcgagctgagcagacagggctgcaaggaaatctggcgcggttcaatacctcgtctagcctgggttccagtatctaattttttttttgttttaactgacaaactcatttctctactgggacaggatgctgtgctggctggaagttccatttctacagcaagaatcctatctggaaacacagaagttgtcctctagccacagcagctcgaacttttttgattgycgttgctgct

SEQ ID NO: 25322 - DNA, 147 bp, Homo sapiens
caatagaatagtcattcctctttcattttaaagttaaaccctatgctcatactcacagtctgtctcctctagcttctacagtgacctagactcatcagttatctctgcctttctgtatcttcaactttttcctctgtcctgaccgag

SEQ ID NO: 25323 - DNA, 114 bp, Homo sapiens
ctaaggcaggagaatcgcttgaaactgggaggcggaggttgcggtgagctgagatcatgccattgcactccagcctgggcaacagagcaagactctgtctcaaaaaaaaaaaaa

SEQ ID NO: 25324 - DNA, 134 bp, Homo sapiens
ctgagggagtggctctggccccgagggtcttcgcagtgcccacggggcagcttgttttgtggactattgtttggatattgggggatgccaaggtgagggttggggagaggcccaggagcacatgagaggtgcct

SEQ ID NO: 25325 - DNA, 319 bp, Homo sapiens
  misc_feature 293: r=a or g
  misc_feature 294: s=g or c
tgaggcagagctggaggtgaatttgaatgttgttgtattcagacgtaaagtaattttgctgagaaccagttgtcatgaggtatacttacttaccttacttacctaaagattatcacagtatttaaactgtaacttaagaggtaaaagtctattaagtatgttgatgaatataacctgcacagtggctggcagcaagtaaaccctgtttgggtgttcaactttaattttttgttgaaatatgtaagcaggagagtgcacctaccgcaagtgttcagtttgttcatttttaaaarstgaaccccctgtataaccagcagtt

SEQ ID NO: 25326 - DNA, 205 bp, Homo sapiens
  misc_feature 111: y=c or t
caacaccgtcattatttcaggcaactgttgatctgatttttattactgtagatcagttttggctgttctgggtcttcacatcgatttgtttataccaaatttttttttttyctcgcatctgactgcttttgctcagcaaaaagcttttgagattcacccatgttttattgcatgtatcaatatgtttctttttactatggaggct

SEQ ID NO: 25327 - DNA, 241 bp, Homo sapiens
tgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtcccga

SEQ ID NO: 25328 - DNA, 142 bp, Homo sapiens
cataactgctctttccaaatagtaccattgtttattagctctcttgttatcagatttgccaaattcctgaaaaatatttgatttttgaggaagtacattagaatttggcatttggtttgcgtgccaatttcagcagcaccca

SEQ ID NO: 25329 - DNA, 377 bp, Homo sapiens
  misc_feature 333: k=g or t
  misc_feature 334: k=g or t
ttacaacacctggccaacctttactccttattacactaactttatcgttagtgttctactctacccacaactctggggaaactgaggctggggtagcttgctggtgcactagtaaattccaaacttgaacgggagaaatgcttattggaagcactgtctttatatagtttgcaagttgtcattactttttatttttagagacatgtcttgttctgttgcccaggctggaatgcagtggcatgccaccatgcagtggcatggtgatagctcactgcagtctcaaattgctgggctcaagtaatcctcctccctgtaatcccaaagtgctgggakkataggcatgcaccagcacatccagctaattttttgttggtcca

SEQ ID NO: 25330 - DNA, 222 bp, Homo sapiens
  misc_feature 116: r=a or g
aatagagaccaacagatagacagctacctaaagcctgaaagactgacagcaacacagaaaaaaagaaacaggcagaaagagagacaaagacagaaatagaaacagactaacacacrgagtcaaaaatacagagacagaaagacagggagaaagagaaacagaaaattagacaccaaagacatacgaacagggaggaaggccgactgaaagaaagacggagag

SEQ ID NO: 25331 - DNA, 333 bp, Homo sapiens
  misc_feature 298: n=a, g, c or t
cagaaagtcaacaaggatacccaggaattgaactcagctctgcaccaaacggacctaatagacatctacagaactctccaccccaaatcaacagaatatacatttttttcagcaccacaccacacctattccaaaattgaccacatacttggaagtaaagcactcctcagcaaatgtaaaagaacagaagttataacaaactatctctcagaccacagtgcaatcaaactagaactcaggattaagaatctcactcaaagccgctcaactacatggaagctgaacaacctgctcctgnatgactactgggtacataacgaaatgaaggcagtt

SEQ ID NO: 25332 - DNA, 259 bp, Homo sapiens
  misc_feature 115: w=a or t
ttattttaaaaagttttcttgtttaggcaatttggtaagtggtttctagttataaactagccactgttgattaacttgagaaggtgaagcaggggagttctgaagagattacctwgagctacataaccctaagttaagtaaaattttcactttcattcttttcattctctcataaactggttgaaaaaacactgtactaccaacaaaggtgtcagttgcttgtgctgccctgtctatgttatgctctgaataggtctcc

SEQ ID NO: 25333 - DNA, 369 bp, Homo sapiens
tggggtatttttgtgagtttttaaattgaataatataaactgggagttttacataatttatagatttgtagaaatatgtttaagtatacagaaatttcattgagtcattgaattttagggttaaagggacatctgatctagcctttttattttaacagatcaagacactgcagctcaggggttcagctatttacatgaggtcatacagtaagcattaatatttgtagtctcttaatgtagtatcatcttattgtagattgaaacatgacatttaatctgctatcaagatactgggtttgtagggggggatgaggagttgtcagaataacaaaataagtggctttaattttattgaaaacagtggggtgt

SEQ ID NO: 25334 - DNA, 304 bp, Homo sapiens
  misc_feature 109: k=g or t
  misc_feature 220: r=a or g
  misc_feature 255: m=a or c
taagtgtgcaagttattaaaaaaaaaaaattgggccaggcacggtggctcacgcctgtaatcccagcactttgggaggccaaggccagcggatcacttgaggtcagaakttcgagaccagcctgaccaacatggagaaaccctgtctcaactaataatacaaaattagccaggcgtggtggcgcatgcctgtagtcccagctactcgggaggctgaggcrggagaatcgcttgaacccgggaggcggcggttgcmgtgagccgagatcgtaccattgcactccagcctgggcaacaagagcgaa

SEQ ID NO: 25335 - DNA, 187 bp, Homo sapiens
  misc_feature 174: k=g or t
tacaaaaaaaaattagctgggcacagtggcgcacgcctgtagtcccagctactcgggaggctgaggcgggagaatggcttgaacctgcgaggcggaggttgcagtgagctaagatcatgccactggcactccagccttgagtgacagagcgaggctctgtatcaaaaaaaaaakttgcgggggccaa

SEQ ID NO: 25336 - DNA, 385 bp, Homo sapiens
  misc_feature 346: k=g or t
  misc_feature 375: r=a or g
ttgatcctcagtgtggtggtgttgggaggtggggcctagtgggaggtgtttgggtcatgggtgtggatccctcatgaatagatgaatgcccttcctcgtgggtagataagtgagttctagctctttcaggtcccaacaagagctggttgtgaaaaagagcctggcacgcccacttgcctctgctcccaccctgtggtctctgcacgtgccagctcccctttgctttccaccgtgaggggaaatagcctgaagccctcactggatgcccaatcctgaactttcccaaccagcagaaccatgagccaaataaacctcatttctttataaattacccagcctcagataktcctttttggcaacacaaaaatggactargagaactaga

SEQ ID NO: 25337 - DNA, 200 bp, Homo sapiens
  misc_feature 40: r=a or g
  misc_feature 56: s=g or c
  misc_feature 70: s=g or c
ttcctttgtgccaagcacataatgaaggtagaggtttaarggggcccttagcacasaagcactgggttastcagaaggtgaggtgagctgtcacacagccttgatgctagaatgagggtgccctggtagtgtcttatcagccatgacactggtgcattgggccaggtttgtttttttttcttttttttgagacaggctgt

SEQ ID NO: 25338 - DNA, 294 bp, Homo sapiens
  misc_feature 11: k=g or t
  misc_feature 12: s=g or c
  misc_feature 216: s=g or c
  misc_feature 281: k=g or t
  misc_feature 284: k=g or t
cttactctgtkscccaggctggagtgcagtggtggaatcacatctcactgcagccttgacttcccgggttcagacaatctttctgagtacctgggaccacaggcatctgctaccacgcacagctaatttttaatttttatacagacagggtctccttgtgttgctcgggcaggtctcaaactcctgggctcaaggatcctctctaccagctgagcstcctaaagtgctgggattataggtgtgagtcaccatatcctgtatgtctctgttttttaattcakatkttcccctcta

SEQ ID NO: 25339 - DNA, 310 bp, Homo sapiens
  misc_feature 225: s=g or c
  misc_feature 226: s=g or c
  misc_feature 227: s=g or c
  misc_feature 291: k=g or t
cacgatctcggctcactgcaacctccacctcctgggttcaagcgattctcctgtctcagcctcctgagtagctgggattacaggtgcctgccaccatggctggctaatttttgtgtttttagtagagacggggtttcaccatgttggccaggctggtctcaaactcctgacctcaagtgatctgctcaccttggtctcccaaagtgctgggattacaagcgtgasssaccgctcctggctgagataggtctttcttaaaggggagagggaagtggtggagagagaggagakaagatgacaaaggaggaac

SEQ ID NO: 25340 - DNA, 236 bp, Homo sapiens
  misc_feature 10: d=a or g or t
aatttacaadtatttctttttcagtgtctcaggaagcccagaatatatcagtaaatggtcttgttgcacaaaaatctatcatatattaatatttataaataaagaaataagaacctactttagtctttttgtctcagaggacagttttattacattaaagatgattacaaagcaacgcaagtcagcatgaataatttgtttccttgtttattgctgaatttaaaaaaaataggggt

SEQ ID NO: 25341 - DNA, 156 bp, Homo sapiens
  misc_feature 4: y=c or t
  misc_feature 11: k=g or t
  misc_feature 12: m=a or c
tatyatacttkmagttttagggtacttgtgcacaatgtgcaggttagttacatatgtatacatgtgccatgacggtgtgctgcacccattaactcgtcgtttagcattaggtatatctcctaaagctatccctcccctctcctcccgccccaaaca

SEQ ID NO: 25342 - DNA, 375 bp, Homo sapiens
  misc_feature 278: r=a or g
  misc_feature 333: k=g or t
  misc_feature 370: y=c or t
ctctgtttaatctttctctttcttgcttttgatcccagaagacatccatggaagcctaagaggcacttttaagaaattctagagctccacagagtagatttaggaaactactgatctagtgtgttttttttcattttacaaatgaaaaattgagaccaaaaggcctactgacgtatccaaaaatcacatagtggaagagttataaacaaatagaactatagtttctgactctggtatggtattctagtgaactaagaagtttttctaatatctctgargatatttacactttttgatgattgactatatttttccatctctctggacagacakctgttctccagcatatcctttgctacctgttttccayctgat

SEQ ID NO: 25343 - DNA, 144 bp, Homo sapiens
  misc_feature 11: s=g or c
tgtaattttcsagctgtgaaaatgttgccttgtatttaaaagggtttcatgaatggaaacctaagtaaaactaagctcattagtgacagacttgttttcttcttgttattcctccagcaactccctcaccaccacgcctcccgc

SEQ ID NO: 25344 - DNA, 103 bp, Homo sapiens
  misc_feature 12: y=c or t
  misc_feature 56: s=g or c
  misc_feature 57: r=a or g
ttttgtgtgaaygtattgcatataatgttcaagtagatgattttacatttatggasrtataaaatgtctgattaccccattttatcagtcctgactgtactct

SEQ ID NO: 25345 - DNA, 298 bp, Homo sapiens
  misc_feature 2: r=a or g
  misc_feature 3: s=g or c
  misc_feature 12: s=g or c
crsatcctgttsatttcatcagattctgtgcagcagctttttaatttgaagtaatctgagtcatctattttttcctttgctttcctggggtttgagtttaaatcataaagtcactgccagctgggtgtggtgattcatgcctgcaatcccagcattttgggaggccgaggcaggtggatcacttgaggccagtttgagaacagcctggccagcatggtgaaaccccgtctctactaaaaatacaaaaattagccagacttgatggcacacacctgtagtcccagctacttgggagagc

SEQ ID NO: 25346 - DNA, 99 bp, Homo sapiens
  misc_feature 21: s=g or c
tctagtgggtctcatgtagasatagagatatttttttgttttagagattccaaagtatatatttttagtgtaagaaatgtaccctctccacactccaaa

SEQ ID NO: 25347 - DNA, 154 bp, Homo sapiens
  misc_feature 10: s=g or c
  misc_feature 12: y=c or t
  misc_feature 110: s=g or c
tgtatttttsgyacagacggcgtttcaccgtgtgggccaggatggtctcggtctcttgacctcgtgatccgcctgcctcggcctcccaaagtcctgggattacaggagtsagccaccgcacccccggcctgttttgctttgttttaaactgggt

SEQ ID NO: 25348 - DNA, 366 bp, Homo sapiens
taagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccgaactagagcagtaaattcaaatggtaagatgaatcctagaaggcctctgattgcagcatgttgacaccaaccccac

SEQ ID NO: 25349 - DNA, 196 bp, Homo sapiens
  misc_feature 12: m=a or c
acaaatgcaatmatgtacataaagcatgcatagtagtgtttataaatagcagccaccactgctttgattagaaataataacagctaacatttgaggatttactgtgtgccttgaacgctgctaagctctttatatatattacatattgagtggtagaatcaggattcaaatccagatctgactccaaagcgctaac

SEQ ID NO: 25350 - DNA, 224 bp, Homo sapiens
tatgtggtgtaaaggtttgttatacgtgccacaatatagcatataaatattatgccatcattccttctcttgttaaaggtagaagaataaaattgtgatttttataacctgtgcttattactcaaatggtcttcaacatctttttaaacaacacataccttttgaatgttcagtttctattttgcttgaggtattttgtacatatgtgccttgtgattgccgcc

SEQ ID NO: 25351 - DNA, 283 bp, Homo sapiens
  misc_feature 13: s=g or c
  misc_feature 46: s=g or c
  misc_feature 261: m=a or c
  misc_feature 262: s=g or c
gtttttccctctstgttcctctgcgggatgcgagccgtctggagastcgggcggccgggacttcagctttcggggtgctggcggacccgctggggtttgaggtctccgagaatgaaacgcgctggcagccgggacgaagggaacttacctggaagtgaactcgaactacttttcccaaggggccgttcggtagcccaggccagtcgccggcctgggaaatattacagttcaggaaaataaacataactcctttaagggagmsaatgggcgctagacagggaaa

SEQ ID NO: 25352 - DNA, 125 bp, Homo sapiens
tactaactgaatatttcttgaatttatccacttcgttccactgacactttccctattcagatactgtaacttgcataaagatgagctcactcagggcctagttttaattttgataacgaagaaaa

SEQ ID NO: 25353 - DNA, 201 bp, Homo sapiens
  misc_feature 85: w=a or t
  misc_feature 90: k=g or t
  misc_feature 108: r=a or g
  misc_feature 114: w=a or t
  misc_feature 123: r=a or g
  misc_feature 147: s=g or c
  misc_feature 154: h=a or c or t
  misc_feature 169: r=a or g
cggacttggccgtgttctcatgtgcagaaccaccattgcctccaaattaatgaaaaaatgagataaggtaatggcttagagttawtggtktaaaggattgttattaartaagawtcaaaagargtgatttaaacactaaagaggtascaaagahccaaagtaagttgargaattactgtgttctttaaagacaaaagcaga

SEQ ID NO: 25354 - DNA, 154 bp, Homo sapiens
cttataaaatattttaaaaagttaactgttaaacagccttaggcaggtactttaagtggtattctggaaagcattgttatcataggagatggcagcttcatgtgtgttattgcccctgaagactttccagtgggataagatatggaggtgggta

SEQ ID NO: 25355 - DNA, 83 bp, Homo sapiens
  misc_feature 3: n=a, g, c or t
  misc_feature 27: r=a or g
cantccaatcagttacatagctttaaractcagaattatttttgtgtacatccactgtgtagtacctgaagtgagctgaactt

SEQ ID NO: 25356 - DNA, 269 bp, Homo sapiens
ccgtcattcatcctttttgttgccaggcggtttcagtgtccaggtgcgctgcagtctgtcccttcacctgttgatggatatgtgggttgtttgcaggttttggctattgcagataaagctgctgtgaacattcatgtaccgacaggtctttgtgtagatccgggctttcgtttcccttgggttaatacctaggagtagagtggctggatcataggggaggcatatgtttgagtttttaagaaaccgccacattgttttccaaggcagca

SEQ ID NO: 25357 - DNA, 88 bp, Homo sapiens
gctaatttttgtatatttagtagagacggggttttgccttgttgcctaggctggtctcgaactcctgacctcaagtgatccaccgcca

SEQ ID NO: 25358 - DNA, 346 bp, Homo sapiens
  misc_feature 11: w=a or t
  misc_feature 25: n=a, g, c or t
  misc_feature 26: n=a, g, c or t
  misc_feature 27: n=a, g, c or t
  misc_feature 48: h=a or c or t
  misc_feature 49: w=a or t
  misc_feature 50: n=a, g, c or t
  misc_feature 51: n=a, g, c or t
  misc_feature 112: n=a, g, c or t
  misc_feature 113: s=g or c
  misc_feature 120: k=g or t
  misc_feature 121: w=a or t
aatattgcagwaacctttgttcacnnnaaactgcagatgctctgttghwnncactggagattgtcctgatactaaggacaagtatgctcatataacattaacagacaagacnsttttcakwaagacaggcaacgtgttggaccttccggagcttctcagaagacagagggttttcttttgaggctgttgtacagtggcctgattatagctcactgtagcctcgaaattctgggccgaaatgatccgcctgcctcagcctccaaagtagctgagactacagttacaagctattgaggcactccagagtgacggcatgtgatccccctgacacaagaaacaggccccg

SEQ ID NO: 25359 - DNA, 143 bp, Homo sapiens
caaaatcctctcttgtaaatacctgaaaatacataaatatgtgattcttaactatagtcatcctacagtactacagaatactaaaacatactattcctatctggctgtgtaaacttgtatcctttaaccaatcctacccccaa

SEQ ID NO: 25360 - DNA, 326 bp, Homo sapiens
  misc_feature 96: n=a, g, c or t
  misc_feature 308: h=a or c or t
atgaccgggagttttaagaccagcctgggcaacatggcaaaaacctatctctgcaaaaaaaaaatagaaatcttagccagccgtcatggtgtgctnctgtagtcctagctacttgggagactgaggtgggaggatcaattgaaaccagaaggtccaggctgcagggaactgtgactgcaccactgggctccagcttgggtgaaagagcgaaaccctgcctcaaaaagaaaaataagatggatgtttctgcattaaaattagggagttgtcgtataatgtagttgcataaactagtattctgtgcttghgtggttaaagagcctgaa

SEQ ID NO: 25361 - DNA, 212 bp, Homo sapiens
  misc_feature 123: m=a or c
  misc_feature 124: s=g or c
tccgggtggttggcaaactcatcgtgtctgtcctgagaggctccacaatgcccacccgcatcgccattctgtagtcttcagggtcagctgttgataaaggggcaggcttgcgttattggcctmsattttgctgcagattaaatcctttgaggattctcttctcttttaccatttttctgcgtgctctcactctctctttctctctctagcca

SEQ ID NO: 25362 - DNA, 164 bp, Homo sapiens
caaatgaccaaatggtatgatgcacactgagatactcaataaatgtgcagtgattcttagccttttttcctagaactttaatattaacatggaaaattctgaaatggacaacaaaaagataacactttgtgtatggggaagaatatcatgcagttgatgacggt

SEQ ID NO: 25363 - DNA, 166 bp, Homo sapiens
atttctgttgttaagccgtccactgtgggaggccgacgcaggaggattgcttgaggccaggagttcagggccagcctggacaacatagtaagaccctatctctacccccctaataaattaatttaaaaagccccccaatctgtggtattttattatggcagcccga

SEQ ID NO: 25364 - DNA, 375 bp, Homo sapiens
  misc_feature 330: k=g or t
  misc_feature 331: v=a or c or g
gttctctcctaggagtgaaacatgtacttggtagatgtcggctgcctccaccaaatgcaaaaacgcatctcatcctgtgagctgaccttgctgggggcaccgtctgggagtcgtttttgattagaagttgacctcagaaatatgctcacatcattttgaaagcatcttccagcaccacagaaatcgactcagatggagaaaggacactgagtggacaggggccaggatggggcgtggacgctctgcctctgccggggacaaggccttcccacagactccctggggtgttgccagcctgagtcagagatattgatgtaatgcctaccgtgkvcagacacgctgcgaggccctggggatgcagccacaatcccaacg

SEQ ID NO: 25365 - DNA, 224 bp, Homo sapiens
ctcttttaaaaatctatggcaatatgcaaaggctgggaggacaagccccagagaatggaaatcttgggaaatgagcactgagtaggttcctgagtctgggtttcagagtctcccacttggaggtggcaggctatgcttctcagcaggtgcctcgttgttgcagtgtggggataaatggctgcccagaacacagaataccctcccttcagctatgtggcgggcct

SEQ ID NO: 25366 - DNA, 278 bp, Homo sapiens
tttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacgt

SEQ ID NO: 25367 - DNA, 282 bp, Homo sapiens
  misc_feature 282: m=a or c
aataagcacaatactggataacctatgggtcagatctggcaggcttccaaattaacccatctggcagaagtcttgtgattcatggcaacatgcggtccctgggtagggtcttatcaggagttctccaattgttggcatactgtttactatgtaacttacagacactgaaaaggatcctgatttgtttcagaatgggaagaaagtctggctgatggtcttgcacatggacactttaacctgtatgttgccatctgtagccaatgattgtaacttctgtaatgm

SEQ ID NO: 25368 - DNA, 157 bp, Homo sapiens
tagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggagca

SEQ ID NO: 25369 - DNA, 222 bp, Homo sapiens
  misc_feature 84: n=a, g, c or t
  misc_feature 85: n=a, g, c or t
  misc_feature 86: k=g or t
gagagcgagtgagtgagtgagtgagtgtgtgtgtgggggggactcggcttgttgttgtcggtgacttccccctccccttcaccnnktcccctccccgccgccgctgcagtggccgctccctgggccgtaggaaatgagcgataacgatgacatcgaggtggagagcgacgctgacaaacgggctcatcataatgcactggaacgaaaacgtaggggccacgt

SEQ ID NO: 25370 - DNA, 102 bp, Homo sapiens
aggcggggatcgggcggcgccgagctgaggtggtgagggactagctcccggatgtggagaagctggggagaaggcgtgggaggaagatggactcggtggagc

SEQ ID NO: 25371 - DNA, 200 bp, Homo sapiens
  misc_feature 120: k=g or t
tatatgtcattgcattttttttaaatcttattttatgtgaactactctaatacatttttctttgaaggttcttccaaagatcttgacgaggcactcttcccgtctttcttagtaattttktctttgcagttattagtcattgtcttctaaaaatattttttaactttattcccccaccccttccttccttaccaccaccg

SEQ ID NO: 25372 - DNA, 304 bp, Homo sapiens
tcctggtacatttgatttacaaagagaatttactgccacatggtattcattttatgggaaatgtcgtgtcgaaacaatattgtgtaactatatcttttaaagacaatcctgcaataataaaactaataaacataatgtaatgacatttgtaaagtgtatcccagaactatcagtagattaataaatattgaggaaaaggaacatcctcagtcaagtaagtttagagaccttattgagttgcttgctttactgtaagattcctcaagacatttaatatatgtgttaaaattctctaagagacacc

SEQ ID NO: 25373 - DNA, 346 bp, Homo sapiens
  misc_feature 295: r=a or g
  misc_feature 317: n=a, g, c or t
  misc_feature 318: n=a, g, c or t
tagagaagcaagagcaaacacattcaaaagctaggagaaggcaagaaataactaaaatcagagcagaactgaaggaaatagagacacaaaaaacccttcaaaaaattaatgaatccaggagctgtttttttgaaaggatcaacaacattgatagaccactagcaagactaataaagaagaaaagagagaagaatcaaatagatgcaataaaaaatgataaagggcatatcaccaccaatcccacagaaatacaaactaccatcagacaatactacaaacacctctatgcaagtaractagaaaatctagaagaaatnngtaaattcctcgacacatacaccgtccc

SEQ ID NO: 25374 - DNA, 271 bp, Homo sapiens
aaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggaga

SEQ ID NO: 25375 - DNA, 153 bp, Homo sapiens
ttacatttgatgattttctgtcatggctaacactaatttatatagttttttaggttaaaaaataacatttttttactgtgtaaacctactagtaaaaatacaaaaatagagtaattataggctttcgggaagcttaagctttagagaaccacg

SEQ ID NO: 25376 - DNA, 93 bp, Homo sapiens
cctccatcaacagctaattaatccaaagatagtatttgacttgattggaaaatgttaggatggaccaaggtgggccataccaactccctctga

SEQ ID NO: 25377 - DNA, 314 bp, Homo sapiens
  misc_feature 42: b=c or g or t
  misc_feature 43: s=g or c
agatctccagattccaccatacccgaaatatgcaactactabsaccattttggcattgtgcttttctgtgtgtatatgtgtttgtgtcctagcaaaaagaaatgcaattcctgcaggaaaaatgcactgggagaagagcatccagggcttacagtttacattctgtattgtgagctatcagttgctatgatttactgaattgaggggtacgttatgagaaagtgaaatctgggttttcatctcttccctctcactcttacattttaaacttttctccttctcaagagttttcacattctcctgcaaatatgctc

SEQ ID NO: 25378 - DNA, 202 bp, Homo sapiens
  misc_feature 43: y=c or t
  misc_feature 46: m=a or c
  misc_feature 47: s=g or c
aaaacaggatttgcttagtacacatggaaagtcacataaaatygcmsgcattttttctagtcagtctggcaaggaacaggattaaggtttggatatagatgtgggcatctgagtttgagttttggggccagtacttccatctgtgattattgtttataggcataacaaagtgaggaggaggccaaaagagaaaatgggggcc

SEQ ID NO: 25379 - DNA, 85 bp, Homo sapiens
  misc_feature 27: r=a or g
  misc_feature 44: m=a or c
  misc_feature 45: b=c or g or t
taaaaaataaatatacaagaaatttaratatggaaactttcaambgaagtttttagcattcatatttctgaagttattaaagctt

SEQ ID NO: 25380 - DNA, 383 bp, Homo sapiens
gaggagggtgtagccagtgctaagttcgcttgcggctgacctttctttggaatgtcgtgagttccatttgtcccagaatacggtccgctaccgctgtgacatgagtgttagggaaggcgggttgtcacgtttctacaagccttccagtcaaaagggaaaccttgcctaagtccttgtagttgagaaatctctaagaggtggaagcaaatactgcacatgcgtgttggtcctgtgagggaaaccagctagtggagagggagaggttgaaggaacagaaaaatgagaagacaactcactggaggctgaagtgggaggatcgcttgagtctggaagcttgagactgcagcaagctgtgatcgtgacactgcactccagcctgggca

SEQ ID NO: 25381 - DNA, 399 bp, Homo sapiens
aacaagtcttactagcatagtactgtactgttaagtcttatgcaggcaatgagtttaaataaatacttttatttacatattaaattatagaatactgattccagtatgactgaactctaaggattctcttcacacaggtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgat

SEQ ID NO: 25382 - DNA, 218 bp, Homo sapiens
gttaagagtatgtttagctttgtaggaaactgccaaactgttttcccaagtagcttactatttgcattcccacccgcaatgacttgagagttcctatggctctgcacccttgccagcatctgctgttggcagtgtgttggattttggccattttcataggtggtatcttgtgtttgttttaattcacagttccctagtgattcataatgtggagctgt

SEQ ID NO: 25383 - DNA, 500 bp, Homo sapiens
  misc_feature 410: m=a or c
  misc_feature 411: w=a or t
ctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagagaggatacacatgtaaaattacatctggtctcttccttcactgcttcatgcctacgtaaggtctttgaaataggattccttacttttagttagaaacccctaaaacgctaatattgattttcctgatagctgtattaaaaatagcaaagcatcggactgaaccaactttggaaataatttatttttataatgggmwcatgttaaagtagaagtagctttttatgcaaatacatgcatttatgcaatattaatgtaagggctctaaaacaatggagtagagccaga

SEQ ID NO: 25384 - DNA, 464 bp, Homo sapiens
  misc_feature 447: m=a or c
attgacctaccagattatgagcatgtagaagatgaaacttttcctcctttcccacctccagcctctccagagagacaagatggtgaaggaactgagcctgatgaaggtatgtatagagagttttaaaaaggaggctgtgaggccaggcacggtggctcatgcctgtaattccagcactttgggatgctgaggcgggcggatcacaaggtcaggaatttgagaccagcctggccaacatggtgaaatcccgtctctactaaaaatacaaaaattagccggggtgtggtggctgtggtaaaaggtatttgaggagaaaaaagaaaaaaaaggaggctgggcacagtgggtcctgcctgtaatcccagcactttgggaggccgaggcaggaggatggcttgagcccaggagttcaagaccagcctggcgagacctcaactctactaaagmtttaaaaattagcgcgc

SEQ ID NO: 25385 - DNA, 507 bp, Homo sapiens
ttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccagcctggcacatgataagtactcaatacatgatattctctt

SEQ ID NO: 25386 - DNA, 178 bp, Homo sapiens
  misc_feature 92: y=c or t
  misc_feature 93: y=c or t
tcatttacattcaagattaatattgatatgtgaggttttgaaccagtcatgatattattagcttgtagctttgtattctcaattgcattgtyytctttatagggtctgtgggctctgtacttacatatgtttttatggtagcaggtgttgttctttcttttttatgtttagggctcaa

SEQ ID NO: 25387 - DNA, 234 bp, Homo sapiens
catactgtgaccgagattcatcttctctgtttttccgatggcttgctacatatcctttaagtaagcattgcaaccaccccaccctccaaaattggacagtttgaacaggcaggaagcaacatttttcatgcaacgatcatgtgcttcatgatcctcctgcaaacatactgatgtcttcttcccaagatctagacaacgagcatcatctttaaccagtattttcaagaggccgga

SEQ ID NO: 25388 - DNA, 347 bp, Homo sapiens
  misc_feature 12: s=g or c
  misc_feature 119: w=a or t
  misc_feature 199: k=g or t
  misc_feature 200: w=a or t
  misc_feature 266: r=a or g
  misc_feature 274: w=a or t
  misc_feature 275: k=g or t
  misc_feature 310: r=a or g
cattgtttagastagagtaggaatttgagttttgatcttacttttatatgtgctaagaaatcgttacctttaggattctgataagggcatgaggagtggtgccagacttaaccttggcwtgtctcctggtcctgtcactttgtagatttggacaagtcacttatctgagctcagttttctcatatatacaataggaatkwtaataatgctaatcatttaaaagtttttgaggccaagtgcagtggctcatgcctgtgattgcagcrctctaggwkgctgaggcaggtggatcacgaggtcaggagttcargaccagcctggccaacatggtgaaactctgtctctac

SEQ ID NO: 25389 - DNA, 388 bp, Homo sapiens
  misc_feature 12: m=a or c
  misc_feature 22: m=a or c
  misc_feature 51: n=a, g, c or t
  misc_feature 53: s=g or c
gcgcggggcggmagacccgccmagtgttcaagcggccgcagagcgcccagnasttcgcaggtctggggctctcttcccagagagctcgtaggggaggacagtcaagggactcaagcgtctctcttgactccccttctctcgctgtgcagtggcggcgccgaggggtcgacgctcagggctaatctctatgagtcaccctcgaggccccgggtaatattgggtggatcacaagaactaatctttcatgatttggaaaccggaaggaaagaagcacttttgtagctgacttacctcaatgacatcaccagtgtctgagcctacaactgcgctatcttccctggatttttcttcaccttttcgttactcatgagccaggctggagtgcagt

SEQ ID NO: 25390 - DNA, 416 bp, Homo sapiens
  misc_feature 149: k=g or t
  misc_feature 150: k=g or t
  misc_feature 291: y=c or t
  misc_feature 327: s=g or c
ccgaattattttagtgttacttatctttgaataaaatgtatttttcttggatcaattagttgcagcacgttcttaggaatggaatagagaagcatcctaagccagaaggatttttttttttctagatcacagtgaagctttaatatggkkggatatttgtcccagcccaaatcccatgctgaattgaaacccctagtgctggaggtggggcctggtggaaggtgtttggatcatgaggacacatctctgatgaatggcctagctcatcctcttagtgatgatgagtgagtyctcacaagatctggttgtaaagtgtgccccaccacsgccattctttctcttgttcctgttttcttcatgtgatgtgcctgttccccttcaccttctgcaatggctgcaaagcttcctgaggccta

SEQ ID NO: 25391 - DNA, 96 bp, Homo sapiens
ttacttttcagtctgtatgtgtctatatgtttcttgtaagcataatatttttggatcattttttagttcgttccatcaatctacctttcttttttt

SEQ ID NO: 25392 - DNA, 158 bp, Homo sapiens
  misc_feature 21: s=g or c
  misc_feature 41: s=g or c
  misc_feature 55: s=g or c
  misc_feature 109: s=g or c
  misc_feature 149: k=g or t
  misc_feature 150: w=a or t
tattaaaaaaacaaatggtascatgatgatcccaaatttasataagcaaggttgscacttggctctacctcttgggagctgttttaacctttatttacggagtgcctascatatgctggacagtgtgctgggcattaggaatagagtgkwgggcgcaa

SEQ ID NO: 25393 - DNA, 227 bp, Homo sapiens
tgatcctgcctttgagaagttaagggctctgctggacaagttgccttttctgagcgtgtttcttcatctccttttgagataacacttatttgaggattgaaggaaatgtttgtaaaatatttattacatttttagcacatagatgtaaagaaatagatattacatattcttatttgtatggtcagtgaaagcaaaagagatgagaatggagagattgatgtgagcgg

SEQ ID NO: 25394 - DNA, 307 bp, Homo sapiens
  misc_feature 1: m=a or c
  misc_feature 12: s=g or c
  misc_feature 305: s=g or c
  misc_feature 306: r=a or g
  misc_feature 307: k=g or t
maaggtcttttsagggaatatctcagtattcctttttttccagcttccctagtgatggtcatgcattgaagagactgggtgtacccttggctggagaggctgatggaaggccagagttattggtgggccactgagcagccctcctctcctatttagtcatcctgcttggagtatctgactctgaagcttctcttgcatctttacctcgctccagagatgttgaataaacttccagcctcattgcagcctttccggggatcatcctagtctcagtgccttcattaataataacaaaatctgcggasrk

SEQ ID NO: 25395 - DNA, 101 bp, Homo sapiens
  misc_feature 51: w=a or t
ttgaaccattctaagtcagagaccatttgtatatacatatgtggatttgtwtttatgtatttgtcaagttagtgtattgttgctgacaagattttttcttt

SEQ ID NO: 25396 - DNA, 198 bp, Homo sapiens
  misc_feature 11: s=g or c
  misc_feature 21: s=g or c
  misc_feature 86: y=c or t
  misc_feature 87: y=c or t
  misc_feature 88: y=c or t
  misc_feature 143: s=g or c
aatcctgactsacgttgtgasacatttactgtagctggagcactctctctcctgctcatggaactttactccccccagtcctgctyyytatccctgccctagtccagagaagccatctatctttcatccacttcacagaatasagtctcattttcctccagaaacagctcaccattaatcagtgcataagagggcccc

SEQ ID NO: 25397 - DNA, 130 bp, Homo sapiens
  misc_feature 13: w=a or t
  misc_feature 19: y=c or t
tgttgttgttgtwgttgtyttgagacagagtctcattctgtcgcccaggctggagtgcagtggcatgatctcagctcactgcaactttctgcctcccgggttcaagcaattctcctgccttagcctcctc

SEQ ID NO: 25398 - DNA, 254 bp, Homo sapiens
tgttcattcttcaagttccagcgtaattccatcttttctttgatgccttccttgtctcttttaggcagaattaattgttcccttttctatccactcccttttttttccccagcctttattttagattccagggggtacatgtgcaggtttgttacatgggtaaattgcgagtcgcagggggtttgttgtatagattattttgtgacccaggtaatgagcatagtacctgacaggtagtttttgatctccacgcc

SEQ ID NO: 25399 - DNA, 345 bp, Homo sapiens
  misc_feature 312: r=a or g
  misc_feature 334: r=a or g
tagaagactaagaaaattgctgaaaatcatgcaattacatggaaatcaatcaacatgctcctgaatgactttttaataaataatgaaattaaggcagaaatcaagaagctctttgaaaataatgagaacaaagttacaacatactagagcctctggacacagctaagacaatgttaggagggaaatttatagcactaaatcccacatcaaaaagttaggaagaactcaaattaataacctaacatcacaactgaaagaactagagaagcaagacaaaaccccaaagctagaggaagacaagaaataactgaraatctgagctgaactgaaagaraccgagacctt

SEQ ID NO: 25400 - DNA, 243 bp, Homo sapiens
gataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtgat

SEQ ID NO: 25401 - DNA, 112 bp, Homo sapiens
ctttatttccctttcacttttaaagtatagctttgcttttgtgtgtgtgtgtgtgtgtgtgtgtgtgtgtaagttctctatgcctttacccatttcttattctggaacaccc

SEQ ID NO: 25402 - DNA, 112 bp, Homo sapiens
  misc_feature 86: w=a or t
ctttatttccctttcacttttaaagtatagctttgcttttgtgtgtgtgtgtgtgtgtgtgtgtgtgtgtaagttctctatgcctwtacccatttcttattctggaacaccc

SEQ ID NO: 25403 - DNA, 127 bp, Homo sapiens
caagtagctgggattacaagtggccaccaccacacctggctaatttttgtatttttattagagacggggtttcaccatgttggccaggctggtctcaaactcttgacctcaagtgatctaccccacc

SEQ ID NO: 25404 - DNA, 452 bp, Homo sapiens
  misc_feature 393: k=g or t
  misc_feature 394: k=g or t
agatggagttgaagaacattatcttagactataagtctgtctgcatacagctatgttctcaaagattattcctgctgcaaataaagatcttgggaaagagcaatatagagttatcacagtctattgacccaaagatgtttaaaattagccctttttacccctcattaaccagattgattcatgctcctctcacccctaaactcattttcagtctggttttttaaatggtataaccaaccaaaatgcttacaattgttctcgaggtatgtgaccctaccaacatcattatgcccctttggccacttcatgaaatgcttctctgtagtttgttggcataaaacctgcaaaggtaacctttgtgcaaaaagagacctgactactggaaccatgtakkaataatgtccttctctattagcagtcaaggtgttgtaggagggcattgggctggatga

SEQ ID NO: 25405 - DNA, 419 bp, Homo sapiens
  misc_feature 7: w=a or t
  misc_feature 8: w=a or t
  misc_feature 260: r=a or g
  misc_feature 261: r=a or g
  misc_feature 318: d=a or g or t
  misc_feature 319: n=a, g, c or t
  misc_feature 358: r=a or g
ttgatcwwtgttcttttttagaaatagtgaggctgttgtgaggtgagtcaccacttgtgacttagaagattgcagtggtttccacttcacctgtttccacttttgtgatgatgccttaaggaaaaagattgtgccaggtgtggtggctcaggcctgtaatcccaacactttgggaggccgaggtgggtggatcacaaggtcaggagatcaagaccatcctggccaacatggtgaaacgccatctctactaaaaatagaarrattggctagatgtggtggtgcacgcctgtaatcccagctccttgggaggctgaggcdngagaattgcttgaagatgggaagcacagattgcagtgarccgagatcgcgccactgcactccagcctggcaacagagtgagactctgtctcaaaaaaaaa

SEQ ID NO: 25406 - DNA, 332 bp, Homo sapiens
ttcaccagcaagagcaagaagtattggcagcagcaggcagccaggcaggctgggagtttgcatggaaatcatgaagtctttcttgtcttcctcttttgaaatattttggaaggccgagttaagaatagctcagaaactggtctcattctttttgtgggaagaatgaccagaagcataaaagctaagtcttccagcaagtgcaagacacctcttttggtgtttgcagtaaacctaacaagaatgaattgctatcagtaaagtcctgtaccatgacacctaaaaggaaggaaatggtaaagcaaagtaataactcaaagacagtcaccgagggt

SEQ ID NO: 25407 - DNA, 268 bp, Homo sapiens
  misc_feature 24: m=a or c
  misc_feature 176: w=a or t
  misc_feature 223: w=a or t
  misc_feature 268: m=a or c
tcttatgtgtgcctttttgcttamtttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaawacagattacagtctcttatccattttttgaaatccaaaaactacgawaacaaaagattttctgttgttgagctaattaaatgtgaaccctgm

SEQ ID NO: 25408 - DNA, 225 bp, Homo sapiens
  misc_feature 12: y=c or t
ttctccatttcyaatacatatgtttaaacttatatgatttttgtaacattttatcttcattgtataagttttaacaagtatcttttgtcatttaattaaatttcattatgatttcttatgtgaataatggattatttcaaattatattttttattttccaatgtatgaggggatctactagttatcttcttgttaaaaaaattctggcatatactgtctgttcac

SEQ ID NO: 25409 - DNA, 115 bp, Homo sapiens
tttgaaaaactggacctgttcagtgagtggcctggctgacatgttgatgaaggtcacctcagcctgccctgctgtgatggtggtgatggttttaggctgaagggaacatggccgt

SEQ ID NO: 25410 - DNA, 203 bp, Homo sapiens
ctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggggtgca

SEQ ID NO: 25411 - DNA, 316 bp, Homo sapiens
ctaaataaaagatgtatttcttcaatcccacctagctgcatttcaagtgctcaacagccacatgtggctccatattggtcagcaaagagaatgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgcagggc

SEQ ID NO: 25412 - DNA, 112 bp, Homo sapiens
  misc_feature 51: r=a or g
  misc_feature 59: r=a or g
  misc_feature 63: s=g or c
  misc_feature 71: m=a or c
  misc_feature 86: w=a or t
  misc_feature 97: w=a or t
  misc_feature 100: w=a or t
  misc_feature 105: r=a or g
ctttatttccctttcacttttaaagtatagctttgcttttgtgtgtgtgtrtgtgtgtrtgtstgtgtgtmagttctctatgcctwtacccatttcwtawtctgraacaccc

SEQ ID NO: 25413 - DNA, 180 bp, Homo sapiens
  misc_feature 11: k=g or t
  misc_feature 36: r=a or g
ttctcaactakcattctttccattgatttgaagggraaattaactattataatctcttgaatccaaaactggatattaagaactttcccccttactaagtttaagacttttgtcatgtggtgagtcaaataagaccattttgattgtaaaccataaaatagttcagcaagtagccccaga

SEQ ID NO: 25414 - DNA, 385 bp, Homo sapiens
  misc_feature 259: w=a or t
  misc_feature 308: r=a or g
  misc_feature 377: v=a or c or g
acactcttatattctcaattaatttgatagaaaactattaaaagtaacgatagtcacaatgtattcagggattataacctattgattaataaatggattatagtaatttaataagggattagatggaggaataggaaatactcttattataaaaggttcatgaaatatccataaagcaatataaggttattcaaaagccagcggaggtagttgcaaatatgattgtaaactctaggacaataacaaaaacaaaattgawatgaattaaaattgatgtactgagaggtgaaagaatcaaattatattaracatacaatcaaaactagaggctgagtacagtggcatatgtcttgcagtttgttctgctgaagtattgvcccccaac

SEQ ID NO: 25415 - DNA, 275 bp, Homo sapiens
  misc_feature 138: y=c or t
  misc_feature 252: r=a or g
cagtcaatctcagtagtatagttatggatcaaatgacacaaaataaacaaaacgccgagccaaagtctgacacaaagtagatgctaaaaacagaataagccacctctgccctttcatttcttctacttcttctgtgtyaatgggcaaatgaatggctccaatagaaaggtatggctagccctcccagttaatacgttttcaggccaagactaaaatgaaattgggactaaaatgttaaaatgtttactagaratataaacttgcattcgcaccga

SEQ ID NO: 25416 - DNA, 162 bp, Homo sapiens
ccatttaaaccatttttttgtattatactttaagttctagggtacatgtgcacaacgtgcaggctcgttacatagttatacatgtgcaatgctggcccgctgcacccatcagcctgtcatttacattaggtatttctcccaatgctattcctccaccggccc

SEQ ID NO: 25417 - DNA, 295 bp, Homo sapiens
tcactgggctagtttcttatattgtactcatacttttctttgtaagacatgtaccacagagaattgcttccattgtgctcatatttcttccctcagcagaagtaattgcttttttttggaatgttttgagagaagagagatctttgagaaagcacctgtagaaactgctttctctgtatctgactttacagctgagaggaaaaagtcagctgatcgtgtccagattattccatgtaaaaacagaaacacgtagccttgttctgggcaattgcaacagttcctaaatggccttaca

SEQ ID NO: 25418 - DNA, 167 bp, Homo sapiens
  misc_feature 112: w=a or t
  misc_feature 128: d=a or g or t
  misc_feature 138: k=g or t
  misc_feature 145: k=g or t
tgctggctataaaataactgattaatataattctaacacaatgttgacattgtagttacacaaacacaaataaatattttatttaaaattctggaagtaatataaaagggawaatatatttataagadagggataaakgtaatakagcccttctgccccccaccaca

SEQ ID NO: 25419 - DNA, 164 bp, Homo sapiens
  misc_feature 17: w=a or t
  misc_feature 21: v=a or c or g
  misc_feature 87: s=g or c
  misc_feature 88: m=a or c
  misc_feature 92: m=a or c
  misc_feature 93: s=g or c
  misc_feature 109: k=g or t
acaaaaaattagctggwtgtvgtggtgggtgcctgtagtctcagctactcaaggaggctgaggcacaagaatagcttgaaccgggasmtggmsgatgcagtgagccgakatcgcgcccctgcactccagcctgggcgacagagactccgtcaaaaaaaaaaaaa

SEQ ID NO: 25420 - DNA, 136 bp, Homo sapiens
  misc_feature 4: s=g or c
taasgtttttacagatacccaccttagttgtaaattggatagtttatatttctgggactttttaaatgaaaatgtggaatgttaagttacaaaagacttttcatcagaaaatttcaaacaaagtaaacatggcgct

SEQ ID NO: 25421 - DNA, 313 bp, Homo sapiens
catgtgatacttcgacaaacatcatatgccttgcagtttttctcggtcgtgttctcagggttgagtagtccccttagctacctaactttactttcaatacaaagcacaaaaaagaatatcttcaaataaaagtttgcctgcagaacctggcaaaatgacccattatgagagtttagatgttttaattttatgtgctcccagctactctggagtctgaggtgggaggatcacttgaggcagaggttgcagtaagctgagattacactactgcactccagcccatgtgacagaggaatgagagccagtctcaaaa

SEQ ID NO: 25422 - DNA, 136 bp, Homo sapiens
cgaattccaagcaagttatgatgattcttattgtagttcaagtacagatgagtaagtggtgtgacttcagtttattatcttcttggtgacctactttagtatgtgttctgtagcgattcatattagttaagggatc

SEQ ID NO: 25423 - DNA, 311 bp, Homo sapiens
  misc_feature 131: y=c or t
tttacaagaaaacctaagtcttcaaaagcacaacttttgttgcttaggactttgcatcactgttgttccagacctcacttcaacttcttggtctctgaactggttttagctagcatgcatgagagacagtyttcatgtataatgtttctgctctgtaactggaaagtggtttactttgcataaatgctgatgaaaacttcatgactatgagacttttcttctgtgtatcaagaaaaagcttgctcgttggcaagcaattcacaaggtggggacagacttgtactttaacatgtagtccattcaagcaaacc

SEQ ID NO: 25424 - DNA, 160 bp, Homo sapiens
  misc_feature 111: m=a or c
tgaggaagaaataaagtggttggaaatagaagtcttggaaatggaaaaatcatagctgttgatataaaagacacaacagacttgatgttctctagactggaaataattgamgacaaaattagggaaataggagctgagacgttcccccagcagggcaccg

SEQ ID NO: 25425 - DNA, 353 bp, Homo sapiens
aatttgggatttgctgatggtttggaggtagatggagagaaagaagtgtcaggtgtttggcctgagtattaggaggatgaagttgccattcactgcagtgggaagactgaaatgggagcagcaggcttgcgggagaagactgggaatttggttttgaacctgttaacttagagacctgttgggcacctgagtgaggatactgaatagttctggggagagagctgggcaagggggatggatttgggcattgtcagcgtatagatgttatttcatcatgagactgggtgagaagcacaagggaactagtacagttggagaagagatggagtctgcaaacctgaggtcaggagaaa

SEQ ID NO: 25426 - DNA, 167 bp, Homo sapiens
ttaataaaaaggaataactgttccaaagactcagactaacatacaggacagtcagctggatgtgataaagattttatcacctcatatggaaaacaccggctgcactggattcatcagtgttaacttcctttgaggaagctgccttatagttttcatcactgggacca

SEQ ID NO: 25427 - DNA, 145 bp, Homo sapiens
  misc_feature 1: s=g or c
  misc_feature 4: v=a or c or g
  misc_feature 5: r=a or g
  misc_feature 56: b=c or g or t
  misc_feature 63: b=c or g or t
  misc_feature 73: s=g or c
  misc_feature 75: r=a or g
  misc_feature 92: k=g or t
  misc_feature 110: k=g or t
  misc_feature 115: s=g or c
  misc_feature 117: s=g or c
  misc_feature 118: k=g or t
  misc_feature 121: w=a or t
satvrtctaaagtaaatgtacttcattataaatgaaatatttcactttaaatatabagagaabatggtttgasargctgttttagaacccakgaacaataatcttttggkagtasaskagwagaaaaacacttataccaaccgta

SEQ ID NO: 25428 - DNA, 162 bp, Homo sapiens
  misc_feature 2: w=a or t
twattgcggtaactagactttccagaatggttttgaattatggcaaatactttatatctgaatgtagtggacatggctttgtgatttaaaaggtcttcatttttaaaatatgtccactacattttttattgttttattgttattggagataatttacagagc

SEQ ID NO: 25429 - DNA, 72 bp, Homo sapiens
ttatttatttaattcctttaaatatctttgacctccaaatgcataggcactgttctaaatgccagggatcca

SEQ ID NO: 25430 - DNA, 124 bp, Homo sapiens
taaaaatgttcttatgacttttggtcatagaaggtctatgaaggagcttccatggccaaacatatttagaaactctcactttctaaagcttgacaaggtatattagcatctgaaaccccaagga

SEQ ID NO: 25431 - DNA, 331 bp, Homo sapiens
  misc_feature 216: k=g or t
  misc_feature 297: k=g or t
  misc_feature 298: k=g or t
  misc_feature 309: m=a or c
caaaaggacagaatattaagtttgttaaaatacaccaaacttttccacccttaaaggatatggattttgagtagctccttgcctcccctgtcccctttgagttttttttttaggctgaaagacccttggaggagtgtctggagaagacatggaagctccgtacccctccctcataccttgccctatgcatcttttctgtttggctgtttctgagtkgtatcttttatcataaaagggttaaactgaagtccagtgggacagcagagcaagcccatgattacaggcaatgtccaccakkcattccctgcmaccccattcccattaagcgcca

SEQ ID NO: 25432 - DNA, 200 bp, Homo sapiens
  misc_feature 47: b=c or g or t
  misc_feature 163: r=a or g
tagtaatccttctatatcacagccacacaagtgcttagagttcctgbctgagatcagtctatataattatattacacttctcaagtttagtagtgctagacaaataggaagggagttttacattctttgtttatttgcaataatttcatgattgtcgtaattraactatagcccgagtttaaagaagaagccagccaaaa

SEQ ID NO: 25433 - DNA, 212 bp, Homo sapiens
agcgttctctggtagcgaccattttggttaatgttgggtgtgtttctgcggtttgtgaggtcacctcatcctaacccgaatcctgaagcagcgagagagcggcgactgttcacaggcatcatctggctgcaaagaagagaacacactgtgtttgagggaggaggaaggaggatcagagtttaaactcctgccataatgcagggcacggtggc

SEQ ID NO: 25434 - DNA, 118 bp, Homo sapiens
gtataaattcctggacacatgcaccctcccaagactagacaaggaagaaggcgaatccctgaatagaccaataacaggttctgaaactgaggcagtaattaatagcctacccaccgca

SEQ ID NO: 25435 - DNA, 148 bp, Homo sapiens
acgaggccgtgggtacgaccggaagccgcagactgaatctcgctctgttgcccagcccatctcggcccactgagacctccgcctcccgggttcaggcgattctcctgcctcagcctcccgagtagctgagattacaggcgcccgcttc

SEQ ID NO: 25436 - DNA, 140 bp, Homo sapiens
tatacaagaacagaaggttttgagagtttggatggagtctgtgaaagtcatgattgaagtgagaactgaaagaccagtagttgtaacttggtaaagagttgatggtcgagggtggagagatagattcttggtgaaaggtg

SEQ ID NO: 25437 - DNA, 269 bp, Homo sapiens
tattaaggtttattgggcactgaaacaacttgagagagaatgaacagtctccattcctagacgtatttttcaataattttatatccttaattccagtgctttcacttttatccaagtttcatacaggcagcattacttccatttattttaagagattggagcacattggtttgcaccatcgatagcacattttgaaagttgagctacagtttaggataaagttaacctaagaaggttttaaagttaaatgaaatttaaagatgctgaac

SEQ ID NO: 25438 - DNA, 309 bp, Homo sapiens
cttttcaataacatttctattcagtgacattcgtatatttaataacatttggatattcatgtgagagaagaaaagaaaattataacacagacatcaattcctggtacactgtagatgtaaattcgaaagacttaacaataaagcttctagaagataacaccagaaggtatcttggtgaccttagggtggggagagacttcttttaaacaggacacagaaaacactaaccatgaagataaggttgaaaatttgaactgtgttaaaattaaaaactttcagtcatcataagacaccattaaagagggtagg

SEQ ID NO: 25439 - DNA, 460 bp, Homo sapiens
  misc_feature 336: w=a or t
  misc_feature 337: y=c or t
  misc_feature 364: b=c or g or t
  misc_feature 365: n=a, g, c or t
  misc_feature 381: r=a or g
ataaatatggagcttcaaagttgttcctttcagtattttaaaagattactttgtctctttgcatctaatatttgtattgagaaatactatttcattcagatttttgtctctttggagatcataaactctttctggaaggcttagggttttcctctgtcttagatttccctatcatgtcaatctccttggtttgtggtctgccagtcctggaggtttgactgggagaggaggtagaggaataaatgtccaaggggccaatgaaccttgctggtatactccagttccctaccccactgggctttgggctgcctaatatttaatatcataccacaggawyaaggctgttgctgctggtttctgtgabnttccaaggcaatgcargtggagactagcgtgaagtttaaatgctctccctcagcctgctctctccctctgctgtctctggctgctcatagcacca

SEQ ID NO: 25440 - DNA, 126 bp, Homo sapiens
  misc_feature 2: b=c or g or t
cbtttcatcgttgatgtgcagaacaaagtatgctgcttgggaaattataaacatactttcatttgaaatattgggtaatatcaggagtcctttgctttaatagaagtagatctggaattgcttttt

SEQ ID NO: 25441 - DNA, 184 bp, Homo sapiens
atagtttctttatcattttggctttagtttggatcctagaagggaaacaggatgaattataatatgagaaaaagaatctgtacatatactatgatattactagaggaattgcctgttttagtcaaagccaaccttatgtcttgtatttcttgtgtatcatgtgaagtgtgtatgtgtgtgttga

SEQ ID NO: 25442 - DNA, 436 bp, Homo sapiens
  misc_feature 113: d=a or g or t
  misc_feature 227: s=g or c
  misc_feature 228: k=g or t
  misc_feature 229: k=g or t
caatgggtgatttcatgatacaattatagtagcaggtagtactaaaaagaggaactattttctccttatttaagaactttttataagagaactctagtttttcaaaattctgdttaaaatgggccacccagaactggacacactcttctgttgttcgttagtgttcgccttagatggccccacctctctgtcccctctctctagctatgtatatttcttttcaacaskkaagttgttagattgctgtccttgattggttttctgttttcagtaggccagtccccagctaaattgggtgaccaacttggctaatgtccagttttatctaaagtgatgttccctgtttgcacagatgactttttaaaatctcctgcaaatgtgatcccctttagagccctacctgcatggtttgaatagcctcagtagccaatttcac

SEQ ID NO: 25443 - DNA, 64 bp, Homo sapiens
catatatttgttggccatttatatgtcttcttttgagaaatgtctgttcagattgttcacccca

SEQ ID NO: 25444 - DNA, 250 bp, Homo sapiens
  misc_feature 144: w=a or t
  misc_feature 162: y=c or t
  misc_feature 212: s=g or c
tatttgctcactagtttttttccaatacattgaacaccctcttggtgcaatgtgccatgcttagttgttggggattacaaaggtagaatattctacctcaaagggcatagaagtgaatttttttttttaaaaaaaaaactacawtacaaggaatagagtggycatttgcaaaataaaatttttattgaattgctgaagcagtaaactctcasctgggagggtcagggaaggctgaggagggatggctaca

SEQ ID NO: 25445 - DNA, 424 bp, Homo sapiens
  misc_feature 59: w=a or t
  misc_feature 60: w=a or t
  misc_feature 316: w=a or t
  misc_feature 349: v=a or c or g
  misc_feature 404: w=a or t
  misc_feature 413: k=g or t
caatgtctttaataggtatagggctgtgtaggtatttctgtttcttcttgtgtcactcwwgacaatttatgatattcaaagatttttctgaagttgccaaatttattgacattgcattgtaaccttactattcgtttaataactaggatttattgtgatgcttcctttcccctttttaattatacctttggttgctcttttattttcttaatcaattttgctattagtttttcagttttattcagcttattaaagaacaatgttaacttttttttctattttctatttcagtgttttatttttatgattccctttwaaaacactttgggtttaatttgctgtccttttvctctttcttaaagtggaacctaggtcgttggttttacacctttctttcagttatwttatgataktgttccattgc

SEQ ID NO: 25446 - DNA, 330 bp, Homo sapiens
  misc_feature 103: b=c or g or t
  misc_feature 105: y=c or t
  misc_feature 217: r=a or g
  misc_feature 227: b=c or g or t
  misc_feature 236: b=c or g or t
  misc_feature 246: r=a or g
  misc_feature 309: w=a or t
tattagctttggtgatttggggagactggctgattataacattgattttctttgatatatatgatatatatatcatatatatcatatatcatatatatatttbcycaaatttttaagtgtccatcataaaaaaaagtatctgaaaacaatttctcataatttaaactttcttttgcttccccacacctaggtatgagacccacaactgacatgggarttggaaaggbagtgacatbggaattggaraggcagtaacatgggaatgggggtaattttcgtggctcattcagttggatggtctggggtcawagtttttattggtgggacgca

SEQ ID NO: 25447 - DNA, 101 bp, Homo sapiens
attaataatctaacctgaaaaataatgaagagaatcctgactgatgaggcatctgaaggattttatttacagatacctcaaggattcaaaatcaagggatg

SEQ ID NO: 25448 - DNA, 205 bp, Homo sapiens
  misc_feature 90: r=a or g
  misc_feature 91: r=a or g
  misc_feature 152: v=a or c or g
  misc_feature 186: s=g or c
tttaaaatcttaaggtcatagaagtgtcctctgtattactttttaaaaactgtactgttttatgttacacattggcttctatatgaaatrrtttttgtgtatgttgtgaggttggatgttaatattcatttttatctgtaccgatgtatgavagacagcacaatttattgaaaatgaatcttttcstcattgtactgaagcgtga

SEQ ID NO: 25449 - DNA, 198 bp, Homo sapiens
tcaattgttgtcactatgcattcttcaatgaaaactagcttatttttccatatagtaatgcagttagggttctcagcactttctttcttctatcctttttttaactcttcatattatgttcagatgatcatactgtcaaggtttgtgtacattactgaaaatttgtattgtataaagctttttgcattacgaggctag

SEQ ID NO: 25450 - DNA, 230 bp, Homo sapiens
gtaaaatgtactatggaacagaccttgaaggctcttgctactttggaaatctgagaaagggaagccataaacatgaggagcactgttactctccataaaacagcattatgctgttgattttcaaatattcacaaatgcttcttggaatgtacttttccatggattagtgtgttttatgttgaaagtgcattttttttcatcagcgagtttgcttttaaaatcaggtagaa

SEQ ID NO: 25451 - DNA, 138 bp, Homo sapiens
cacttcttgataggattgtattgaatctgtgggttgctttgagttgtatttttatcttaaccatgttacaacttccaacccatggacacaagatgtctgtccattgatttaggtcttcctgaatctcctcgagcattc

SEQ ID NO: 25452 - DNA, 181 bp, Homo sapiens
taagtattttattggatcaggtagcagaaatgcaagatgaattaagttattttctagtggactctgctggccaggtggtggcaaaccaggaaggcttgttccgaagcaattgcatggattgtctagatagaaccaatgtgatccagagtttgttagctcgtcgttcacttcaggccccatt

SEQ ID NO: 25453 - DNA, 469 bp, Homo sapiens
  misc_feature 300: b=c or g or t
ctgttcatattgggttatatttgcccggatcttcatcagtcttttttgttaatcactgtctattatgtatcacttcttccttcattgagtttttaaaattcatgtggcatatatttcagtaggcttttcagtgagggtctgttatcctgaagtctctcagtctttgagaagtctttaattcactttcattcttggatgataactagaaatcaaattccagattgacagttatttttctctattattttgaagctactgtattgtctctgatttctatggctgctatggagaacttctacbagcaggttagattcttgtgggtaaactctctttttctttctggttgcttttaagctttttctctttgtctctgttgttctgcagtattatttttatttatccctggctcgctgcatttcctaaatgtgaagattcatgtctcattaatcattttcagccattatcactt

SEQ ID NO: 25454 - DNA, 207 bp, Homo sapiens
tgaattgtaagcattctttaaatattctagatattaacacaagtcccttatcagatacatggtttgcaaatatttttctcttaatctatggtgtttcttttactttcttaattaaagttttaaattttgatgaaatcagcttacctatttttttcttttgtcatttatgcttttgatgtcatatttaagactttgtgtggcccggtg

SEQ ID NO: 25455 - DNA, 158 bp, Homo sapiens
tcttgaaattttagacaaactttctgcctccttggaaagctctacatctccttgtgattggagtgtgggtttcaagattccagaaggtgggtgtcttcattttctattttcaatgcactctaaagatgacctgcttacaggttctctgaggcagacct

SEQ ID NO: 25456 - DNA, 206 bp, Homo sapiens
gttgcaatgatggggtctaagataacacttctggaggctgcaggcgagaaacacagctgatatcatcttttattgtgtgttgttatttgcctagcattataaattaaggaggaatagtaacaaagagcttgaagacatgcacagctcacaggccccgggtggaggctggcgacatcagacagacagaaccaagacatctgaggagc

SEQ ID NO: 25457 - DNA, 219 bp, Homo sapiens
acagttctcggaaagtggtgaaggcacacgcttccctgcatggtgcccgcctctctccactctctagaaatattagaggctaggctgctgctgtatgtcagggctagtccctcttctatgaatccagaataactctgaagaagccgagtaacaggcatgaagtgaagagaaatcgctgtaacaggaagacagcaaagcagatgctaatgaccacacagt

SEQ ID NO: 25458 - DNA, 280 bp, Homo sapiens
taaactatgacataagtataaacaaaaaaataaaataagtaaataaataaataaaatttagattaatttgctgttacatttttatataagctatgtttatgacagactttcctataatattcttatcataatgttcttgcacttgaaagaatgtgcattctgcagttgtgtgcaggtgttatgtgtatttcaactgggtcaagtttgttaatcaggttggtcaaattatctacatctttactgatatttttgtctgtttttctataaattactgagagag

SEQ ID NO: 25459 - DNA, 121 bp, Homo sapiens
ccttttactccagcttcatcctccataaccaccattctactctctgctcctgtgaatttgaatgttttagcttccacatacaaatgagaacatgcaatatttgttttcctatacctggctg

SEQ ID NO: 25460 - DNA, 266 bp, Homo sapiens
  misc_feature 106: w=a or t
  misc_feature 124: w=a or t
  misc_feature 125: k=g or t
  misc_feature 128: w=a or t
  misc_feature 141: r=a or g
  misc_feature 160: r=a or g
atatttcattttctgtacttagtccgacctcagttggcttaaattttaatatagctaaagttttaatttttttccagatttgaactacaaacttaaactatgatcwttataagctttttgttgwkgtwgttgttctgtcargcacataacacagctatargttcataaaagacagtaactgtaaggttttgacaggggaagaactatgaaaaaatgtgctttcaaaacttgaatacaccatatacaaagtagaaatgcctggtgcc

SEQ ID NO: 25461 - DNA, 246 bp, Homo sapiens
atgagagcatcccaggaccactgaacattcagagggctggaggcagagaaaaacttcccctactcaagaaaaagaagctatttttgtcaagttaaatgagcctgaacctgcagagctgaattggcagatgaatattgctaattggtgcagtttcttcggtgcaggaaagagtttccaatcagaccggcaattcatcggccacatgaagactcagcctgcctgcacccaggtgaaataaacagcact

SEQ ID NO: 25462 - DNA, 331 bp, Homo sapiens
tttttagtagagatagggtttcaccatgttagccaggatggtctcgatcttctgacctcatgatccacctgcctcagcctcccaaagtgctgggattacaggcttgagccaccgcgcccggcccatatcctgccactttactgaatttgtttaatcagttctaatagttttttggtggaatctaggtttttccaaatataagattatatcgtctgcaaacaaggatcatttaacatcttccttgccagtttggatgccctctatttctttctcttatctggttgctctagcttgtgtttgtttaatatttcaataaagctttcaatacaat

SEQ ID NO: 25463 - DNA, 448 bp, Homo sapiens
  misc_feature 385: n=a, g, c or t
  misc_feature 386: d=a or g or t
  misc_feature 426: k=g or t
atcttaaaacagtaatcggcccatatgtgcagcaacctttgcacctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtacaaggcgagatcgacgtgtgttcattcccatccatggtattaatcndttattcatttaaaaaaatctgctaacggaaatatttccaktcagctcattaatcaattgtga

SEQ ID NO: 25464 - DNA, 129 bp, Homo sapiens
agtgagtctttttgtgttactccaaaataaaggcaatgatttatttttttcccagtgccaatacaattttgagctaagcactcaaggtggatactttacattttaaagctggaatcagcaacagcccgc

SEQ ID NO: 25465 - DNA, 420 bp, Homo sapiens
  misc_feature 7: n=a, g, c or t
gtttaanaggaaatcagaacataaaagtttggaaaatttgcagtctgaccatgtggtataaaagtaaaacccattttctggaaagaaagtcaagatggctgcagaaatttacatacgtaatgaggagccaaatgttaatagccaagacaatggggaaaatgtctccaaggcatgtcagaaacctactgggaagcttctcccgtcacaggcctggaggcctaagagggaaaaatggttttgtgcgccaggccagggacctgctgctttgtgcagcctcgggacttggtgctccatgtcccagccactccagccttagcagtggctaaaaggggccaaggtatggcttagcattgcttcagagggtgcaagccccaagccttggcagtttccacatggtgttgggcctgtggatgcacagaa

SEQ ID NO: 25466 - DNA, 138 bp, Homo sapiens
tgtaggatcagtttggtgggtctcaagtttgtcttggcccatctgagaggcaaaaaatagtacttcgctttcatttacgtatcactaattatgactaattttcagcatcctttcaaggttattgactttttttttttt

SEQ ID NO: 25467 - DNA, 400 bp, Homo sapiens
  misc_feature 324: r=a or g
tatgattatattcactaaagactcatcacttacataatttttctctaccacaaatttacttgccacttaacaccagcaattttgtaggctggcctctctctgattgtctgatcatcacccatccatacaatatgtatgcaaagtaagttgattacaaagagaaatttcagatcttgcaaaagagaaaataattcatggactccatgaaagtgacattgggaaactgctggaatcatatgccatggcccaattaagatctgagttaagccaaataaccattaaagaagagaaaattgactaagatattgacttgataggcattaragagaaatattaggaccttttagggattaagggaagtctttagtgaaaagagatgctctaaatattttggggaaaa

SEQ ID NO: 25468 - DNA, 292 bp, Homo sapiens
ttcaattgtttgcagtggtcctctcgaggggttgtaatgagttgacatgcaccagaacagatagaatgcactgccagctggtagtttactcttgtacaggaaggctgcttttctaacacacaactctttgttgtgttaaagagaaataaatatataaaagcctaaaagtaagctttcaattctttatgtctggcaaaattgtcagtacaatgtgccttgaggatatatccatggtgctgtcttacaaggttattacgaaagaataagctcatactataataaccaccccaat

SEQ ID NO: 25469 - DNA, 257 bp, Homo sapiens
caataaacgtttattgattgagtggtgcctcttgccttctaggggcagtatggggaggtggtttagagtgtggaatatggagtcattgcctgctgtccaacactggcactcaaacctgctggttccatggtgatgctagtatctttgagcttccatttccttgtctgaaaaataaagtaattccactatcttaaggttctgacataatgaataaatgaaataatgcaagttattatctcatttagcacaatgcccgg

SEQ ID NO: 25470 - DNA, 141 bp, Homo sapiens
  misc_feature 57: y=c or t
  misc_feature 113: y=c or t
  misc_feature 120: w=a or t
  misc_feature 129: s=g or c
aaagccctgaagggtcaaaagaaatacaaaagcaaaggctattttcttttttttttyctttctttcattccttccttcctctgtttctttctttcttcctttcattttttttyctttttwaagagcgascggctctgcggt

SEQ ID NO: 25471 - DNA, 389 bp, Homo sapiens
cttttcaactattcaatatcaggaaggacacacactagctcatggggtaactttggaaaatacatctcaatacaccccagagcacagctcatacctttcccttagtgtttcactgcacttctcaaaaaagaaaattaagttgttgcttttttttctcccttgacaggtcaatctgtgtattagaaatggagacttaatttaccaactctagaatggtattaagaatctaagttcaggagtaagccactgctcctgtctctggccattctgagacctgtgcataagtaatttatgtataaggcatagtttgagagactggagcaattatttagaatatgaagacgttctaaatttgtgctacagcaatgtcatccatctcatgggcccct

SEQ ID NO: 25472 - DNA, 193 bp, Homo sapiens
acccaggctggggtgtgattgtggctcactgcagccttgaactccaagactcaagcgatcctcccaccttagcctcctcaatagctgggactacaggtgcataccaccatgcctggctaatttttaaaattttttgtagagatggagtttctgtatgttgcccaggctggccttgaactcctgggctcgggta

SEQ ID NO: 25473 - DNA, 234 bp, Homo sapiens
  misc_feature 157: w=a or t
  misc_feature 168: k=g or t
  misc_feature 181: y=c or t
  misc_feature 188: w=a or t
  misc_feature 192: y=c or t
  misc_feature 194: k=g or t
  misc_feature 204: y=c or t
ccgatatcctatttaaaattgtgttttgggggtagctctctttattactggtcactgtcttataaaaccagagatgacatatctgtaaacagagcttgagaaatgaacaaggcccagtggaagcagaaaatttgatgagattagatttttttttttwagcttctttgkgtaccacagattyctattgwagtyckggactctgtyccctgaggattatcataaagaaggggggcc

SEQ ID NO: 25474 - DNA, 157 bp, Homo sapiens
gtgctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggttctggcgatggttgagacgccc

SEQ ID NO: 25475 - DNA, 104 bp, Homo sapiens
ttacttttcagtctgtatgtgtctatatgtttcttgtaagcataatatttttggatcattttttagttcgttccatcaatctacctttcttttttttttttttt

SEQ ID NO: 25476 - DNA, 439 bp, Homo sapiens
  misc_feature 305: r=a or g
  misc_feature 307: r=a or g
  misc_feature 308: r=a or g
  misc_feature 411: n=a, g, c or t
tttcctttttgttacaacaaggctgctgtaggcatgcctttataatagggcagctctttccattagattcttgtttagagattcttattatcaaccttgaaatgggtggtgttattgttggagcttaatattaaacatgtcttgatttacataaataattaccattaaaactatcacctcaaggccaggcgcagtggctcacatctgtaatcccagcactttgggaggctgaggtgggtgaatcagttgagctcaggagttggagatcagcctgggcaacatggtgaaaccccgtctttactaararratacaaaaattagccaggcgtggtggcgcatggctgtagactcagccactcaggaggctgaggcacgagaatcgcttgaacccaggaggcggaggttgcagtnagccgggattgtgcactgcacttcagct

SEQ ID NO: 25477 - DNA, 118 bp, Homo sapiens
  misc_feature 24: r=a or g
  misc_feature 45: r=a or g
  misc_feature 111: d=a or g or t
cacaaaatgaaacaaacaaatgtrctgcatattaccatttatctrcacagtaatttattatgaagcagcatataacagcatattcttcaatataatatttttgtgtgtgtdcccccaa

SEQ ID NO: 25478 - DNA, 275 bp, Homo sapiens
  misc_feature 14: w=a or t
  misc_feature 114: y=c or t
gttaatccagcaawaagaaatgaaaagggaaaaccacatagaagggtaatcccggaaatgcttcatctggtggactgtgggagcagaggcattgccaggacttgggaaacagtyactgtgaaatgcgctgcgtatctcattcactcacttcagctaatgattccgacttggcagacgctaaactcatggaggttcggtttctcctgatacaaaccaaatggctacctggaagaatttctttcaagcaacagttatttttcttatcttcagggtat

SEQ ID NO: 25479 - DNA, 176 bp, Homo sapiens
  misc_feature 11: b=c or g or t
agctgtcaacbgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagcgg

SEQ ID NO: 25480 - DNA, 436 bp, Homo sapiens
  misc_feature 19: s=g or c
  misc_feature 410: r=a or g
agacgatgtatatgcgaasacacttgatagctggtattgtcatgattctgattatttcactactgctactttccctgtggcctaggctttgcctatttccagtgggcgagctagctagatcctcctcccttaaataagccagtgtttttaagacagaatactacttgcatagtggacaataatatcttaaagaactgagcaggatgaaaagaatttgatagaaagcaggtttgaggagcacattggaggttggcaggtttcgaggctgcttgagaggacttgggccgatctgggctgggcttggacgtgaccctggcacccaggcaggtggatcccagctggggcttccattcacgactttctggtccctggcaggacagagcgggatgccaccagcttgtccaaagggragttccaggagctcctggtgggcatc

SEQ ID NO: 25481 - DNA, 241 bp, Homo sapiens
  misc_feature 27: s=g or c
  misc_feature 134: r=a or g
gtccagccgctcccattccttgcgcascaatcgtctgcgaacggttcgccggcgaatgctgcgaacaccttgcctgctgcggacgtgacgggcaggacggtgccgatctgcgcgccgatgttcagcccttccargctgttgatcaagcggatgaccatcggaccgttatgagaccacatggtcagcagcaccgtatttttgcaggcgctattgatttcgtgaagaaagggcatgaccctct

SEQ ID NO: 25482 - DNA, 124 bp, Homo sapiens
  misc_feature 27: m=a or c
  misc_feature 68: r=a or g
  misc_feature 79: r=a or g
  misc_feature 85: k=g or t
  misc_feature 101: k=g or t
  misc_feature 103: s=g or c
tttttccagttcactatgtttgtatamtaacttttcttcagccttttaatgcgaaccaactagtagarcatgctttcargatctkacagctctgctagtakascgagtatttattaatacagaa

SEQ ID NO: 25483 - DNA, 132 bp, Homo sapiens
  misc_feature 10: h=a or c or t
  misc_feature 22: k=g or t
  misc_feature 124: n=a, g, c or t
  misc_feature 125: k=g or t
  misc_feature 126: r=a or g
cttactagthtctctgtgagakaaacttccactccattggaaggattaatagagcctggaggtgggattttctcctagttgaatctgatacacaattctggcttctaggttgcggctcccgagnkrgtggca

SEQ ID NO: 25484 - DNA, 293 bp, Homo sapiens
acacagccctatcggctgtactgggctctgccttttgggcagctcgccggccactccccaaaagcagagcattccatcctttctctttttaaacccacgtcatcatctgatcataatggaaatcaatctcctcaaaccaccatgcaaaggcgtatccatggcaacctcaaaaggaaggacacagagatgatgcttcagtggctgcagcaggaaaagctcttcgcctctcggtaccttaagtatacctgagtagccagtggtcaacatgggtttgctgctctcctcactgcttg

SEQ ID NO: 25485 - DNA, 376 bp, Homo sapiens
  misc_feature 176: k=g or t
  misc_feature 177: k=g or t
catctttttagtagagaatgggggtttcaccatgttggccaggctggtcttgaactcctgacctcaaatgatctgcccccacccctcggcctcccaaagtgctggtattacaggcatgagccaccacgtccagcccaggtgcagtttaaaaacaattttttcgacctgcagttggkkgaatccgtggatgcaaaactcactgataaggagggctaactctgtaattgagccaagagcaaaccttgttcacaggaagaatgcaacatccctacagttttggggaaccactctttgaatccccaaaaccccttaagagtatatgtggcttagtggtagaatatacctgtgggtaccccagctgacttgttagtggcta

SEQ ID NO: 25486 - DNA, 167 bp, Homo sapiens
atgaattaggacttccttattccaacctaaactgtgtttataaaagcaattgcatacacaccaaaaaaagtctattggtttttaagtctacattttaagtaacaagttaatgggcagttgtttaattggggttttacttcactgttgtacttttaaaggggctgtcg

SEQ ID NO: 25487 - DNA, 244 bp, Homo sapiens
  misc_feature 114: k=g or t
  misc_feature 121: k=g or t
tatatgtcatttgtcatgtgttatggtagtaaaggattatttttcatttgaacctcagtgtaaggcaagaactgtcctttttgttgctccccacagtgtcagtaaagtgttttkgcatcakacttaacagacaacagatactttgcatcatacttaacagacaacaggtgattgttaagtgaaatgaatgggccttaaactagtaggatttcttcaggtgaaagtggtaggggcaggcaggcac

SEQ ID NO: 25488 - DNA, 98 bp, Homo sapiens
ttttttatgttgctaactcacttattatagccagcagtgtttttgtagatttcagtggactttctacatagacatgccgtctataaataaacccttct

SEQ ID NO: 25489 - DNA, 274 bp, Homo sapiens
caagttcaaagttccacagatccttagagcagggacacagtgccgcctgtctctttgctaaagcatagcaagagtgacttttactccaattcccaataggttcctcatctccatctgagacctcctcagcttggacttcattgtccatatcactgtcagcattttggtcaaaaccattcaaaaagcctctaggaagttcatcttcctttcttcttcctagccctttaacctgttcaaacttcggcccattacccatttccaaagctgcctccac

SEQ ID NO: 25490 - DNA, 327 bp, Homo sapiens
  misc_feature 25: k=g or t
  misc_feature 26: w=a or t
  misc_feature 88: s=g or c
  misc_feature 89: r=a or g
  misc_feature 257: r=a or g
cttttgctcctcctcctgccatgtkwgttgcctacgtccccctcgtcttccactgtgattgaaaacttcctgagacctccccagaagsraatgttgccatgcttcctggaaagcctacagaaccatgagccaattaagcctcttttctttataaattacccagtctcaggtatttctttatagccgaataataatggcctaagacagaaaatgtcacaaaaccaaacaagcaaacaaacaacgagcacatcactgtrataatgatctcctcactcttctgaacttttaagtttcctcttcttggaggttactgtcttcaccagacgc

SEQ ID NO: 25491 - DNA, 208 bp, Homo sapiens
tacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcacccatgt

SEQ ID NO: 25492 - DNA, 171 bp, Homo sapiens
caagactcatgttagttatttttaataaaacaggtattgctctctctaagccagacctgattacttatctggagcaaggaaaagagccctggaatatgaagcaacatgagatggtggatgaacccacaggtaggtgagagtgaatacaacagacgacaaggatgatgaggg

SEQ ID NO: 25493 - DNA, 167 bp, Homo sapiens
caagtgctgattctatcacttatctaccagctctgtgaccttgaacaagccgcttaaccttgctaagcctctgttttctcatatgtcaaatggtgataataatgcctacctcccgaggttgttgtaagaattataagcacaaatgtatgtaaagtgcctggcaccgg

SEQ ID NO: 25494 - DNA, 177 bp, Homo sapiens
tatagatattgatgagaatcttttagaagtagaagcatttacagaagaggaaatggatatgcacatatcagactatgaagaagacattgaagaatctgttggaggtttcagaagtcccagtcttgccatttgcatgatgactttaccacagcagttagaagaagagttcacagaagc

SEQ ID NO: 25495 - DNA, 152 bp, Homo sapiens
  misc_feature 8: n=a, g, c or t
  misc_feature 62: m=a or c
  misc_feature 63: w=a or t
  misc_feature 90: w=a or t
  misc_feature 91: h=a or c or t
atagtgtntttctgaatatataaccaagcattttctctggactggaagccacatttgatccmwggttctcagaaatctgggtttggtggwhtctgtctttatagatacttgtacacatcacaaaatcaccaaatttggggaaatgccagacc

SEQ ID NO: 25496 - DNA, 208 bp, Homo sapiens
catatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaagggccct

SEQ ID NO: 25497 - DNA, 114 bp, Homo sapiens
  misc_feature 12: s=g or c
  misc_feature 53: s=g or c
  misc_feature 80: k=g or t
  misc_feature 98: k=g or t
caggaggctgasacggaagaattgcttgaacccaggagacacaggttgcagtsagctgagattgtgccactgcaccccakcctaggtgacagagtgakactccatctcaaaaaa

SEQ ID NO: 25498 - DNA, 238 bp, Homo sapiens
ccgggtgaggtggggcacacctgtggtctcagcctcccgagtagctgggactacagatgcccaccaccacgcccggctaattttttgtatttttagtagagacggggtttcaccgtgttggtcaggatggtctcaatctcttgacctcgtgatccacccgccttggcctcccaaagtgctgggattacatgcgtgagccaccgcacctggccaagactgtcttaaaaaaaaaaaaatt

SEQ ID NO: 25499 - DNA, 172 bp, Homo sapiens
tatattccttttttcagccctgtagacatgaactgatcttcccttgaagatacaaacacatggccattttttgtttgggattttttgtttttcaaggtttttcatttttgtttattaggtggatttttttccctgggtactagctctgtgaaggagataaaaagcgcaattg

SEQ ID NO: 25500 - DNA, 235 bp, Homo sapiens
ccatactgagtgtgaaagtcacgctaacagtggctgattctagcaaaacattacagtctgagctaacaggattacttgttctaagtcccatgttaaaatagcttttgtcctttcctttggaaatatcaatctcacattcaaaaaactagcttcaacttagtgcctggacttaaaactaagtcagagaaaaatacatccacccagctccctgcgtccaggtacagaaatacccccc

SEQ ID NO: 25501 - DNA, 196 bp, Homo sapiens
ccccacgtctttgacgcggtcgatgatcttcaggtgcccggagctgtccaggaagccggcgtcgctggtgtggtaccagccgtcggcgtccagcacctcggcggtggccttggggtttttgtagtactccttgagcagcccgggcgagcgcaccaggatctcgccctgctcggacagcttgatttccaccccctct

SEQ ID NO: 25502 - DNA, 472 bp, Homo sapiens
  misc_feature 367: k=g or t
  misc_feature 401: k=g or t
atctctctatccattgaccagtccatcttattttggggatgcattttgtagtaaattgcagacatcaatgtactttacccctaaacatctcagcatacataggcattaatttgagttcaatatttgttcatgcatttttttgatgataatatttatattaacagtgaaaaatgcacaactcttaaggtatcacctgataagctttgataaatgcctctatctgtgcaacccaaacctctgtcaactatagaacaaaaagttttattacctaattaattccctcgtgttgtttcccaatcatcccaacacataccccctcgcaagtgatcacagttctgatgttttctcactgtagattagttttgckttttctggaacctcatataaatgggataatcagkatgactctcccttttgtgtgaatttcatctgcatggtgacatgtatcagtagtttgttatgctgagcagta

SEQ ID NO: 25503 - DNA, 338 bp, Homo sapiens
  misc_feature 232: s=g or c
taagctggatcgatgtcatctgaggcagcataatctccagcagtgagtgcctatccaggaaaatgtcatctaggatatgggtcttgagtatttcttttaagtaaatacagactcaggttgatgtgggtcttagcatttgccatgattgattaaaacaatggcttgtatggagggttggtgcctccagatgataaaacaacaaaagcacccataccagcagtaagatcagcasgctgagcatggcggctcatgcctgtaatcccagcactttgggaggccgaagcaggtgcattgcttgagctcaggcattcgggaccagcctgggcaacatggtaaaa

SEQ ID NO: 25504 - DNA, 142 bp, Homo sapiens
accaaaacatgctcataccctctcacagaggagggttaatgccatgatctagttaatgcattcagctctaactctaggatatttgggtgatatctatgcctctttttgttctgtcagcctataaaagaaataagaaggagat

SEQ ID NO: 25505 - DNA, 187 bp, Homo sapiens
attatcagctagaacaacgccttcttaaaacagccaaagaaaagatggagcaattgagcagagctctcaaagaaactgaaggaggctgtccagataccactttcattgaagatgcagttcatgtgctcttaaaaactcggcgcattctcaagtgttcttatccatatggatttttcttggaacccgt

SEQ ID NO: 25506 - DNA, 346 bp, Homo sapiens
  misc_feature 318: m=a or c
  misc_feature 326: m=a or c
  misc_feature 329: m=a or c
aaaaatatataaggtaaaatgaatgaactttgggaatattaaaatatgatcaaatttgacacatttaaaggtgtaaattaccaaaaacgtttggtggatagcccacactactttgcctctagttgtaccaaattttcttaccattaaaaggactgtgaattggagaatcaagaggcacatgagcaagatggaaatgatgaactaaaggactctgaagaatttggtgaaaatgaagaagaaaatgtgcattccaaggagttactctctgcagaagaaaacaagagagctcatgaattaatagaggcagaaggaatagamgatatagmaamagaggacatcgaagtca

SEQ ID NO: 25507 - DNA, 134 bp, Homo sapiens
tttaagttttagcgtacatgtgcacaatgtgccggttagttacatatgtatacatgtgccatgctggtgtgctgtacccattaactcgtcatttagcattgggtatatctcctaatgctatccctccccccgct

SEQ ID NO: 25508 - DNA, 94 bp, Homo sapiens
  misc_feature 49: s=g or c
  misc_feature 94: k=g or t
tacaatttggtaagttttgatatatgtatacatcataaaatcacctctsataataagtatattcattatctccaaaaatgtcatcatgcccctk

SEQ ID NO: 25509 - DNA, 205 bp, Homo sapiens
cattttttcaatatttatgtttttggctaaatgcacaatcagggttaaataacattcacttttgggaaaaattcttagctgtccctaaaatacagttataccatcattgttcctgtcttactgaaatagtttttttagtatagaaagaatatttgaataaactagaatagaggtaacttaacatatctacatatgaaggaacaga

SEQ ID NO: 25510 - DNA, 190 bp, Homo sapiens
  misc_feature 11: n=a, g, c or t
  misc_feature 123: n=a, g, c or t
gggagcttgcnccttagggattggtggattcttggtttgattcccccaggatgctaatgggggaatgcctggagttggaattgatgcccactccagcgctttgtacccctccagtggaacgantgcaacactacacaacacacccagcacaacacactcagctcttaaggctgacacaggaacccggata

SEQ ID NO: 25511 - DNA, 374 bp, Homo sapiens
atgaaaaatacaaaaatttgatactgacattctcttatatgatgagagtttcatttgcgtttcaaaaatggtgttatgatacttattttaaaatgaagattgcttttcatttccattaagttgctaaaatagatagatgtgatctgcagaagttgtttagtcttcatctgaatttcaggctgggagggagcaatataactaaggacaaaaaatgttttgtttttcttgtgtatttatgatcacctaatttcacgttttgtgaaatggacagtaacctgtttcctgaaagattcctgtgggtactttttgagctgtgataatagcaaaattgtttttcggtaataatatcacactaatgcttcttttaaacatta

SEQ ID NO: 25512 - DNA, 123 bp, Homo sapiens
agaaacagaaagtcaaaacctacatgtcctcatttataagtgggagctaaacaatgggtgcatatggacagagagattgggatgatagacactggagactccaagaggagaatggaaggggga

SEQ ID NO: 25513 - DNA, 359 bp, Homo sapiens
  misc_feature 317: y=c or t
cattaacagcaaaaattaaaggacttaaattaaaaacacagggtctaatcctatgatgaaaaaataaggaaaaagtattcccataagagctataaactgctcacctatttaaaataaattacttcttcagagctgccttaaaaggttaatttattttaaacatataagaatttcctagccaaaagggatttgtactataagaaatacattttacatattaagaatagaaatgtagtatgaggctcaactgtcttagacaactgatcacacatccgctgtcatatctcctacagaccagtctcaattttactccagtytattaaaaataaataagacatgaatgtaatagattcctggtt

SEQ ID NO: 25514 - DNA, 347 bp, Homo sapiens
ctttctccctggcgtgccctggctgggcatgttttcttgacttaggactgacactctcaatataatcttaattcatttttagtctaggctgactaaatcttctgatttggcaaagcagactttcgggattgccattgttatgtttactctggatttatatcttaagttgaggctaagtaacacatttacataaatcaactcagcattagactctaacacaaaattgtttaccgagagaaaagactaattgtattgcttcctgagatttgctttcataatatattaaacctcaaaggatttaaaaatgtagcatgttctgttttaaaattaactcttctgggggtcag

SEQ ID NO: 25515 - DNA, 329 bp, Homo sapiens
cttcccatctttgaccctgggacgttctcttttcctgtaccaaaagtttcctatcaaacttctgttgaactcaaaaagattaccacagcttcacactcctgcatgaaaccttacacggttgttctagtcagtgacctgtgtcattgttgatggcactcatttggcacagatcataataagagatagcatatgatatttgtgtgaccaaagtgagatgtaacctaatgaaaaaaaaacagagttactatttctgttgcaggcattttttaatctcctaactaccagtaaacttttctgcagtctttggtgtgtaattgaaatattagagg

SEQ ID NO: 25516 - DNA, 311 bp, Homo sapiens
tatttatcaggatgtcttgaaaatcattccatatcagtccagagagatcttcctcgttctttattacacctgcaaaagtactctattgtataggtagaccatagtttatttaacatctttccaatgtgagactttttaaaaaaatatggtgcagttacaaacaatactacaatgaaaattttgtgcatgtgtattaatgttggaagtatattttcagggtaagtagttagaaatggaaggactgggtcaagagatcaacaaatatgtagttttgttgggtgttgtcaaattcatctccaaaagggttcaat

SEQ ID NO: 25517 - DNA, 284 bp, Homo sapiens
  misc_feature 10: k=g or t
  misc_feature 32: m=a or c
  misc_feature 265: w=a or t
tcctgtatakattacccagtttcaggtatgtmtttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatcttttgtataaaaaaagatgattggattwagattatcttccctcccca

SEQ ID NO: 25518 - DNA, 85 bp, Homo sapiens
tgttattatttgtcgttccaggtttttaattataaaatatttataataaaatttccatctgaatgttcttcacagatccctcaaa

SEQ ID NO: 25519 - DNA, 68 bp, Homo sapiens
  misc_feature 41: k=g or t
  misc_feature 42: r=a or g
  misc_feature 47: m=a or c
aacttagccggccggccgcgaggaccggagtcgagccggckrgtgcmtgcgatggtcacgaccgggag

SEQ ID NO: 25520 - DNA, 204 bp, Homo sapiens
taccatgaattttattagaaggccgctattatgaagaaaataatcataaattattgttttccagagaaaaaaagaagtgataataatcagttttcttttttttcctttactaaacaaagacttgagtacttactatattcctgttaatattgctaggtgttgaggatacactagtgagccaaaacagatacggtccttgccctc

SEQ ID NO: 25521 - DNA, 406 bp, Homo sapiens
  misc_feature 250: m=a or c
  misc_feature 307: s=g or c
acataaaaaggtagacggaaagtcaattagacacgcgcgcacacacgcacacattcacaagccggtgctaagtgtgcacccggcgcactggctcccgggccgcggcgggatgcaaatacaaaacagcgacgcgggaaatcgatttgtcacaaagggagaggtgtaaacgcagcgcaaaggaattgcttgcccaatctaccagccacactctctcgggaccttgccccgccaacttctcttcgccagagamacgcccaggagagcgggaacattttctagggcgctcccaagttggaattctcatcasagtaatatcagcttctagagtctcagcttttgcaacaaccctggcgccagaaattttcttatgcagcaccatcctgggactctggggcccactggcagt

SEQ ID NO: 25522 - DNA, 226 bp, Homo sapiens
  misc_feature 12: s=g or c
  misc_feature 69: s=g or c
gtatgcttagtsaatgcgtgaatctcaatatagttcttaaaatgttatcagggatgcctttatatgtasacaattgcacattgatttgaggctttttttgccactacaacctccgcctcccgtgttcaagcaattctctgcctcagcctcccgagtagctgggattacgggcacccgccaccacgcccggctaatatttttttgtgtttttagtagagacgggata

SEQ ID NO: 25523 - DNA, 267 bp, Homo sapiens
aaacttgagcattttcatcagtatctcatagtaggactgtaaatgtcaaattgaattactgccctaacttatgtgtcaagataagaaacactgagtatcagctgccactgaaatagtgcttattgcaactagtctggaatcctgtgggaagattacctatgaagattacaaactgaagaaggatgcaaatggaaagaattttatgaaagattgaaacataattctaaatttcagaatttctggggtcagaagtaaagagtactaccg

SEQ ID NO: 25524 - DNA, 163 bp, Homo sapiens
cattttttatttattgtttatttttggagacggagttttgcttttgattgcctaggctggagcgtgatctcggctcaccgcaacctccgcctcccgggttcaagcgattctcctgcctcagcctcccgagtagccgggattacaggcatgcgccaccacgccc

SEQ ID NO: 25525 - DNA, 439 bp, Homo sapiens
  misc_feature 218: k=g or t
atgtctcagaatatcaatagttatcttaacatttgtagtcttttcagtttataaagcactttcactttatctcatttgatccttttgataattctgtggttggtatcattgcccctattttactgctgaggaaaatgagagctagagaacttctcaagcttacacgtgcaataaaataaacatagaaccaggactcaaactcagatcttctcactgtkacttcattgctttttccatactaccataacacctcctttcataaagttaattccattgtttgacaggcaatcttcttgggcttattactgagtcctttccgctcccccatcctcttactaaggaccctagtgaaaggacatttagagaggtagggaaggaagctacttttggttcctggttctttccaggtagttctaagcagtgcatcatggtgtgggcc

SEQ ID NO: 25526 - DNA, 71 bp, Homo sapiens
  misc_feature 41: k=g or t
  misc_feature 44: k=g or t
atactcaatctgtaggctactgtttcattttgttgactgtktcktttactgtcagaagctttttggtttga

SEQ ID NO: 25527 - DNA, 160 bp, Homo sapiens
  misc_feature 43: d=a or g or t
  misc_feature 97: r=a or g
  misc_feature 122: r=a or g
attctaaagaggatagaccttaggagtaaataccatgtcccadacaaagggccatgtctcaggactaaggataaaactgacatagaataaataatartaatacataacaaaacaaagcctarcaagatcaagaggattttttagtagtttaatagcctga

SEQ ID NO: 25528 - DNA, 145 bp, Homo sapiens
  misc_feature 85: y=c or t
  misc_feature 86: s=g or c
cataattggtttcctgtggaaatgtgatgaatgagaagaaataatctattttgcttgcgacatttatcatgttttcctttatgtystaaaatgatagcagtgtctagatctggatacctctgatggtctcctattaagaggaacc

SEQ ID NO: 25529 - DNA, 158 bp, Homo sapiens
tggcatgtgctggtgatcccagctgctcgggaggctgaggcgggagaatcacttgagcctgggaggcagaggttgcagtgagctgagatcgtcactgtattccagcctgggcgacagaacgagactccgtctcaaaaaaaaaaaaaaaaaaaaaaaaa

SEQ ID NO: 25530 - DNA, 207 bp, Homo sapiens
  misc_feature 193: m=a or c
caggtaagccaaaacaaataattttccaccataaatattataacaaataaactcttttaaaataaaatattttcttccttttcctccctggtgacctagtggtaatgttctgcagtgttttatgtaggagacctggatttcattcctgttctcgttatctctctccctagggctgcaatgaattaaataagamataaaatcactagc

SEQ ID NO: 25531 - DNA, 415 bp, Homo sapiens
  misc_feature 208: w=a or t
  misc_feature 319: k=g or t
  misc_feature 335: r=a or g
  misc_feature 336: k=g or t
  misc_feature 397: r=a or g
aaaaccttttaaatctattattctcttctttttgtttctgtttcaatgggttgtatgagtgaagctaaaatgtaaacatcctactgccctatacaaaatagaatactattatttcatctttatgctagttacaagaaagataatcttaacctgcagtaacctacctacagtagatataagtgttcaacatgttgaatatacctatgawaatattctaggtaaacttatttatgctcacaatcaaaaatatgtgattaaatattgttggttttttctaaactccaagattgctagtatgaattttaatgaagaatttctktacatagattaattgrktacttcattcatttgtggatttgaaatgtaactagttgcacatttcctttatgccagccargtattgctgtaggagcac

SEQ ID NO: 25532 - DNA, 445 bp, Homo sapiens
ggtggttgggtggtaagatggcggctgtgagtctgcggctcggcgacttggtgtgggggaaactcggccgatatcctccttggccaggaaagattgttaatccaccaaaggacttgaagaaacctcgcggaaagaaatgcttctttgtgaaattttttggaacagaagatcaatagacccagccccatttctctatcacaagccagcttagcagcctgtggtggcagtatttcaaggagatcgctggcctggagctgtggagccagagcttctggaagagggaatgttcttagaactccatggatttaaaaagaagatttggccgggcatggtgcctcaggcctgcaatcccagtactttgggaggccaagtgcctggatcaaagtggaacagctgaagccatatcatgctcataaagaggaaatgataaaaaattaacagggca

SEQ ID NO: 25533 - DNA, 98 bp, Homo sapiens
ttcaaagcatgttattaaattagtgaataaaacagacccaaattcttgccctggtgcagcttgttttctttttctttttttttttttttttttttttt

SEQ ID NO: 25534 - DNA, 145 bp, Homo sapiens
gagagccccggagagaaaacacactaccttgaggttcatcaggggaaggaagagcttgaggggacagtggagaagcaggaggtaaggtctcaccgtctcgctgcgactgcggcgcgggggcttccaggacttgcagccagacagc

SEQ ID NO: 25535 - DNA, 160 bp, Homo sapiens
  misc_feature 9: s=g or c
  misc_feature 40: k=g or t
aaactttcsgagggggaaaaagagctactggcgcctggckaccctccctgccccccacccaaccccgctccggcaacgcccccttcctcacggctcccgaccgaacttttctccaacttctgcgactcgtgagattcccttctacccactccggccctcg

SEQ ID NO: 25536 - DNA, 422 bp, Homo sapiens
  misc_feature 41: y=c or t
  misc_feature 42: y=c or t
  misc_feature 88: k=g or t
  misc_feature 112: w=a or t
  misc_feature 119: w=a or t
  misc_feature 339: w=a or t
  misc_feature 349: y=c or t
  misc_feature 352: k=g or t
  misc_feature 371: y=c or t
  misc_feature 400: y=c or t
tgaagtttttccttgttgttttgagggcagttttttttttyyctaacaaattcagtttctttaataggtatagggcaattcagatttkgtttcatcttgtggcagttttgtwaaattgwatttttaaagaaatttgtgtcatctaagttgaattttttggtgtaacattgtttatcctaactttttacttagctgtttctcacactgaggtaataaacccctataaggcagagattattgtattcttggcatttgcataatactctacactaaaaacaaataatgagactgattcttagctttatctcatcctttatccttacaattgatattttgtcwatttatttayctkgtatatatttttatgagtyccttcagattttctgaataagaatttatycttaatttcatgaagcaccaca

SEQ ID NO: 25537 - DNA, 228 bp, Homo sapiens
ttttaatataatgcattaaaatgtcaggtaatactgtatattctatattgcatcacaacaggagatatatctggatgacctaccattagtgatgctaagttttacattgtattggagcaacaccaatgcatttcatcctccataaccttaatgcttttactctcctagtttggctatctctttctaaaaatacagttcccagaccagcagtattagcatcggcagcct

SEQ ID NO: 25538 - DNA, 430 bp, Homo sapiens
  misc_feature 7: r=a or g
  misc_feature 99: s=g or c
  misc_feature 316: k=g or t
  misc_feature 317: d=a or g or t
  misc_feature 318: w=a or t
  misc_feature 325: n=a, g, c or t
  misc_feature 383: w=a or t
  misc_feature 397: k=g or t
aaaaaargatggaccctcagcggcgcttcctcgtagcgagcctagtggcgggtgtttgcattgaaacgtgagcgcgacccgaccttaaagagtggggascaaagggaggacagagccctttaaaacgaggcgggtggtgcctgcccctttaagggcggggcgtccggacgactgtatctgagccccagactgccccgagtttctgtcgcaggctgcgaggaaaggcccctaggctgggtctgggtgcttggcggcggcggcttcctccccgctcgtcctccccgggcccagaggcacctcggcttcagtcatgctkdwgcagggnatggaagcacctgactacgaagtgctatccgtgcgagaacagctattccacgagaggwtccgcgagtgtatkatatcaacacttctgtttgcaacactgtacatc

SEQ ID NO: 25539 - DNA, 158 bp, Homo sapiens
attttaaattgctaccgagaaggtccagaaaccgttctcatccaatttagtcacttttattacgttccactttgcctcccccaatcactgcggcggctcccagtttcagcgtggccgcatttggaaaaggctgaaggtagaaaactctggaatggttg

SEQ ID NO: 25540 - DNA, 318 bp, Homo sapiens
aataagaaagggataataagttgttagcaagtcagattctggttcaaagacatgccaaattcaatgttggtaatgattttcaataattatattggtagcttctaagtaagaactttagtaaattaccccactctaattctgggttctgtgctctcattctctcacttaagatctgatgactgagacgtctaaacacagtgttacttttaatgtttaccttacctgacttctcaataacttacctgatgctattgactacacccttcttgaaattcttgtttctggatgtccttacaaccactcctgttttttgacccc

SEQ ID NO: 25541 - DNA, 306 bp, Homo sapiens
tagtttagctctcttatgagttgtgacctttttcaggtcactactgaatatgagtattccatgaggcctttgcagactgggtagttgcaactcaactgactcctattccctatatgagctctgggaattgttaagctttgagctttccagtaagttttctccagtagttctctttgtctagtctcctgcagtttcaccttatgcatatacaacttagtattcagccaaagacttaaaggaactcttagggagactttctagagttatttttctgcataaatcccttttcaatcgaatcgtgccata

SEQ ID NO: 25542 - DNA, 394 bp, Homo sapiens
ttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacgagt

SEQ ID NO: 25543 - DNA, 162 bp, Homo sapiens
agcgcctgcttccccttccccttccgccatgattgtgtttcctgagacctcccagccacgcttcctgtacagcctgcagaactgtgagtcaaccaaacttccttttaaaataaattacccagtctcagctaggtctttctagcagtgtgagaacggacacgt

SEQ ID NO: 25544 - DNA, 432 bp, Homo sapiens
tcttgtaatttccaattttaaaaaattgatcgtgttttatttttgaggagggatcttaatttgtttctatagctctgcaagctcccctgtattccacattttgttcatttctcgttcaatcttcatggtttttcttttttaggtttttgtgcaatgttaagaactttgggatattattatcgtctctgagatattcttccagactgattctatctgatcttgtgttccatgtgcctgctgtggctttacaacccatctgggcaggctcgaccagggcagctcaccctaaatatcccatttgctctgttgtaatctgggagagtcatggtttttttcaaggttcctattttatctgagagagaccaaattgtttttcatctgagctacagtttgaagactctgtttttattcttatcaatttttctgagaacg

SEQ ID NO: 25545 - DNA, 208 bp, Homo sapiens
  misc_feature 100: v=a or c or g
acattttgtttttctgctatctaatggattatgctgctctggaacattcatgtgatgcttttgttaattgcttatacattttattaagctaatgagcgtvgtcatagtaacatataaaatcaagaatcgtttaacttttgcaataaaaatcttgatgttgactctgaagtagtaagatgcaacttcaatgtactgggattgaggcagc

SEQ ID NO: 25546 - DNA, 277 bp, Homo sapiens
aaaaatgcaaaagctattcttagctcatgggccgtttgaaaaacaggcaacaagccagatttggcccacaggtggtggtttgttgactcctgctattatagaaagaatgagagtaaaacaaacctttcccatacagtctgatgctcatggcaagagagacgtgaccaaaagctgccgtggaagtcccaaaaagaggcactactctcagcctgggaggatctgggaggcttcagagaggtaatgcttgagctgcatcttgaagctgagtggagaaggc

SEQ ID NO: 25547 - DNA, 395 bp, Homo sapiens
  misc_feature 48: r=a or g
  misc_feature 66: r=a or g
  misc_feature 91: w=a or t
  misc_feature 116: s=g or c
  misc_feature 126: v=a or c or g
  misc_feature 180: w=a or t
  misc_feature 201: w=a or t
  misc_feature 235: w=a or t
  misc_feature 238: k=g or t
  misc_feature 239: k=g or t
  misc_feature 271: k=g or t
  misc_feature 272: w=a or t
  misc_feature 277: w=a or t
  misc_feature 309: w=a or t
  misc_feature 310: v=a or c or g
  misc_feature 319: r=a or g
  misc_feature 320: r=a or g
  misc_feature 330: w=a or t
  misc_feature 331: w=a or t
  misc_feature 346: r=a or g
  misc_feature 347: k=g or t
  misc_feature 353: r=a or g
  misc_feature 354: r=a or g
  misc_feature 361: w=a or t
ttaagggaaaaagtatcctgagggaccaggaccatcttaatgtgccarggaaatcagacagatgaratacaatataacgaataaaaatttwctttttgcataaagccaagtctaasgatgcaagtvaacttacatgcaaatataaaggctgtcagactaatctatataaatggcttccawagttccatttcagagaaagawatgaaggatttaggggagacaatctttgaatcawcakkttaccttcgattctttgcttcactgacttctkwcagtwtggcaaattggggttcatcacgatttaaaagwvatgctgccrragcttgacawwtgcagtctaagaagrkaatacrrattctawatgcctatgcagttttctgtagttcccagcattc

SEQ ID NO: 25548 - DNA, 289 bp, Homo sapiens
caattgcttcaaagagaataaaatacctaggaatccaacttacaagggatgtgaaggacctcttaatggagaactacaaaccactgctcaatgaaataaaagaggatacaaacaaatggaagaacattccatgctcataggtaggaagaatcaatatcgtgaaaatggccatactgcccaaggtaatttatagattcaatgccatccccatcaacctaccaatgactttcttcacagaattggaaaaaactactttgaagttcatatggaaccaaaaaagagcccaact

SEQ ID NO: 25549 - DNA, 171 bp, Homo sapiens
ctgactcttggagaaatttgagacaggaatgattagagcaggacagagtccagaaacctcttacagaagcagcacgttagggctcagtttcattggattttctaggctatacattgtgtgagggttctagttaactattgaataataagtagaatgatgtaccaggcacta

SEQ ID NO: 25550 - DNA, 271 bp, Homo sapiens
  misc_feature 221: m=a or c
  misc_feature 222: w=a or t
  misc_feature 226: w=a or t
  misc_feature 227: w=a or t
  misc_feature 244: m=a or c
  misc_feature 245: s=g or c
cgagatcatgacattgcactccagcctgggtgacagagcaagactctgtctcaatgaatgaatgaatgaatgaataaataaataaagattttaattgaaataaaatttatataccataaaatttaccaatttaaggcatataattcagtggtctttagtatattgatagagttgtcaaccattaccataatcaattttagaatattttcaccaccacctamwagawwctcgatacttgttagamstcacttaccattttcccctaacccta

SEQ ID NO: 25551 - DNA, 422 bp, Homo sapiens
  misc_feature 374: k=g or t
  misc_feature 380: k=g or t
cagattaattgctcccatttcaccaccattgccaggccaactattggcaacaaaaagaaccaggagatatggggcatcaaatgccgactgacactgcaaaagcccagttgtctatgaagtatttattgcaggatggtgtctcttctttagaacagggaaaataggcaggaagcccaattgctggagtacttagctagttttattcttggttttccctttgccttcattctgcaagtatactagggagccatttgagagggaaaactatgaaatcttgctttttgaaatgattctaaaagcttctatcactgctttgctcttaagagccaaagttgtaggccttttgaaattttaggagagtgagcctataattkcaagakaccttaaagagcaaaatttgagccacctcttccaagtgccct

SEQ ID NO: 25552 - DNA, 209 bp, Homo sapiens
tttaattactgtcgatgaatgtctgcaggctcttgaggaggtatttggggttacagataatcctagggagttgcaggtcaaatatctaaccacttaccagaaggatgaggaaaagttgtcggcttatgtactaaggctggagcctttgttacagaagctggtacagagaggagcaattgagagagatgctgtgaatcaggcccgcccgg

SEQ ID NO: 25553 - DNA, 122 bp, Homo sapiens
caatagcacccccctcttgccttgttgttacaacccaaaatgtctttggacattgccaaatgtttcctggggagtgaaatgcatcctcctcccattgctgtatatgtatgtgtgtgtgacgc

SEQ ID NO: 25554 - DNA, 132 bp, Homo sapiens
actgatgtctgtgtagacagggagctgtgacgagagcaagaggtcagaacacatccagactccttaagagaaagcctttctgttttggaaacttttcaaagccagggacttgtccagcccaacctccccacc

SEQ ID NO: 25555 - DNA, 213 bp, Homo sapiens
catacattttgttcagttttatagttgatcacagcaagaagcaaaatccagtactagttactgcaatatgaccagaaacaaaagtgatcctcggatattatatttatatactaacacaaaaagagacaagagcttacattttaatcctcatggattgggagctgtcttgcataaatcagcaaatcctttttctatggtatattacgacctcac

SEQ ID NO: 25556 - DNA, 112 bp, Homo sapiens
aaggtgcttggtgggggaacttctgagactcattgtccaggagaaataacttcacaagcagctaaacaagaactgcctcgagataaagaagatgaaaacaatcgcagctcac

SEQ ID NO: 25557 - DNA, 364 bp, Homo sapiens
cttttgcattttcctgagttgctaagttagtcatagtagccaaatgaggctactccaacatgatttgtctagtaaccagtcatgctcaatcatagtgatcaatgtttccaatctagttatagtttccttttttagaattttgcccaagatcattaccaggttcaccagaatgagctttgtcttctttttgaaaatctgccatttctctcctgtgattatttccttacatttactgatctagtaatgtcattttaaaattccatttatacttactccttgttgccctctgcattctccctacacggacctgctttgtgttccttgaacacaccaagttcttctgtaccttagagctttaatactc

SEQ ID NO: 25558 - DNA, 184 bp, Homo sapiens
cttcctagccaaatgtattcccatcctccttctctggacccacagaacactgtcctttcatggcactgaggttctgcttttggacagttttctgggtaaaatggacttctttctgacttcttacccttcttgatcacaagctccccagggaagagactgtcttatttctctctgacccttgcct

SEQ ID NO: 25559 - DNA, 132 bp, Homo sapiens
taaacatatcttaaatacatgatactgaaagtatgaggcagactaaattattccatcagtattcagaatacttatcaacagagactttttaggaaaaaatacaaaattatgaatacaaaactagggatgagg

SEQ ID NO: 25560 - DNA, 156 bp, Homo sapiens
taaaaaatttagttgttgactgagcatggtggctcacgcctgtaatcccagcactttgggaggcagaggcaagcagatcccaaggtcacgagtttgagaccagcccggccaatgaaactccgtctctactaaaaatacaaaaattagccagacaag

SEQ ID NO: 25561 - DNA, 179 bp, Homo sapiens
cacgacagcttccttcaagctctttctgctcaaacattcattgcggggcaagaaaagccgtgttgaatctctaccgggccgaaccttgggccttggtgtcagcgcacggcagggccacagagactacagccctggggttccagagccggctctcccgtgctctccagaaatcccaggcc

SEQ ID NO: 25562 - DNA, 156 bp, Homo sapiens
  misc_feature 94: k=g or t
  misc_feature 118: r=a or g
caaaaaattagctggatgtggtggcgggcgcctgtagtctcagcctcccgagtggctgggactacagggacccgccaccatgcctagtagagakgcggtttcgccatgttggccaggrtggtctcgatctcctgatctcgtgatccacccgccgta

SEQ ID NO: 25563 - DNA, 394 bp, Homo sapiens
  misc_feature 350: s=g or c
cttacctactgctttttatcctgggtacccgtgctcaaggacctttggctgtttaaggacacattcaaatgcctaaccatagcgttcagtgttctcaacactgggccttagtttaaattttggttccagcttctggcccgtttgccctgtggtcccctgtgtattttagccgcatctctctgtgaagctcccagtgtgctttgcacagctccttgtctttgctcatgctgtgcccttacctggaatgcctttttcccattccttgttattaataaaatcttccaaggccctacttaaatgtcctctctgaatgaagccttccttgattctccccccaccctccaaatgasttgctgccgcttctgttcatagagcgcttcgtttatatccctgc

SEQ ID NO: 25564 - DNA, 236 bp, Homo sapiens
gagcgatcccggaaggagccgaagcgacaatgcgggggaagagatagagtcttcctctgtcgcctaggctggagtgcagtggcgcgatctcggcgcaccgcaacctctgcctcccgggttcaagcgaattctcctgcctcagcctccggagtagctgggattacagatgtgctccaccatgcccggctaatttttgtatttttagtagagatgggggggtttcaccatgttggccg

SEQ ID NO: 25565 - DNA, 302 bp, Homo sapiens
taagaaaacaaacaacccaattcaaaaaagaaataggccgagctcaatggctcatgcctgtaatcccagcactttgggaggctgaggcgggtggatcacttgaagtcaggagttcgagaccagcctggccaacatggcgaaaccctgtctctactaaaaatacaaaaattagcccagcatggttgtgcacgcctgtaatcccaactacttgggaggcaggagaatcacttgaacttgggaggtggaggttgcagtgagctgagatcgcgccactgcactctagcctgggcaacagagtaaga

SEQ ID NO: 25566 - DNA, 168 bp, Homo sapiens
acattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaata

SEQ ID NO: 25567 - DNA, 317 bp, Homo sapiens
  misc_feature 13: m=a or c
catctggtgttcmttggtgtcctttgttatgtcctttataattaaccagtaaacgtgtttccctgagttctgtgagctgctcaagcaaattaatggaacccaagaagggggttgtgtgagccccgatttatggtggttgggtcagagcaaatgttaacctgagatttgtgattggcatgggaagtggggggcagtcttgtgagactgagcactcagtctgtgggatctgatgctctcttccagtgtcagaattgaattggagggcacctagctggtgttcattgcagaattgcttgcttggtgtgtgtggggagctt

SEQ ID NO: 25568 - DNA, 354 bp, Homo sapiens
cacaattttatcctgaaagcatagagaaaacaaatcaacttgtcattttcaaaaacttaccctggctgtaatctcaataaaaggacatcttttaaagtcaagctttatgaaaaatttactaccttgtttttgtttttctcatgttttttatttattttgaggagtggggtgttaactgtgttgctcaggctggagtgcagtggcatgatcacagctcactgcagcttcaacctcctggactcaggtgatcctcccaccacagcctcccaagtagctgggactacaggtgtgcaccaccatgcctggctaattttttttgtagagatgaggttttgccttgttgctcaggctggt

SEQ ID NO: 25569 - DNA, 143 bp, Homo sapiens
  misc_feature 117: r=a or g
  misc_feature 130: s=g or c
cttagattgtgagaatctctctgtttacacagtagttttgattatttgtgctgggcacactgtgctccagcccatttttaacattttcagcttgtgttttcatacatcatgcatgarataaacgtttgastagcacctgcact

SEQ ID NO: 25570 - DNA, 195 bp, Homo sapiens
ttaataagtaaaatattctgttttatgtatcataattttttttattgtggcaaaatacacctaacatgatatttaccattttaaccattttaaaaggtacattcacagtgttgtgcagccattattactaattccagaacattttcaccaccccaaatgaaactctgtatccatgaagcagtcacttcccgttca

SEQ ID NO: 25571 - DNA, 192 bp, Homo sapiens
aaatagtctttacaaataaggaaaacagctcagtttgggaagtatcagagatgggattcaaacccagatcctctggtccaagttgtatgtgcactgaactaatcaggcaggaaaaaagcccagccactgtctcacagattgttttttgtatattgtagcaaaatcctgaaacaatggggtccttccagtcat

SEQ ID NO: 25572 - DNA, 148 bp, Homo sapiens
ttttttcataatttatattttgtaggttgcatgttgtaattgtatgaaccatgtctttaacaggataataagaactccaatttacagaatccttaaattccaaagtcagttatattaaatataaaaatcttaatttaaaccagtctta

SEQ ID NO: 25573 - DNA, 281 bp, Homo sapiens
agctaccatttattaagcacatactacatgttaggcgttttatatttaatgcttccaacacctagtgttgtcagcattgtcagagtcactgttttatggacagaggaagtgaggcacagagaggggaagtaactctcgcaaggttgcacagctccccacaagcccgtgtgcataaccaccacgtcacttgatgctaagtcccgttgatgggactgaagaccagccagacaggggaggcgccctcttccaggtgctgggcctgccccgtccccgcagccaca

SEQ ID NO: 25574 - DNA, 428 bp, Homo sapiens
  misc_feature 409: w=a or t
aaccacaaccacagtctgattttagaacatttccatcaacttcaaagatccctggtgccatttgtagtcctccaacccatctccgatctatcttgtttctatgacttgccttttctggctatttcatataaatgggatcatatgacatgtggtttcctatatctgacttttttcatttagcataacgtttttgaggctcatccatgttgtagtactccatgccatgttgtgggctacataatattccattgtatggatataccacattttgcttatcagttaatggacatttaggttttgtctactttttggcattaatagtgctgctgtgaacaatcatgtacaagtctttgtatcagagccacttttgataaaatagtttctaaaacatttcatcttgatttttatwaggtgatatgtatgttact

SEQ ID NO: 25575 - DNA, 200 bp, Homo sapiens
ttttaaattgggcagcctcccaagccagagcaggctcagagagactccacagtttctttttaaaatgtggccccactgcaacgaaaaaagaaaaaatgccctccaaaaagttactcaaatactctcattaagttgaaaaataagaatggagaattagccattggattgggcaatgtgaagatctttggtaaccgtgaata

SEQ ID NO: 25576 - DNA, 462 bp, Homo sapiens
  misc_feature 35: s=g or c
tattcttccattatttctcttatcccctgccagtsactttagcctgaattagctgtgaggcaaactattttgccatttctatgtgtggatcttccagtgtgactttatgcagtcattgaaattgtcttaagcacaaatgaaacctcatggaaatgttaattactgctcctacaattaaccttcctcatatattcaacaagcaaggaattattgagaactaatacctctgagacactactccttagtaggtttcaaaccaggaaggaggcaagttgaatagagtctaagttttataatccagatcaacacagagaagggtactgctctggtattgagggtgggagtggtcagagaaggcctcctggaaaggttaggcctgctgaatcttcaagaacaagcagcagcccaagaggggaggtgagtgagatgagccaccttcctataggtctctcctccttccat

SEQ ID NO: 25577 - DNA, 108 bp, Homo sapiens
attgaaataggaaaaacaatcaggcaaaatcagtgggagaaaggaaaaaggcaaaggaaactgagaaaagattaacttgggtttttttagttagctgttttttttttt

SEQ ID NO: 25578 - DNA, 130 bp, Homo sapiens
taagccggcgtcaggtcatcgaggcctccgggctgattaggactaatggcgctcaggggtgcagcctcagcctccacccgccacccgtacccgccctgcctcaggacttcgttcctgctgtacccctaca

SEQ ID NO: 25579 - DNA, 276 bp, Homo sapiens
  misc_feature 249: w=a or t
  misc_feature 250: k=g or t
ttctacttaagtcaagagaagtttacacatgaccactacagaattatgctattttgtgtttttctgtgtgcttagtattaccagtgagttttggaccttcagatgatttcttcttgctcattaacatcctttattgagactgaagaacttccttttgcatttcttgtaggacatatcttgtgttaatgaaatccctcagcttttgtttgtctggaaaggtttttatttctccttcatgcttaaagaatwktttcactggatctactattctggggt

SEQ ID NO: 25580 - DNA, 146 bp, Homo sapiens
atttttttttatcaaatagaaaaatagtggcactaaacattgcttcctttttacaggatggagttctggtggatgaatttggattgccacagatccctgcttcatagatttgcatcattcaagcatatcttgtaaaacaaacaccc

SEQ ID NO: 25581 - DNA, 179 bp, Homo sapiens
taacaaaggaatcacaagagacacttgcaggtgtgtgaagacgaagttcatcacatgggagggcaccgagtgtctttatttgccttccctgcccggctccccacctccagtgatgccgttcactgccctccttgttaaaaggccttctgttatataacagttacacatgccaggcattc

SEQ ID NO: 25582 - DNA, 437 bp, Homo sapiens
  misc_feature 149: k=g or t
  misc_feature 150: r=a or g
tttatcaatcaaacaaatatgcactctgtactgctgttggtttactctgaataggtggacaagtaataattgagagataaatacatagaagaatacatgaagttatttattttgttacagctgcaccttttctgtatttccccttacckrtacttgcttcctttacttatgtggcttagatggcctgttctttaaagtgcatagctttcttgccaacagtttttcttcctttctcccattgtctttgctcttgttgaggaaaaatcacatatttctgcatattgctacaactctaaaggcatggtttccaattatagttgggagcctctcaggtgccctgtaccttccatgtttctcttacgtagctttttatttatgttatttaaaatctttttcactttcattaagctgccatatcctcattcagcagattagca

SEQ ID NO: 25583 - DNA, 208 bp, Homo sapiens
actagcttctaaagaattaataagagagaattgcaaataaaaagtataatctttttttcctccatttcaggctggctcacagttggaccaacgcttacaaatagcaactacaatgcagaaacatatgcatcctatttcagtgctcctaattcctacttgactggttgtacagaagaaattgagagacttcgaccaaaatcgcctcctg

SEQ ID NO: 25584 - DNA, 184 bp, Homo sapiens
tcaataaaaaaggtagaaagtaatttttttacttaaaaatataaattaaaataaatttttaaaatcataagcacataaatagaacttaccagggagaaagaaaaacctgaaggcacaatttcttttctgttcaaaatgtgaacccaggatgtctctagatgatgatggatgataggtagggaga

SEQ ID NO: 25585 - DNA, 324 bp, Homo sapiens
tattgtcatcgttttaccactaagttggttgagacacttacttgtaatactttaatttttttaaagtgtttttagaaacaagttgtttgaaaaccaattagaaattagaatatttgccagattataagcagatggaatgcagtgtaaaactgttaacaatgctaataaaattatgagtcatcagattggtacagttttccctgccaagatggtcatattgataatgtaagacaaattttagtattacttgcattatgtgtacctaataggtatatcatactggtactgagcatatatagaaaatactattcatagaggagtcct

SEQ ID NO: 25586 - DNA, 233 bp, Homo sapiens
  misc_feature 12: y=c or t
  misc_feature 13: y=c or t
ttgttcgttttyygtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatacct

SEQ ID NO: 25587 - DNA, 417 bp, Homo sapiens
  misc_feature 117: n=a, g, c or t
catgcaggatagtaatacgttagaatcaaaaataaggttatacttagaaaatattgatttgcctttttgattttgcatgtgtataatctggctctgaaatcagtgacacgaagtgancttcgaaacaagcctgagcaatagaagtagatgtggaaataacttcggtttctcaaggcaaatactttgataggaacaaacaaccgtttagatatagaagatgtgatacattcctttaaaaagaatttgaccttatgtcattgtaggcacacctcatatttcaattattcatatagtttttcttgagcaattgctggtttaagaataatgtcatgtcttttgcgtgcttatatcatttggatatttccttccttccttccttccctcctttcttccttccttctttccctccccccttcc

SEQ ID NO: 25588 - DNA, 390 bp, Homo sapiens
  misc_feature 339: s=g or c
attctcctttctcagcctgttggaatcgaatccgttccggctcccacccaggcggtacctctgtctccactcccggaggccagatcgatctctcaggtcagggcttctcttggatgtcagctggtcctgcccactactgtccgccactagagttcttttcgctcccaaccttttcttcccttcgtgccccgtgacctcagcctactttcactgctttatcccttaaaaattagtcacttttcctcagaaaaaatggacttaacagtttacaaaaggccgggcgcggtggctcacgcctgtaatcccagcactttcagaggccgaggctggcggatcacstgaggtcaggagttcgagaccagcctggccaacatggcaaaaccccgtctt

SEQ ID NO: 25589 - DNA, 256 bp, Homo sapiens
  misc_feature 54: y=c or t
  misc_feature 240: m=a or c
aaaaaacctacgcacacagacagcagtgggcaggtgcagccctgcttagggccyggagatgggcagacccaggctcacatcctagctctgacacggaattgcttcaggcaagagcatctcctctggacctcatctgaccatctgtcacatggggttcagacctccctgtctgcatcagtgagaccagggcaggaactgctgccacaacctcaggctgggcaccaaacacccgtgcccgcmaatgcggcccaacccc

SEQ ID NO: 25590 - DNA, 263 bp, Homo sapiens
ttttatcttgggcccaaatctccacttgttgccatctcctaccagcagttggtggggaaagggccaggggaacacatacctagtcctttcaaggggaatacctggaagcttggagagtttatataacttcctgaaggtcacacagctgtttagtggcagggctgattggatctgaggtttgtgtgattcagaagccactagatctcttttatggggaaagaaagataatgcatagctgttgcattccaagttgacactgaagc

SEQ ID NO: 25591 - DNA, 120 bp, Homo sapiens
  misc_feature 71: k=g or t
ctaaagatcgccaagtcagaccctcccacgctgctcacgccctccaagtggtctgtagagttccgtgactkcctgaagatagccctggataagaacccagaaacccgacccagtgccact

SEQ ID NO: 25592 - DNA, 321 bp, Homo sapiens
  misc_feature 56: w=a or t
  misc_feature 102: m=a or c
  misc_feature 205: w=a or t
  misc_feature 230: r=a or g
  misc_feature 237: y=c or t
  misc_feature 242: m=a or c
  misc_feature 316: w=a or t
  misc_feature 320: w=a or t
ctctaagataacgacacatggatattttttttttactcagtatacttgagaccagwtaattgagagattattagcaaaaaggtagggctccagaaagattamagttttcaaaaatgtgctttgtacttttcaaccaccactgtagcatttagacactatcattcttaactggagcagccagagggttaatggtttgtacatcttwcttctctctcactctgtaatactartttagayttgamagcaaagatgccagagtagagtgcagcacacatagttactttaaaatagtttactaaactgattccttcctttwcccwa

SEQ ID NO: 25593 - DNA, 221 bp, Homo sapiens
  misc_feature 23: r=a or g
  misc_feature 24: m=a or c
  misc_feature 54: r=a or g
  misc_feature 196: w=a or t
  misc_feature 205: d=a or g or t
caggctggtctcaaacttctggrmtcaagtgatcctcctgcctcagcctcccaragtgctggcattacaggtgtgagccaccatgcctggccaaaagtgtgtcattgtaaatgacagtattcaaaacttaccatccaattcagcaaagaagtggctcacatcattgataaacacatgaaattctgttttttttttwaatttcagdttatttgttaaggtac

SEQ ID NO: 25594 - DNA, 309 bp, Homo sapiens
  misc_feature 12: m=a or c
  misc_feature 252: r=a or g
  misc_feature 253: m=a or c
  misc_feature 303: b=c or g or t
ggttggtagacmctttaaaacccagctcaaatttcacctcccagaagactgaccgtcttcttttttcatttcttctcagtaccttgtatatacttactggttgggacatcctactcatcagtgtaacccggtaccaaggcacttcggaaatgatggctcttcattgcctgcagaattaaccatggacattttagtttggtttgaaaaacatatagccttctgcctccagccttcccatcaggctagtaaaarmcttgcagaactcagttgaataaaataatttttttttttgagacagcattbcactct

SEQ ID NO: 25595 - DNA, 191 bp, Homo sapiens
tattaatatttatccaatcagtgatggacatctggttgttcccacttttgggttatgaataatgctgcatgaacatttttgtacaagtttttgtgtgaacatatgttttcatttcttttgggaatgggattcctgggtcaaatcgtagctctatgtttaacattttgaggaactgccatactattctgaag

SEQ ID NO: 25596 - DNA, 135 bp, Homo sapiens
  misc_feature 12: s=g or c
  misc_feature 46: k=g or t
ctacagttccasaccgtcgccgctgatgccaaacctggagaacttkccctacagccagcagccgctcagcaccggggccttccccgcaggatcactgaccacagccacttcatgcccctgctcaatccctcccca

SEQ ID NO: 25597 - DNA, 444 bp, Homo sapiens
  misc_feature 222: s=g or c
  misc_feature 223: v=a or c or g
  misc_feature 288: d=a or g or t
  misc_feature 379: b=c or g or t
  misc_feature 382: s=g or c
  misc_feature 418: v=a or c or g
  misc_feature 419: n=a, g, c or t
aacatgacccagaagacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaacsvtctgtaggccagtagttctcaaagtgtggtctctggaagagcagtatcagcatcatctgggaacdtgtcacagatgcagattctagggaccactccagacctacacaatcagaaactcttgggggagggcccgaaatatctatgttttaccaagcbcascacatgattctgatgtactctaaatactgagaaaavntgttctagacaaatacccaagcaaa

SEQ ID NO: 25598 - DNA, 146 bp, Homo sapiens
agatgaaaaatactcattttaagaaacatttaatgatcaacatgtattcacctagagtttgtcaagattagtacagtgttttctacctgagtgctcatgattgcagatcacttctgcctaaagtctatgtaagttactgctaaacc

SEQ ID NO: 25599 - DNA, 319 bp, Homo sapiens
  misc_feature 75: s=g or c
  misc_feature 124: w=a or t
  misc_feature 266: r=a or g
  misc_feature 306: k=g or t
  misc_feature 315: n=a, g, c or t
tgatgatgatgatgatgatggtttttttctaatcagaagaaagctggggtatgccctctacttactaaacaagtsacaagcccagctcagattcaagaaaagggtgtgaagtagaggtgcagtwaagtggggggccactagtctaacagacggtcacaaccagtgccatggaaaaccaaggatattagcaaaagcagaagttgctagtgaccttgggaagccgaagctgcttacagtagctgggacaagctgaaagtcagactagraaataaagagagggccttcaagaagcttcctgaatgattkctgctagcnccaa

SEQ ID NO: 25600 - DNA, 195 bp, Homo sapiens
  misc_feature 12: d=a or g or t
  misc_feature 46: s=g or c
  misc_feature 141: m=a or c
  misc_feature 142: s=g or c
  misc_feature 170: s=g or c
  misc_feature 172: h=a or c or t
  misc_feature 183: d=a or g or t
  misc_feature 188: w=a or t
  misc_feature 189: y=c or t
gagagaagaggdgcaggggagaggcgaggagagggaagaagaggasaagaaaagaagaggagctaagggaagaggagagagcaggagaggaggagagagaagagcggaggagaggagagagcagcagaggaggagagaggmsaagggtaaagaagagaagaggagcgaasghagagggagcadgcggwyccggcg

SEQ ID NO: 25601 - DNA, 295 bp, Homo sapiens
  misc_feature 173: k=g or t
  misc_feature 174: s=g or c
  misc_feature 179: s=g or c
  misc_feature 180: r=a or g
gaccctccccccttcccccaaccccatgacagccctgggtgtgtaatattccccttcctgtgtctaagtgttctcatcgttcaattcccacctatgagtaagaatatgcagtgtttggttttttgtccttgcaatagcttgctgagaatgatggtttccagcttcatccatgkscctasraaggacatgaactcatccttttttatggctgcatagtattccattgtgtatatgtgccatattttcttaatccagtgtctatcattgatggacatttgggttggttccaagtcgc

SEQ ID NO: 25602 - DNA, 436 bp, Homo sapiens
  misc_feature 284: w=a or t
ctttttattgtgaataaaatataaaagttaaaggccctctgctaagtcacataaagtacagcatataagttcatataggtacaaataaatgagtttgcagtggattgggccttcaaattacctcaagtgacagatagtaagaaaagcttcttgagcaggtggaggtcactgaatcccctactatgcacttatcaagattttacttactttaatttactggaaattgattttttaaaaaatgactacactgtaacaagggaagggatctgggtttttttgttgtwttattcttgtttttttaaagtagttcaaattctgaaactgtgatttaaaaattttttacagtcaagcattctgattttgaacataactcccttccctttctgtgtaacaaaggtctctctgttatctcttaaattttgttacatctccccct

SEQ ID NO: 25603 - DNA, 382 bp, Homo sapiens
  misc_feature 13: k=g or t
  misc_feature 327: y=c or t
  misc_feature 338: d=a or g or t
  misc_feature 357: r=a or g
actcttccaccakagtaggacacagtgagaaggcaccacgcctggctaatgtttgcatttttagtagagactgggtttcaccatgttgcccaggctggtctcaaactcctgacctcaggtgttctgcccaccttggccccccaaagtgctgggaatgcaggtgtgatccacctccccagcccagactactgtctttatggtagatttatgttggtgacatttgccatcatgggtagataacacatatgtatattgccttttctactttatatcaatacaaataaaattgtttttagctgtgtggagcttgtttgcctgctaagctgytattgacagtdcctgttatgatatagttcrtatcctacaccaacatatggcgcga

SEQ ID NO: 25604 - DNA, 335 bp, Homo sapiens
  misc_feature 21: y=c or t
  misc_feature 22: m=a or c
acaggtcagattgctcgagtymgggagtttgagaccagcctgggcaacatggcagaaccccgtctctacaaaatacacagaaattagttgggcagggtggcatgcctatggtcccaactactcgggaggctgaggtgggaggatctcttgagactgggaggtagaggttgcagtgagttgggattgtgccactgcactccagcctgggtgacaagcaagaccctgtctgtcaatcaatcaataaatgttgaccctttgccatattactttaatgttcttcccccaattatgaagttttaaaagtttaggtagtaaattttttcttttatgatggc

SEQ ID NO: 25605 - DNA, 156 bp, Homo sapiens
tgctatcgaatctaaacgttcatttgcccaacctacttcccctttcttgaaagaagtaaaaattacttttggaaatttcctgaataaatggagtcaggaatcccagcagttcttactgttaaaggacgtgcttgcacacgtaaagaagggcctgtt

SEQ ID NO: 25606 - DNA, 318 bp, Homo sapiens
  misc_feature 118: r=a or g
  misc_feature 119: w=a or t
  misc_feature 172: y=c or t
  misc_feature 173: w=a or t
  misc_feature 194: w=a or t
  misc_feature 195: k=g or t
atttagtttagtgcaatggggctataaggaaaatatgtttttctcatttaaaggaacaaagaggctcaggtttttgcaaatacagtaacattgctaggggtcacataactcataagtrwtgctgcaactgaaatttgaactcatttgaatttcagcatttggcttaatagaywctgatttctgtctaatatgcwkattgtgtgggggttcccaagacccacccgtagttcagtgattggctagaaggactcacatgatccagcatcagttgtactaacagctaggatttattacagcacaggaaaaaggtgcacggga

SEQ ID NO: 25607 - DNA, 177 bp, Homo sapiens
  misc_feature 3: r=a or g
  misc_feature 20: r=a or g
  misc_feature 64: w=a or t
  misc_feature 83: n=a, g, c or t
  misc_feature 173: w=a or t
  misc_feature 174: k=g or t
acrtattacttttaaaatcrgaaatagaaaagccttcttaaagatagagctgcatgatccagtwaggtatagacaagccagtnagttaagacaactgagtatgttccactttgttgagctgtgctaccctagttaatgtgacattagtgctggcccaagaaatacagaaaagwkcgg

SEQ ID NO: 25608 - DNA, 434 bp, Homo sapiens
  misc_feature 12: r=a or g
  misc_feature 136: k=g or t
  misc_feature 167: y=c or t
  misc_feature 171: s=g or c
  misc_feature 172: r=a or g
  misc_feature 177: r=a or g
  misc_feature 178: r=a or g
  misc_feature 188: r=a or g
  misc_feature 189: d=a or g or t
  misc_feature 321: s=g or c
  misc_feature 322: y=c or t
  misc_feature 379: b=c or g or t
  misc_feature 380: m=a or c
cctcaggtgacrttctattatgtttgatgtgtcatttttgatttggttgtgtccttgcaaaatgtgcgttgttttatttatcaatttatttttatttttatttttttaaagagatgaggtctcatcatgttgccakgctggactccaactcctgggctcaagcgatyttcsrcctcrrtctctgagtrdctgggactacagatgtgcgccaccatacctggctattgatcaatttttagtttaccaaacaggcattatgttctgggtcccattctgtgtcgggttctcttttcactcggcaccatggctttaggatccatsyatgctgctctgtgaacgccgagttgctttaactgcttggtgctccatgaggcatccbmttttgtgtctctgtcctcccagtgagggaccccatcgtaccctactcccctccc

SEQ ID NO: 25609 - DNA, 199 bp, Homo sapiens
ccatatctttgtgcattattttgttgttgttgcttattattgattgtatcagcagttgctggctcagtgcttcacatattaagcatattaacatagtgtttaataaatacatttattaaataaatgaacagacttattgagcatctcccctggtgagaaactagcatacaaaaatatgaattatactattctaggtgcc

SEQ ID NO: 25610 - DNA, 151 bp, Homo sapiens
atgaataatgtggctgggcgcggtggctcacgcctttaatcccagcactttgagaggccgaggcaggtggatcacgagatcaggagttcgagaccagcctgaccaacatggtgaaactccatttctactaaaaaacaaaaattacccgggc

SEQ ID NO: 25611 - DNA, 173 bp, Homo sapiens
  misc_feature 20: m=a or c
  misc_feature 91: r=a or g
  misc_feature 103: r=a or g
  misc_feature 126: r=a or g
  misc_feature 173: r=a or g
gtgaaggtagatttttatamaacaagcatggggattcttttctaaggtaatattaatgagaagggaaaaaagtatctttaacagctctttrttgaagcctgtrgtagcacattatgtttataattrcacatgtgcacataatctattatgatccaatgcaaatacagccccar

SEQ ID NO: 25612 - DNA, 375 bp, Homo sapiens
  misc_feature 89: k=g or t
  misc_feature 125: r=a or g
  misc_feature 126: s=g or c
attttgcatatgtggttaaattaaggatcttgacatggagaaattattctggattatctggctgagccctaaatgcgatcatgagtgtkttaatgagaaagaggcaggagcagatttgacatacrsacaggagagaggagggcaatatgaccactgaggcagagattggagtggtgcagacacaggctaaggagtgctggtggcccccggaaactgcaagagggaaggaacggattctcccctaagcctccggagggcgccccactgccaacaccttgattttgacccagtaacacagatttgggacttctgctctctagaactgtgagagaataaatcactggtgtttgtggtaatttgtttcagcagtcgggc

SEQ ID NO: 25613 - DNA, 113 bp, Homo sapiens
tttatgttccttatgaatatgtcaaatgtggttctgggtatttggtaagatttaagcttatatgtgactcaaattctccctctttgatttatacctccgatagctgcccaacg

SEQ ID NO: 25614 - DNA, 108 bp, Homo sapiens
  misc_feature 82: r=a or g
ggatgtgagggcgatctggctgcgacatctgtcaccccattgatcgccagggttgattcggctgatctggctggctaggcgrgtgtccccttcctccctcaccgctcc

SEQ ID NO: 25615 - DNA, 198 bp, Homo sapiens
ataccgtgagggcctttgagctctcggacagcgtggagtggtcaaggaaggcctccaggaggaagaggtggccaaccgccccaggcagcacagtgctgtctctggacggagggacgggaagtggccagaaggggaagtgtgaggagttcccgtccagcctgtcatcagtctccccaggtcttgaagcggcggcgccac

SEQ ID NO: 25616 - DNA, 426 bp, Homo sapiens
  misc_feature 20: b=c or g or t
  misc_feature 21: m=a or c
  misc_feature 300: n=a, g, c or t
  misc_feature 301: n=a, g, c or t
  misc_feature 408: r=a or g
ttaccaaaccgtctaccttbmtaacttgctatattaatgctgatgcttgaaagtaagatctttggcatttatgcttacacgttgcatgaagagtaagttgagtacaacatgttatgccatgtattaagtctattaattaaaaacaaattctaagattcaaggagcttttcagtgttccacatgtctccctttagaaaaagtaaatgtgtgcagaattaacaaagtgtttaaaaatagatatttattattttactatttggatgaatgtgtagggcagtgcttccttggcactggggatanntcattgagcaaaactaaaaatatcttccctcatggagtttatgttatagtaagacatacatgtacctctataataactattacgttagaaggtataaagtattgtgraaaatatatagagcatga

SEQ ID NO: 25617 - DNA, 352 bp, Homo sapiens
  misc_feature 310: k=g or t
gaaaagagctgtctgaagtaatggcccagcccacatgtttacagcgtgttggcagtggttctccaacttcagcatgcatccaagaatcacctggaggccttgttaaaacagcgctggccccatcccagagtttccgattgagtgggcctgtggcagggtcttagatttttgcattcataccttcccaggtgatgatgttgccggttcggggtctacactttgagaaccactgcgctaaaggaaagaaacacaagtagcttggggatggtttagaaaacagaattttaagattaataccctggtgcttgtkaaaattttgatgacaataccaaatttcatttgttatggtgtg

SEQ ID NO: 25618 - DNA, 365 bp, Homo sapiens
  misc_feature 47: r=a or g
  misc_feature 48: w=a or t
ttatgttaggtagcttacattttctcctctgcgtgtgtgtgtatgtrwgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgtaa

SEQ ID NO: 25619 - DNA, 280 bp, Homo sapiens
  misc_feature 12: s=g or c
  misc_feature 24: w=a or t
  misc_feature 111: m=a or c
  misc_feature 214: s=g or c
gaggtaggcgcsgggcggtcggcwgcggtggcggcgtttggatgattgtctctcggcggcggagtcggatactgtggcgtatgacgacctgtctgaggactatactcagamgaaatggaaaggtctcgcactcagtcagagagccctgcactggaacatgatgctggaaaatgaccgtagcatggcttctttggcaggtaggaacatgatggasagttcagagctgactccgaagcaggaaatttttaaaggatcagagtcatctaatagcacatctggg

SEQ ID NO: 25620 - DNA, 80 bp, Homo sapiens
tttgttcagcattcattggtttctgatttttttttgaaaaggaataagatttgtaaatattttctcccagtccagcctat

SEQ ID NO: 25621 - DNA, 149 bp, Homo sapiens
  misc_feature 88: r=a or g
ccttttaggaatattccttgtgaaaaaagaacgtagatatgtaattgatatggtttggctctgtgtccccacccaaatctgatctcgrattgcaatccccatgttttgagggagggtcctggtgggaggtgattgaatcatgggagcta

SEQ ID NO: 25622 - DNA, 152 bp, Homo sapiens
ggtcatgtattacagatgtttctaaataaataatgctttgtaatatgaaactataatttgaagtcttttttttgagacagagtttcgccctgttgcccaggctggagtggaatggcgcgatctctgctcaccacaacctccgcctcccgggt

SEQ ID NO: 25623 - DNA, 65 bp, Homo sapiens
tggaaggcagaacgttatgaaataatttctgagatttccaagttgatcgttccaatttatgagaa

SEQ ID NO: 25624 - DNA, 289 bp, Homo sapiens
agtgactaggccaggtgtagtggttcatccctataatcgcagcactttgggaggttgaggcaggaggattgcttgagcccgggagcttgagacaagcctgggcaacatagggagaccctcgtctctacaaaaaatatagaaaaaatcggctggctgcggtggtgcgtgcctgtagtcctagctacccaggagactgaggcagaaggatcgcttgagcttcggagttaaacactgcagtgagctgatggcaccactgcactacagcatggtggcaaagcgagaccctgag

SEQ ID NO: 25625 - DNA, 208 bp, Homo sapiens
cacttctagatcctgttcaaactgattcatctctcatgaaggcagggctttaactaatttccttgtttttcccaaccttctctcatctgaaaaaattaacttgattggccgggtgagccaccgtgcctggccaaggctctttgtttttgatcagaggttgttaatttgggttccctggtctccaacatttccctcacttccccctagt

SEQ ID NO: 25626 - DNA, 100 bp, Homo sapiens
atatgataccctcattcatgaagtgaagcagaaagggtctgtaaggaacattctaaacatttttaatgatattgcttttactgatcaagcttgttgtgcc

SEQ ID NO: 25627 - DNA, 326 bp, Homo sapiens
catagtaagatttttttctcttcatttgctttttttgtttcatattaacaattttttttttacacggacacaaccctctgacagtctttccaaatattaaaatcatttgaatatgtatgctgtgatctgaacactgctcaagccatcaagcagtcttcatacagtttgcattataaaatctcattaaattctccaagaaaaaataagttgaagaattttatttcctgaccatgcatcccctggatttctgagtttcagttcagattgtagatgacaatataagctgccttccgaaattgtcaacatctgaatgttaagtccattcc

SEQ ID NO: 25628 - DNA, 158 bp, Homo sapiens
  misc_feature 138: n=a, g, c or t
  misc_feature 139: y=c or t
ttgtaaaatggatgaactacagtatttgaaatagtctaataaatactgagaataaaaatggcacaataccttccctcagaagctcagagccagggggagacagaaatatgcacaaatactatagcatagttgaataanyaaatgtattataaagagca

SEQ ID NO: 25629 - DNA, 289 bp, Homo sapiens
cattggttaggtttccagaatagttcattactagttttgatttgggtatcttgtccccgatttaaatgggatgcttctaagttttaaacttctacaataatatatatcttagatttctagtagaatatttatttatttatttattgagacggaatctcatcccatcacccaggctggggtgcagtggcgcaatctcagctcactgcagcctctgcctcccgggttcaagtgattctcctgcctcagcctcccgagtagctgggattacaggcacatgccaccacaccgt

SEQ ID NO: 25630 - DNA, 167 bp, Homo sapiens
atggatgtattaagaagggagaattttttttcagagtgttttatctcagtgtggctcagaaaagccatttatagggtagggtaatcactagagttgagggttcctccccccaccccccataagattggtatccataaagcagagatttctaagcagtgagagacccg

SEQ ID NO: 25631 - DNA, 324 bp, Homo sapiens
  misc_feature 36: w=a or t
  misc_feature 135: v=a or c or g
  misc_feature 142: w=a or t
  misc_feature 212: w=a or t
  misc_feature 233: r=a or g
  misc_feature 234: r=a or g
  misc_feature 254: w=a or t
  misc_feature 285: w=a or t
  misc_feature 288: w=a or t
  misc_feature 304: d=a or g or t
  misc_feature 310: w=a or t
  misc_feature 313: w=a or t
ttaaattaccataaacgatgtgccttcaagattccwaataactgtagtggagtaagaaagagacgtctgtcaaatgtatctttaccaggacccggcctctcagttccaagacccctacagcctgaatatgtagcvcttcccwgtgaagaggtacgtattctaaggtaatagacattttagtagtagttattctctgtgtttctacagggtgwatgacatcactctagaacatrrtttatatgctaaagaatggwaatgttcctacacttaagaaacataaaatgwagwaatggagacaggactdaccggwagwaatgaattgcc

SEQ ID NO: 25632 - DNA, 232 bp, Homo sapiens
  misc_feature 122: r=a or g
tgtctacttttagagagcactagccagtatatgaccatgtgattaatttcttttcacactagataaaattacctggttcaaaagtggtttttgtttattaaatttggtaataaatatatatratacacagacaggatagtttttatgctgaagtttttggccagctttagtttgaggactccttgataagcttgctaaactttcagagtgccctgagacacttccagccaag

SEQ ID NO: 25633 - DNA, 286 bp, Homo sapiens
cataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccgt

SEQ ID NO: 25634 - DNA, 193 bp, Homo sapiens
ttttagcattttaaattctttgctccttttaaaagcagatttttcaccatttatcaaatctagttcttagctgaagaattatgcttccattgatagatcctttagaaacaaacacataatgaatggctaaagccttataaaattagctgcagatggcacatatcttgagcctaacttaactgggttatcccac

SEQ ID NO: 25635 - DNA, 501 bp, Homo sapiens
  misc_feature 328: b=c or g or t
  misc_feature 329: n=a, g, c or t
  misc_feature 331: n=a, g, c or t
  misc_feature 369: k=g or t
  misc_feature 370: n=a, g, c or t
  misc_feature 371: k=g or t
  misc_feature 464: r=a or g
agctgggagaatgagatgcagggaggaagcatttacaggccccaccgaaaaaccttaaagggctgagagcttgagggcagttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgabncnggcaatattttggcagtgcaactggattcttcagatcknkcccaggtataaaatggacacctgatgagaatggagtcattacttttgactgccgaaaccgcggctggtacattcaagctgctacttctcccargacatagtgattttggtggacgtgagcggcagtatga

SEQ ID NO: 25636 - DNA, 167 bp, Homo sapiens
ttttagtaaagacggggtttcaccattgttggtcaggctggtcttgaactccctcaggtgatccacctgcctcggcctctcaaagtgttggaattacaggcgtgagccaccgtgcctggcaatggcaaattttctaaacatttttacgccatcacaaacctgaaccc

SEQ ID NO: 25637 - DNA, 141 bp, Homo sapiens
  misc_feature 19: s=g or c
tgtaaaattgaaggattastgaagtcaacctaaagcatttctgtgtgctatggttgggattacaatgaccctaatatctcgtttcaaatgcagatttttcaggtctcttgacttcttgctcctcctattagtttcctgcca

SEQ ID NO: 25638 - DNA, 449 bp, Homo sapiens
  misc_feature 362: k=g or t
ctgcttacccacattagtatttggtgtctctgtagttacatcttcattgtgcaggtgatcagcctgatgccagtcgacatttatgttacctcactaatatcccttgtctgatttcatgtctcacaatcagtgttctgaaactttgcttcctaagtaaactaccaacagaaaccctgtgcacattggtcagttggtagcaaattatatttatcactatacattggcattcatccacattaactgtgttgtagtgattaacatctcaccattacttaactctgagaaaatagtgagattaaataccagtctataaggccaaatgacacaccttggacaaaggtaaaatcaccaatataagtgtkatattttgaatcctgtgaaaagctggcaagtagccatacatacaccaagatgcttgtgtaccaagggtatactagtcttgtatttga

SEQ ID NO: 25639 - DNA, 128 bp, Homo sapiens
ttatatcttgcatcctatatcatgtcaatatgtgatatagaaaagagatacgtgaattttttagctaagcttgacagattgaaagacaagtgtcatttttttttgtagagggtgatatataccatgtc

SEQ ID NO: 25640 - DNA, 213 bp, Homo sapiens
tttttacattctaaaaagaagaactgccacaaagattgcatggacctgcagtaccccagatagtcaccatctggcccctattctaagccatttaaaatttagataatacatttctttcactttttaaagctgttatctatgtattattttttatattaaaataccttttatgaattggagaaactctgtgttgtctctgagatgagagtggca

SEQ ID NO: 25641 - DNA, 61 bp, Homo sapiens
gttttgttgtaggaattatagtaatcacaccacattacttggccttcggtaatgtgaaaaa

SEQ ID NO: 25642 - DNA, 206 bp, Homo sapiens
  misc_feature 129: d=a or g or t
catttctacttttattctttgtggtttcctttatgtttacagaatatgcataaatctcagtcttttgctatatgaacttttgacagtttcgcttcactcactattttgtaagatgaagatattagagtdtccctccacttttcctctccacatttacccttcaacttgtcaataatgttttaggttaccttttgcatctcgagggg

SEQ ID NO: 25643 - DNA, 304 bp, Homo sapiens
  misc_feature 109: s=g or c
  misc_feature 110: r=a or g
  misc_feature 285: w=a or t
  misc_feature 297: y=c or t
aatttttggtagagacggggtttcaccgtgttggccaggatggtctcgatctgacctcgtgatccgcccgccttggcctcctagggtgctgggattacaggcgtgagcsrccgcgcccagcctaatttttgtaactttttataatgagacttacacagtgatttaaattatatacaggatgctcagccagcacaaagctgtggtgagatttgggcccaagtctccgactccagattccaaaccacattaaaaaaaaaaaatcacctgcagactgcctatagcttwaacagtctctgyctccctc

SEQ ID NO: 25644 - DNA, 190 bp, Homo sapiens
tgtcatataaacagaaccatgcattacacattctttgtgtccggttttttttgtcgagcattatatctgtgagattcatccgtgttgcattcctttgtttcactgagtagtccattgtatggatataccatggtttgtacatccgttctcttactcatgaacatttaggttctttccagtttttattttt

SEQ ID NO: 25645 - DNA, 130 bp, Homo sapiens
ctcaaatgctttgaatgctaaacagaagagtctgaactttattctgcaagccatggaacggtactgaaagttttagaagaaaggagagacataatctgatctgtgctattcctgatggcaacatggaagg

SEQ ID NO: 25646 - DNA, 155 bp, Homo sapiens
  misc_feature 4: y=c or t
  misc_feature 9: y=c or t
  misc_feature 59: k=g or t
  misc_feature 135: k=g or t
catytcctyccttttggagcaggattgctgggtcatatgatagctctatatttgatttkgtgaggagacttcaaactgttctccatagtggctgtactaatttgcattcccacccacagtgtgcaagggttcccktttctccacatccctgccat

SEQ ID NO: 25647 - DNA, 229 bp, Homo sapiens
aatttatgtagtcaagttaatcatctccatgtgggaaataagaccgagtgtcaggaaaacatcaccaagcatggtgaacgcattcttggtgttggaatggaagagcaatctatttgctcctacttggaaaagattctttctaaaaatatggaactgatggaaaagaaacttatggattacattgatcagcgaatacatgaactccaggagcacattgatgataagattg

SEQ ID NO: 25648 - DNA, 149 bp, Homo sapiens
caaaaacatggttcatgtttgttcagtataactcattaaaatgttacttatcgtttggaattcaggacctccccagccattaacgttcaaggaaaaacaatgcctttgttttgtatataaatctaaaaccacatacagtaagccaaacg

SEQ ID NO: 25649 - DNA, 382 bp, Homo sapiens
  misc_feature 379: h=a or c or t
cactattcgcggaatggctttagaggcagatgaagtggtctttgaccacagttgattgaaccagagcacttattgcttaaagaataacagagttctagagctgggggttcttgggccatgctccgtgtgtggataaggaaagaaatactgtttctgggactctcccacagtcacaaagctgttttcactgtggcccctacatctcttaacttttgctattactcctatgctgccttccggattactgctgtctatcttcttgctccactcactgaagatcctattataatcccatgaaaatgtaaattacagtttacttgggagagccagattttctctgtgctcttgagttttttattcattcaagaaaccttgggchgcg

SEQ ID NO: 25650 - DNA, 220 bp, Homo sapiens
caaagcttacctgcccaagtttatacagtgtggacgtagcacctcttgatggggactttctgaaaacacatgtgggactggaaatactaatttagctgtttatgggaacatacagtctgccacacaatataattcctatgtcttttgcaatggctttataattttcaagtatgactgataacttatatttccctacattgtttttacaaaatagacactc

SEQ ID NO: 25651 - DNA, 233 bp, Homo sapiens
  misc_feature 21: w=a or t
taagaaactttgaagggctawttcagtagtatagaccagtgagtcctaaatattttttctcatcaataattattttttaagtattatgataatgttgtccatttttttggctactctgaaatgttggcagtgtgggaacaatggaaagagcctgggtgtttgggtcagataaatgaagatcaaactccagctccagcctcatttgcttgagactttgtgtgtatggggggagg

SEQ ID NO: 25652 - DNA, 105 bp, Homo sapiens
tacatgggttcaattttttttctttaactcccacatatgggtgagaacatgcaatgttcatctttctgtgcctggcttatttctcttaacataatgtcctctgcc

SEQ ID NO: 25653 - DNA, 246 bp, Homo sapiens
  misc_feature 13: v=a or c or g
  misc_feature 244: b=c or g or t
tgactgttcagcvtcatcctctgcccttcccttgtgtcctgggctctggccaaatcaaaccaccgttccccaaatgtactatgtagttaacttttaatattccttctttttattgccttggttctctcaaaaatcagaattaatggaatgttggctattacaattacgtggacatggttatataatggccttggcgatgcccttaataaatgaaatctaaaatgttacattttttttggaaccbtc

SEQ ID NO: 25654 - DNA, 78 bp, Homo sapiens
ctgggttcacaccattctcctgcctcagcctctgtagccctagtggggtttttttttgtttgtttttgtttttttttt

SEQ ID NO: 25655 - DNA, 208 bp, Homo sapiens
  misc_feature 41: w=a or t
  misc_feature 52: d=a or g or t
  misc_feature 53: r=a or g
  misc_feature 58: s=g or c
  misc_feature 81: s=g or c
  misc_feature 92: k=g or t
  misc_feature 106: r=a or g
  misc_feature 148: w=a or t
caaattgcttaatctctctctgccttggcctccttgtctgwaaaatggggadratatsaaccatcttataggattgttgtsacacttaagtkatttaatgtatgtraactttatagagtaatgcagagctcctagtaatgtcttgtgwttgctattagaatggatgcttcaaagaactcaaatttcgtttgttgaactaatgcccttc

SEQ ID NO: 25656 - DNA, 160 bp, Homo sapiens
  misc_feature 11: k=g or t
  misc_feature 12: h=a or c or t
cctaataatakhtaagaacgttttaaaacccagttgccctttgcagtgtgcgtcatcagaaccgtccagtcttggggtgccttccataaatgagaactttgtgatctcctcttccacgaatgagatatttagttattttgttgaggagtgataccagccg

SEQ ID NO: 25657 - DNA, 338 bp, Homo sapiens
  misc_feature 327: k=g or t
aagtaacttgcttgaaatcaaacagctggaagcctccaagtgtggttttgattccacaaggacaggggctataaaccttgctcatgtcctgaatcctcctttataaatatgtgctgaaaggatggatgggtggatggatgaacgaacagtaatgaattttttatttttctgtccctccttgactctctgattctaaattgctctgccctgggtgtggatattgactttcctgcaagtactaacttgtgcccatctcttggatttaatttttgttccctcttcagactacgcttcttgcttccccagacctcttattatctgccagtkcccatgggtat

SEQ ID NO: 25658 - DNA, 90 bp, Homo sapiens
  misc_feature 49: k=g or t
atgtgtctttgttctcgttggtttcaaagaacatctttatttctgcctkcattttgtgtatgtacccagtagtcattcaggagcgggttg

SEQ ID NO: 25659 - DNA, 160 bp, Homo sapiens
  misc_feature 156: k=g or t
  misc_feature 157: y=c or t
taggttaaactactttgcaaattttctatccaagcagaaaatggtaagtttttgatcaatattttggcactactgcagaaagcagttaacaatgttaaatcctcccttctgaaggctggaagaaatgaagataatgcccccaagtgtttgacgaakycat

SEQ ID NO: 25660 - DNA, 135 bp, Homo sapiens
actgtatcttcttattacgagtttttccattgtattaactgcttttacaacaacacaaataacaagttattttacaaaccatttagaaatttctgtactatggtcccagtaatgtaaaatatattaatgcctatt

SEQ ID NO: 25661 - DNA, 374 bp, Homo sapiens
tacaataaaatgtaccagaatcagtgtacagtggatgagattcaacaaatgtgtacagtgccacaatcaagataaaagaacgtttcaatcactttgaattataataaatagtaatatattgtcccaccaatgggctgtatcaaattgtgttactaccagcggtgtttgagagcaactgttggtttttttgtttctttgtttaagagatgggggtcttgcctttatggtccaggctggagtgcagtggtgtgatcatggctcattgcagccttgacctcctgggctcaagcaatccccccgccttagcctcctgagtagctcggactacaggtgcacccagttgatttttaatttgttgcagagatggggtctat

SEQ ID NO: 25662 - DNA, 183 bp, Homo sapiens
  misc_feature 150: k=g or t
  misc_feature 151: r=a or g
aattaaatttgtgtaagccccacaaaattcaaaatttatgtgcttttctgaccacttgccttctagtggaaattttaagcatattagaggatatgtttctgtgggagctgatcagaatggtactaggagtacaaaagaatatctaaaackraaacacagctatatttcagatcatactgcttc

SEQ ID NO: 25663 - DNA, 286 bp, Homo sapiens
  misc_feature 242: r=a or g
caattccaaggttaataagtactacagcaacctaacaaaaagtgagcggtatagctccagcgggtccccggcaaactccttccacttcaaggtgagtgagccacctattccaccttccccacctggcttagctgctgtaagggatggagggttggagtcgctggttggggacttcttcgtatttccaaaccctggacagtgctctaaactctgagctgaggatatacttgttaagcagggarggtattattgatttaaaataaatttcattaccttggaactgggt

SEQ ID NO: 25664 - DNA, 299 bp, Homo sapiens
  misc_feature 274: s=g or c
  misc_feature 275: r=a or g
ttttatccatgccaagcgatgatgattttctctttagtgacagacattttttaaaaaataaattcacataaaaaagtagttttacagatgaagcactaaaactagtgcatttcatcttaaactgcaaattataaagggaataatagtaacttgacagtggagagacctggcagacaccaccttcaccaactgatcaaagttaacatcgccagaaaggggacagatggcatgtgcctctcgataagatgcactgaagacacacactcacttctgsratattcctgccaagaatgcctcgt

SEQ ID NO: 25665 - DNA, 344 bp, Homo sapiens
ctaccaccagttccagatgtagaagtctctcccatgcttttcctagtcaacaccagtcacaaaggtaaccactattcttacatcactgtagatttgttttgactatcttgaacttcatatgagtgaaatttcacagaataattttctggagttagacttttttcactctgtgttatgagatttatccatgctgtttaatgtgtatttttctttgttttgttttgtttttaattacagcttagtattccatagtataactatagtacaatttatttattcattcttctgtgggtggatacttagactatttccagtttttgcttattatgaatgaaactcaggaa

SEQ ID NO: 25666 - DNA, 186 bp, Homo sapiens
  misc_feature 2: n=a, g, c or t
  misc_feature 18: d=a or g or t
  misc_feature 148: r=a or g
  misc_feature 155: n=a, g, c or t
cnccttttattttgagcdtctagatccttttatgtgatgtgttgctgtcatacatagctcacattgggtgggaacagagaagaacattgtttccgtggcccaaccctagggacatggaactcattttattatacagtgaaattttaaratttganaccaagatcagatctcaacaaacagagctcc

SEQ ID NO: 25667 - DNA, 188 bp, Homo sapiens
caaacttgtccttcctgtagaatttccaatctggctaaataatgtcacccatctacctaacctctgaagctagatgtcatggagtcatcctagatacctctaccagctcagtacccatgttcagctgtcatcacactctgtctcttgaatctgtccctatccctcctctctctgcactgccaccgcgc

SEQ ID NO: 25668 - DNA, 228 bp, Homo sapiens
catattcatgtataaatctacctgatttcatttatttattgaggtaaaattcatgtaacataaaattaagcatttgaaagtgtacagttcagtggcttctagtacatcctcaatattgtgcaaccatcatctctatttagttccagtattttcagcatcccaaaaggaaacacagtacttgttaagcagtcattccacgttctttcttgccctaatccctggccacat

SEQ ID NO: 25669 - DNA, 234 bp, Homo sapiens
  misc_feature 34: v=a or c or g
  misc_feature 72: m=a or c
  misc_feature 79: s=g or c
  misc_feature 89: v=a or c or g
  misc_feature 91: v=a or c or g
  misc_feature 97: s=g or c
  misc_feature 196: m=a or c
  misc_feature 214: y=c or t
  misc_feature 234: s=g or c
taacaagaacagctaactatcctaaatatatatvcacccaatacgggagcacccagattcataaagcaagtmcctagasacctataaavavacttasactcccacacaataataataattcctggacacatacactctcccaagactaaacctggaagaagttgaatccctgaatagaccagtaacaagttctgamattcaggcaataattaayagcctactaccccccaaats

SEQ ID NO: 25670 - DNA, 191 bp, Homo sapiens
ccatgtttttctgatttctttgtttttcttcaagccataagccgttagtagtgttcttttgaaaaagtcagtattggctgatcacagtggctcacgcctgtagtcccagcactttgggaggctgaggtggttggatcgtttgcactcaggagttcgagtccagtctgggcagcatggtgaaacccccattg

SEQ ID NO: 25671 - DNA, 209 bp, Homo sapiens
cagtactcctccaaggcatctctcatgactctggttttttcaattcccctattatagtatagtagttcaaaacttaagatgcccttgattataagaaatactattacttatgtgctttttttacaagattttcaattgtaaggataaagtaccagtgattttaaggtgcatcccaatttcatagatgctcaaatctaaaaatgtaggca

SEQ ID NO: 25672 - DNA, 64 bp, Homo sapiens
  misc_feature 50: y=c or t
  misc_feature 51: y=c or t
  misc_feature 61: s=g or c
  misc_feature 62: m=a or c
  misc_feature 63: m=a or c
  misc_feature 64: m=a or c
cttgggaaatgtggttgtgtgcgtatgtattatttttttttaatggatgyytatataggasmmm

SEQ ID NO: 25673 - DNA, 131 bp, Homo sapiens
tttattatttcatgatactattataactgattatttcagtttgggaaaccaaaagtgttttttaaaaatgagtgactaaaaaattgtcaggctggagctacatcactagttgtaaaaatacacaaacctgt

SEQ ID NO: 25674 - DNA, 116 bp, Homo sapiens
cactagggaagcatttgtttcctaggcacctttggaaggtgctacattaatgaatttgttttattattttagataaattgtttttccctatttttagaatattaataaagtcaggc

SEQ ID NO: 25675 - DNA, 215 bp, Homo sapiens
atgaaccacataatgaagggcttagagttctttcagaatatcattaaagacattttcaaaacaactttttttctctctctcatgaaaaaggaagcacagtttttaaggacaatctccaaaatacagaaaggtgtataaagaaaaatatgaagatgactcataatctcttcaaccagagataaccactgttaacattgtggtgtatgtactgccgc

SEQ ID NO: 25676 - DNA, 123 bp, Homo sapiens
tttccctaggataaatttttggaagtggaaaatttctgggtcaagagtatgctcatttaaaattgtgattcattgccaaattaataggccagacttttaaagaggcaggtaagtctagatgca

SEQ ID NO: 25677 - DNA, 108 bp, Homo sapiens
cacaatgttgtgcaaccatcacctctggttgcaaaatattttaattgctccaaaaggagatcctgtgcccattaaagtcattcctcagttcactcctctcacagaccc

SEQ ID NO: 25678 - DNA, 363 bp, Homo sapiens
  misc_feature 295: n=a, g, c or t
  misc_feature 296: b=c or g or t
  misc_feature 333: r=a or g
taggcaataagtaaagttcagtaggctagggtgcttaaaatagttgagcgtggccgggcatggtggctcacgcctgtaatcccagcactttgggaggccaaggcaggtgaatcacgagatcaggagattgagaccatcctggccaacatggtgaaactccatctctaccaaaaatacaaatattggctgggcatggtggcgcgtgcctgtggtccagactactcgggaggctgaggcaggaaaatcgcttgaacccgggaggcggaggttgcagtgagccgagatcgtgccactnbactccagcctgggtgacggagcgagactccatctcaraaaaataataataataataattaagcgtga

SEQ ID NO: 25679 - DNA, 106 bp, Homo sapiens
  misc_feature 24: n=a, g, c or t
  misc_feature 95: k=g or t
aggatgcttgaacttttgaaaacntctggggcccacagtctgttgtttcctcactgaaatggatgctgatcagtagaaataaatacatttctggkgccttttctca

SEQ ID NO: 25680 - DNA, 214 bp, Homo sapiens
  misc_feature 64: r=a or g
  misc_feature 112: r=a or g
caattttatgtttggttttggctttgtggggtgtctgattaattgaaagtgagtggaattctgragaatgagcaagaagagactaggctgaggataggagtgagagcacacrcaggtggcaccataaatctctcctaagctgtagtcagtgcacaggaaagtccatggcctaaaatcggggttatgcacgccccccaccgccacacacacacca

SEQ ID NO: 25681 - DNA, 204 bp, Homo sapiens
  misc_feature 172: s=g or c
  misc_feature 173: s=g or c
  misc_feature 202: y=c or t
ccacccttttgggattccatgagttgggatgcctaggtgacccattattttcatcattacatactttgcattctagccagttattctataccaaaatagatgtttactgaaaaaatctttttgaaacaattccaatatatttagatccccaaattatattctactgtatttsstatattattacaaataacattgcaatggygc

SEQ ID NO: 25682 - DNA, 206 bp, Homo sapiens
tttgactattaagggccccttgcaattccatatgaatttgaagattggcttttccatttctgcaaaaaaaggatgttgaaatatgtttttttttcctttgagacggagtctcactctgtcgcccaagctagagtgcagtggcatgatctcagctcactgcaacctcttgtttccaggtttaaatgattctcctgcctcagcctccc

SEQ ID NO: 25683 - DNA, 102 bp, Homo sapiens
tgacttaaaatttgcaaatggaaaccgaaagcagtcttaaagtttgatgtatgtatagctgctcttgcatgcttttggtttccatttgtgtggaatgtattt

SEQ ID NO: 25684 - DNA, 259 bp, Homo sapiens
  misc_feature 4: v=a or c or g
  misc_feature 5: v=a or c or g
  misc_feature 25: v=a or c or g
  misc_feature 31: v=a or c or g
  misc_feature 61: m=a or c
  misc_feature 75: v=a or c or g
  misc_feature 84: v=a or c or g
  misc_feature 104: m=a or c
  misc_feature 109: r=a or g
  misc_feature 117: v=a or c or g
  misc_feature 122: r=a or g
  misc_feature 123: v=a or c or g
  misc_feature 136: r=a or g
  misc_feature 146: v=a or c or g
  misc_feature 195: m=a or c
  misc_feature 198: r=a or g
  misc_feature 202: r=a or g
  misc_feature 206: v=a or c or g
  misc_feature 208: m=a or c
ttavvactatgaggatttctaagavtttgtvatttttttagctctagttttggtgatttamtttctaagagtagvactcaaatvgaatttctacaccaattccmaagarcataaatvttttrvacaaacacatacrtgtgcatgcvtgtacacacctacacacagacacatacccatcttcataccttaataaamggrtatraatvcmgctaatttgggttctacccatacactatttttttgtgaatcttgggcaaac

SEQ ID NO: 25685 - DNA, 390 bp, Homo sapiens
  misc_feature 141: k=g or t
  misc_feature 142: h=a or c or t
  misc_feature 275: k=g or t
agattggtacttttcaaatcagatatgggtatgatttaccaggttttatggcttcaggttatctaacctttcttgttcagctttcttacctatgaaatagggtgagaaatgtctaaatcattattctagtcatgtgaatgkhtactgagcatcttctgtgtgctccagtgtgtaagggttaaatgagattacttacgttaggtgcctggcacatgagaggtgttcctttgatgtttgttccaattttctctattcaggtaatttttcaggctgaktatctttttatttagaatctacatcaggagacaaacccgtatcacattcttgcacaactccttccacgtcttctgcctctggactgaaccccacatctgcacctccaacatctgc

SEQ ID NO: 25686 - DNA, 452 bp, Homo sapiens
  misc_feature 279: r=a or g
  misc_feature 280: w=a or t
  misc_feature 305: m=a or c
ccgcccgcctcagcctcccaaaatactgggattacaggcctgagctaccgcgcctggctggtaaccagattttaatgaagatttcagaagtggagatgatgccacttccctgactgtatcactctactttttaaaaccctgttttactggtgaatttataacaggaacatatttcttacctccagcaccactatcaaggctgttcagcctacacactgaaactctgtatcattccttctcttatgtttttttttctttttgagacggggtctcactctrwcacccaggttggagtgcagtggcamaatctcggctcactgcaacctctgcctcccaggctcaagcaattctcccagctcagcctcctgagtagctggaaccataggtgtgcactaccacgcccagctaattttttgtatttttttgtagagatggtttcgaactcttgagca

SEQ ID NO: 25687 - DNA, 317 bp, Homo sapiens
  misc_feature 141: b=c or g or t
  misc_feature 192: r=a or g
cggggtggttttaatgctctaagttggtatgattactttttctaaagagctcaaagtgctttggtgccatagtatgaatttcattacccattgtgagacacaaagggggttagcaatgattctgtttgcaccctggaagcbaaaggcaggttactcacccacttagttccctaccacaagaccttgaaagaractggaaccccaggtctccagcccagagattttgttggaagtttccatttgcaggaaatgactgcagggcacatgtgggaagtggcaggaatttgaggactaacattttagttttcctcatttct

SEQ ID NO: 25688 - DNA, 394 bp, Homo sapiens
  misc_feature 104: k=g or t
  misc_feature 282: d=a or g or t
  misc_feature 319: w=a or t
ggctgcgcggcggagagtagagagctagagggtgagaagcgctgggccggaccagaactgtcttagcttttccctctgcggctgctctggttggttactttgakcctgcctcctcagcgccgcaggagagacttaacagcaaaaatgactgtgtcctgagttcagcccccactgctctgggagcttccccctggtttctgcacctgaagaatgtcatcccagccgaagttcttaggagcggggagcgacaaagaaaaacaaagaaaagcagacctgaaaatdgggacctgggagaaatagacgagtgctctaaaccagwcatggctccagttcctctgacaaggattcacatggggttgcaattctgactgtgctggtgatgctggttccaggt

SEQ ID NO: 25689 - DNA, 324 bp, Homo sapiens
  misc_feature 270: r=a or g
  misc_feature 292: w=a or t
ccctgcactttgggaggccgtgaggggaactgcttgaacccaggagttagaaaccagcctgagcaacatagtaagaccccatctctacaaaaaaaatttttttaattagccagcgtggtcatgtgcctatagttctagctacttcggaggctgaggtggaaggatcacttgagcccagaggagagaggctgcagtgagctatgatcgtaccactgcactccagcctgggcaacagagcgagaccctgtcccccccccaaaaaaaaaagaraagaaaagaaaaggaaaaagawtaaaagaaatacgtaagagaaaggaccaagtc

SEQ ID NO: 25690 - DNA, 243 bp, Homo sapiens
agagccggcgtttccgtagagccgggcgggagtcgccggggcttcttcctgtggtgcagcttcgggtctcggagtttggcccctactctgaccccaccccagctccgctccgccttgggttccccggcagaacccgccttgcggtagccatggcagcaggctccgaggcgaccactcctgtgatcgttgcggctggggctggaggggaggaaggtgaacatgtcaaaccttttaagccagagt

SEQ ID NO: 25691 - DNA, 147 bp, Homo sapiens
tgtgaatatctgcaaaggattcagtgatgtgacctgtcttcaagtctcccagcagtggataccagcacctgctctggtagatgtagactctctgattccttgattgtagatagtcttaatgtgctggctttcttgaaggtgggtttt

SEQ ID NO: 25692 - DNA, 262 bp, Homo sapiens
  misc_feature 112: r=a or g
caggaaacaacaggtgctggagaggatgtggagaaataggaacacttttacactgttggtgggagtgtaaactagtcaaccatcgtggaagacagtgtggcgattcctcaargatctagaacctagaagtgccatttgacccagccattgcattgctgggtatatgcccaaaggatcgtagatcatgctactataaagacacatgtacatgtatgtttattgcggcactattcacagtggcaaagacttggaaccagcaccg

SEQ ID NO: 25693 - DNA, 133 bp, Homo sapiens
  misc_feature 97: r=a or g
  misc_feature 98: k=g or t
tggacagaaaacggaagtgaggtacagaaacagctggactggttacagctccacctttgccttatttgaacatggtttgacagttgaccacctgtgrktggctaaaactgggcgattggtacaaaagtaggtt

SEQ ID NO: 25694 - DNA, 187 bp, Homo sapiens
tcttaagtatcttaagagaactttctattttttatgtattccctctcataaacaagaaattatttggcagtctgaatagttttataagttatgttttatatttcttaagttttctctcataatgaattatatgtatatcttgagtattggggaaatacattatttcttcaagtagaaccgctccaac

SEQ ID NO: 25695 - DNA, 318 bp, Homo sapiens
cggtaagagggcagaagaaaatgattctaaacttagatttttttaacttaagtgatgaagtgtgaaacgccatttatctttgaggaagctacctaggaagtggctcatgtcgatggcccaaatcagaagagggcctgtaaaagcttctatcaattttgactgtgtatgcttctaccatggcggctcaataaacagcagtattagtttaagagtggatggtacagtagtatagacgggaagcctctcctctccgtgtgaaccgtgcacccctatgagagggtagagacaatacaatatgcctgtaacgtcaggaccgca

SEQ ID NO: 25696 - DNA, 476 bp, Homo sapiens
  misc_feature 81: k=g or t
  misc_feature 116: r=a or g
  misc_feature 127: w=a or t
  misc_feature 128: r=a or g
  misc_feature 383: r=a or g
  misc_feature 449: r=a or g
  misc_feature 455: w=a or t
  misc_feature 456: k=g or t
tgtactgcacccattaactcgtcatttacattaggtgtatctcctactgctatcccttccccctcccccaccacacaagakgccccagtgtgtgatgttccccttcctgtgtccargtgttctcatwrttcaattcccatctgtgagtgagaacatgcggtgtttggttttttgtccttgtgatagtttgctgagagtgatcgtttccagcttcatccatgtctctacaaaggacatgaactcatccttttttatggctgcatagtactccatggtgtatctgtgccacattttcttaatccagtctatcattgatggacatttgtgttggttccaagtcttcactatcgtgaatattgccgcgataaacatacgtgtgcatrtgtctttatagcagcatgatttataatcctttgggtatgtatccagtaatgggatggctgggtcaratggtwktctagttctagatccaaggt

SEQ ID NO: 25697 - DNA, 281 bp, Homo sapiens
ttaattgatgtgattcgtaaattgtgttcctcaaagataaccttgggttttattttgatgttttccctactctcctaccccctattctgttcctgtgtctccacattttaaagtatcaacaggaagtgtgctattcacttccctttcttgttgcccaggctggagtacagtggtgcgatcttggctcactgcaacctccacctcctgggttcaagtgattctcctgcctcagcttcctgagtagctgggattacaggcatgcaccaccacacctggcagtg

SEQ ID NO: 25698 - DNA, 278 bp, Homo sapiens
aactcaaataactaaatttcagaaaattaagaagctgactttatatttggtggtttgaagtatcttgttgttagcatttgtaataatgctaaaaaaggcctaataaaatgcccaagaaaatattcagtgcatttatagagaaggatattttgtagtagtatagtaatgtgttatgtagtacagttttaaagctataaatggaattttgtgtaaattcacaaaaatgtgatataaacaggatctaagactggattccctgtcactaaactgcaccccac

SEQ ID NO: 25699 - DNA, 73 bp, Homo sapiens
  misc_feature 31: s=g or c
  misc_feature 32: m=a or c
  misc_feature 51: y=c or t
  misc_feature 52: y=c or t
  misc_feature 58: w=a or t
caatgattacaagtcaagggtaaggattaasmttttcatacattttggagyytttcgwgtttaaaaaaaaaat

SEQ ID NO: 25700 - DNA, 225 bp, Homo sapiens
  misc_feature 52: b=c or g or t
aggaaatacagacttgccacaagtatggttctcttgcagcaggttgcaaaabcgctcgattggttcagcgcaacagatcggtacataagtgcgtccgttacttgactaatttgaaattggcggaacgggttggcccagatgccgatatcattttccgtttcgatcacagtcgcataacggaatactgtctcggattcacgccaggtcaacgctaccacccgcacg

SEQ ID NO: 25701 - DNA, 462 bp, Homo sapiens
  misc_feature 121: r=a or g
  misc_feature 125: r=a or g
  misc_feature 130: s=g or c
  misc_feature 132: m=a or c
  misc_feature 255: b=c or g or t
gcttcttttcttcttgatctagtatatcatcttctcctgcccttggatgtgagtgggccttcagacttaaaccaggagttacacctttggcttccctggttctcagttctttggacttggrctgrattasamtgccaggtttcctggttctccagcttgcagatggcagatcatgggacttcttggcctccataattgttttcatatctccaggcctttcattgggtcaggttggcatttcgctgccctttatgbgtgtgacaagtgaaaataaggaaagaaaaaaactcaactgaagaaaatcagaatctgcgcagagtatcctgggcgtttcagctgcttcccacatcacctgcctcatcaagccccagcatccatctccttgctcatcttacaccctgtgtgcatgacaggcccaccattcatttatcagagcaaaggctctcccactattctggttca

SEQ ID NO: 25702 - DNA, 266 bp, Homo sapiens
tgtgcagcacaacagattttatcatgaggagctcaacgcgcccatacggagaaacaaagaagagcccaaggcccggcccttgagagtaggtgacacggagaagccagagcctgagcgggtcccctcctaaccgcaagcgtcctgctaacgagaaggcaactgatgactatcattatgagaagttcaagaaaatgaataggcggtactgagttgtgcagagtgggatgtaaatatcgccttcctctccctatatccctcccatgaaa

SEQ ID NO: 25703 - DNA, 362 bp, Homo sapiens
cctttactgtatcgggccctgagctgggggtggactttggtgtgaactgccctttgccttctgtgggagcccagtgtggtcgggcagaagtctatgcacacctttgataaatctggtgatagaggtgtcctgggtagtggggaactgtattaaagaacatgttgggccaggcgcggtggctcacacctgtaatccaggcactttgggagtctgaggcgagaggatcgcttgagcccaggaggtcaaggctgcagtgaactatgatcgcgccactgcactccagcctgggcgacagagcgagaccttgtctcaaataaataaataaataaagaacacattggtgtttgagaagtaggcagctc

SEQ ID NO: 25704 - DNA, 169 bp, Homo sapiens
ttatatatgatctatatgtgtatatatttgatatatatcatatatatgatttatgtgtctcatatatcatatatatggatgtatacattgtgaaacccaaaaatctgagacaggtctcatttaaattagaaagtttattttgccaaggttgaggacgcgcgcccgtaac

SEQ ID NO: 25705 - DNA, 441 bp, Homo sapiens
  misc_feature 387: r=a or g
agtatgtatgtatatatgtctaatttctgtatgtgtgtgtatgtattttctaatttgaccgtgaaagcaaagcagatgagctcttgctgttctgcagactccggcatgggcctgcctagtgtgtctgtcctctgcatttctattgatagcaccagatcccctgcggcccgtggactcctccccactgaccccaacctcattgcatgcttggaggacaggacaagggccaggagacaggatccttccggtccttcatgtctgagatgaggagatagagcaacaaagaacttctaggtctttgaagagacttttgtcaccaggaaaagtatttgtttttaaacttaggaaatgaagtacaatgagtgggaggtgccctgaggtgggaargccctgtggtcactgtgcggtctctctcattggtgtctgacacacccatcccca

SEQ ID NO: 25706 - DNA, 297 bp, Homo sapiens
gctttctccaccacctctactgttttttattatttcatctttactagtcccattatgtttgcagaaatttgctttcttcagattataagagagtgttaaaatcattcaatctgttagcaactacctgtaaaagccataaaaatttgatagtacccaactttgtaatgagtggacattattaggtgtaatttattttcttccatagtaattgcttttaacaaggaagaagtgacagatataatctaaattgagtttaataagcatttttactttggcattttccataacagcccagac

SEQ ID NO: 25707 - DNA, 365 bp, Homo sapiens
  misc_feature 69: r=a or g
  misc_feature 79: r=a or g
  misc_feature 111: k=g or t
  misc_feature 112: w=a or t
  misc_feature 114: m=a or c
  misc_feature 126: d=a or g or t
  misc_feature 127: k=g or t
  misc_feature 134: r=a or g
  misc_feature 312: m=a or c
aattatttgtcaagctctatgtacgttttatgcagtttctctctctgtgtgtgcgtgcactattttacrataagaaagrataacgacaaaaagcttagaactgggttacckwgmtgttaggaatgdkctgtaartcacctcgcttcctcacgggtgaccttgaactaatttttcatccctggacttaactttccttcccaactcttcttctgtggtaactattccatcttacagccagaaacactgtagtgctgtgaaacttgcttccttcatcttaactgaggttagccctaagtcaaggctattgctgamtcctgttttcagattcgtttctattcttcttgcatttaaggtagaataggctt

SEQ ID NO: 25708 - DNA, 97 bp, Homo sapiens
tcagctaagaggctaataaaaagagagtggtgacttggatcggggtgtagcagtggaagtattgagatggctggattctggatagattttgaaggcg

SEQ ID NO: 25709 - DNA, 121 bp, Homo sapiens
  misc_feature 120: r=a or g
tagagatggggtttcgccatgttggccaggatggtctcaatctcctgaccttgtgatctgcccgccttggcctcccaaagtgctgggattacaggcgtgagccactgcgtccgaccgcarg

SEQ ID NO: 25710 - DNA, 243 bp, Homo sapiens
aaacaaacatttgtagttttgataatgaggatgatacagggaagtttctcatatttcctagcacagaatctagcactttgtatatgctgaaaaaagttagtttcttatctctactcccttcctttctggatcatgcagagcaattccattttcttctttaacagatgaatgaatgtctggcacctacctctgctcagggatgttactcatatagtgaggctgcaactcttatgaactcgacgc

SEQ ID NO: 25711 - DNA, 199 bp, Homo sapiens
ctctttacataaccctatatttcttagaggttttgttcattttctaaattataatttacctcaggttgggggtgttttcacaggggaatgccatgggtgtggggtgctgcaagtgggagtgctccagtgaggagggccccccaggcagggggtattatagccagcatgatggggagtgctgcaagcgagggggccgaga

SEQ ID NO: 25712 - DNA, 165 bp, Homo sapiens
  misc_feature 55: m=a or c
tacgtatttctctttaaaaatcaacctgtgattaatatatctatattcttaggcmgggcgtggtggctcacgcctgtggtcccaaagtgccaggattacaggtgtgacccaccatgcttggcacgctaattttttatttttacttttttgtagagatggggcgaa

SEQ ID NO: 25713 - DNA, 475 bp, Homo sapiens
ttaggaatgaaggagtaagtagttatattttgggaacaacttgtcttttttaaaaaattgaattacaacacagattttgtccatcttatagtgaattagataaaggttatcactagggaagggcagaaaatgagatttaaactaatccaaatcaaattcttgctcactatcctgaagatcaaacacttgagccctcccacagatctggaaagaaaaggcctcccaccaaggaagcatgaccatcctgcctaaaatttgaattaaaaatccagttggcccagctcctcagtgggtggattctggaaagggatggttacccagggtgaacacagcatcctctgggaagggcttgttggaatcagccaggtttagcctgggctataggaggaagcctggcctcttatgtgttactaatccgtgatccagagagactcatttaaaaaggcctcagccaggcgcagtgatgcacgcctgt

SEQ ID NO: 25714 - DNA, 444 bp, Homo sapiens
  misc_feature 335: n=a, g, c or t
  misc_feature 337: r=a or g
cagtttctgtaatcatttctcatatggtaaggtttttagacttttcaccattctggtcattctcttccagacactccagtttttcagtgtcttcctgaaagtgtggcttcgagacctggacctggactagtcatgctgtgggagtctccccactacttacccgtgtgctcagcctgcccctcctggcacataatgttgactaaggcacagcccaaggggaggcagccactataactttcctagatctagggatagttattttttgtcattttcgaggcccttccttcaggctgcatgcagaacagatgcaggtagccatgaagccaaatctggangrgagatgatgcttcctctgaagatcagtaagtaaccaagagtgattaactgaacaggtgctagttcttaatacacatggaagaaagatttgctacaggtgtcattaat

SEQ ID NO: 25715 - DNA, 122 bp, Homo sapiens
  misc_feature 101: s=g or c
  misc_feature 122: n=a, g, c or t
tagagatggggtttcgccatgttggccaggatggtctcaatctcctgaccttgtgatctgcccgccttggcctcccaaagtgctgggattacaggcgtgascactgcgtccgaccgcagggn

SEQ ID NO: 25716 - DNA, 247 bp, Homo sapiens
ttgaaagatttacagacttaaattgtaaaggaaggtaatttagagagaagaaggaaataaacattatgttggtttggttataaccactggcttgtctccactgacatggcctgggggtgagtggtgtatttgcaaagctcctttcaggtctgcattaatctctggcattagttggctgtgaccgattagcctcccagttaaagtatgtagtcagttcttagtgatggtaaatgggttactgaggcat

SEQ ID NO: 25717 - DNA, 245 bp, Homo sapiens
  misc_feature 236: k=g or t
caagtgagttgagtcatgggtgtttgagaaatgaatagaatatgtagaattatttcttttccaaaagagggaatgtcttgggaaagaaatcaaagggaacctgggtgatatctttgattcatccccctatctagtgccaacaagaacaagtttctttctttcttttcctttttctaagaatggatttcatgtaagccaaaagaacacttgattgttctgaacttgtatatattgckagagttaac

SEQ ID NO: 25718 - DNA, 137 bp, Homo sapiens
ttgatatgagtaaacaagtatctctacctgaaatgattaaagactggaccaaagagcatgtgaaaaaatgggtaaatgaagaccttaagataaatgagcaatacgggcaaattctgctcagtgaagaagtaacagga

SEQ ID NO: 25719 - DNA, 331 bp, Homo sapiens
taagaaaacaaacaacccaattcaaaaaagaaataggccgagctcaatggctcatgcctgtaatcccagcactttgggaggctgaggcgggtggatcacttgaagtcaggagttcgagaccagcctggccaacatggcgaaaccctgtctctactaaaaatacaaaaattagcccagcatggttgtgcacgcctgtaatcccaactacttgggaggcaggagaatcacttgaacttgggaggtggaggttgcagtgagctgagatcgcgccactgcactctagcctgggcaacagagtaagactctgtctcaaaaaaaaaaaaaaggaaaa

SEQ ID NO: 25720 - DNA, 101 bp, Homo sapiens
acggctgaaaagatggtcagaaggggaaaggaggaagtgagaagaaagaaacagggaaatgacagagtgttgctcagttacccaggctggagtgcaatggc

SEQ ID NO: 25721 - DNA, 426 bp, Homo sapiens
  misc_feature 410: w=a or t
  misc_feature 414: w=a or t
  misc_feature 417: k=g or t
aacagtctatttctgtttgtaaatattagtatttctgtggattctgtacttgttccttgttatcctttcattctcttaggttcatttggtctgatggattcaggtaccattgaaattctgatagtttcaaaatcttttatctccaggtttgatctctcttgtgaactctggaactgtattcccaattgtcaattggacatccctacgtatgggacctcagatatttcaaacatgatgtgtccaagtctgtatcacttctggccatcatattgttcttttatttttccaaatttcacatcaccagtaacaaactagctgtgatcatggcagatagcctggaaataaaactcccctttttaccctttgcacagcaaattgacatcaaatcctgtttctactttttttttttwaacwatkgcttcccta

SEQ ID NO: 25722 - DNA, 152 bp, Homo sapiens
tttgccaattaggagtgtaaataaaggttttctgttatgtgatagtattagtaggggtgtatgcaactgtaaggacaaaaattgagactcaactggcttaaccaataaaggcatttgttagctcatggaacaggaagtcggatggtgggacg

SEQ ID NO: 25723 - DNA, 130 bp, Homo sapiens
tttgcccttctttttccagtttcttaaggtagcaacttagcttattgatttgagacctttcttctattgtaacaagcactgaatgacataaatctcctttaagcactgctttagctgtgctccacacaat

SEQ ID NO: 25724 - DNA, 355 bp, Homo sapiens
  misc_feature 123: w=a or t
cttatgtttttatagtgctgacttgctcatcagttttgcacagtggcaattttgggactgatttagaacagaaactccattggaaccccgaggacaaagtaagaacttacagtctataaactwagttttatattaaagatggttattttgattgatcttgatatgtttttcatttcatcagtaacaatgaaagtcttctggtagaataatcagttctgtattaaaattattttcttgatatggtagggtttatgtagaaccttccatattctcctgtcacctgtgatctgtagatattgtcaaaatatgaagagcattgcgatggcagaagagttttctgagaaattgactcccc

SEQ ID NO: 25725 - DNA, 429 bp, Homo sapiens
  misc_feature 176: w=a or t
cctttctacagttcctgctagatagttctcagccttcaagttgaagggcagaggactgagtctgtcttgctgctgaacacatgttaagtatttaagtgtttgttgatccactcacatcgtaaagttcacatcactcaaaatgattgtatatgcacactttgaatttaatgttctgwttataacctcggactctgtgaccacatagctacatatgaaatgaaaattactatctatataatcaaaccaaaaaataatgttcttctgaaaaaagcagataattgaatcataaatatagttcctgcttcaacaacctagaactgcactgttcaatctatatagtaaccactagctacgtatggccactgaatacttaaaatgagccttgtccaagttaagacgtgctgtaaatggatttcagagacttagtat

SEQ ID NO: 25726 - DNA, 343 bp, Homo sapiens
ttcccttcacaccatgttctccagccaggtagagttacttgcacttctctgcagatggtgccatccaaccttttgagtctttgtacgttctgtgcctcctgcccggaatgccttttgcccaaataaactccacatcttggggttcagcacaggtaccacctttttcaggaattatttcccctgacactgcttctccccctactgtttggcccattatctcctctgtgtgtccccacggcattcaagtaaaagccctatcatataacttatcacatgacattgtgattgagtgttgaatttctaggtgtccttctaggggccctatatttggatgaagataccg

SEQ ID NO: 25727 - DNA, 198 bp, Homo sapiens
  misc_feature 40: b=c or g or t
atagtattgttttctaaaatgcaaagctgattttcatgtbtatatatattcatacttgatatattgcaattttagagtttctgcagtctgtctaacttggctgtttgttcataggccagatcaaactaccctcattccccaaaacttggattgtgaagggattagtgccccagaactctctgtgttactggcagggca

SEQ ID NO: 25728 - DNA, 212 bp, Homo sapiens
tcaaactattttatggtgattgctgtggttgtaatttagtcaacaaccatgtgaacaagatcctatgtttcagtagatgctgtaactcatcatagtaaaatgagcgtagtttgaatatataaggtaaatggttccaacttgtctagcttaatcacctaagtatgtatcacaatcatatctagtcatggttcttttttttttttttttttttt

SEQ ID NO: 25729 - DNA, 187 bp, Homo sapiens
taatttttttctcctggaccattggataatgtgttttaagtataatgtgattaacccatgtggagaggtggccagggcttgctgaaataaatgcccagtagaaacatcttgtactttgtttaacttgtatacttttgcactaaataagccaagatatactgaaaacagttgggttgaacggcacaca

SEQ ID NO: 25730 - DNA, 243 bp, Homo sapiens
ttaatagtacaatatcagagccaggatattgactttgatacaatccaccagtcttatttcgacttcccattttacctgtactcatttgtgtttgtgaagcattgcctttaaagtgtttaccttttagacatttttataaaatacaattttttatctgcataaaacatgtataatttgaatggatttttaaaacatgattttggacataagatgaaaaatttaaaaatcagcattacagggact

SEQ ID NO: 25731 - DNA, 196 bp, Homo sapiens
  misc_feature 175: r=a or g
  misc_feature 188: r=a or g
cttcctaaaataatagaacaaattggcaaacaatcactaattggaccagtaggttcttacttaaatatctctcctagatttttagtgtatgttttgggattttatgggtttttttatttatttttttttaagcagacgttacagtttgttttaatctactatagatacgtttttrttttttggcttarttggggct

SEQ ID NO: 25732 - DNA, 135 bp, Homo sapiens
  misc_feature 36: r=a or g
  misc_feature 51: k=g or t
  misc_feature 125: v=a or c or g
ctgtaataaaataccatgaactgggtggcttataarcaacaaaaatttatktctcacagttccggaggctaaaagtttaaaatcaggatgccagcatggtcaggttctggtgagggtccccttcvgtgttgccga

SEQ ID NO: 25733 - DNA, 454 bp, Homo sapiens
  misc_feature 242: k=g or t
  misc_feature 308: w=a or t
  misc_feature 309: d=a or g or t
gacaaactatttctggggcaatatggtttactttttgttactttttccaacttaagatctaaatttatacttcactacatattttgtgtcttggaagagtggaaaaagtaacagtttcaataacttagttgtagaaaagagtgcaacattttcactttggtagtattaattgtacaggtccatagtctcttctccacaactttgaaaacctaaaatctctgagaatgaaagctttttccatkaataagctgacctgttaaaactgacgtgacctaaactcatttcatacagcaaagcctgactggaawdtgatttcttaatttgtctcagtgtgtctagtcatatgtttttcctaaaagaaataatagtttttgaataggtaatgttgtacaaaacactaattttgtataaaaacaggataccattataatgtagtctacgtaagaggttagta

SEQ ID NO: 25734 - DNA, 406 bp, Homo sapiens
  misc_feature 164: k=g or t
  misc_feature 165: r=a or g
  misc_feature 248: d=a or g or t
  misc_feature 269: k=g or t
  misc_feature 270: k=g or t
  misc_feature 272: k=g or t
  misc_feature 273: k=g or t
  misc_feature 279: k=g or t
  misc_feature 283: k=g or t
  misc_feature 319: r=a or g
cttaatagattatttgtcagtaatgaaccagcatttggcccacgtgctcttttttccctgatcctctcatctctccccacagagtgattatggattcttcctggaaggtttctcaggtctctaaccaaccagcccgtttgttggccttcagcaaagtagatgtkrgtttttgtgtacttcatagtgtataaaattattcctgcaacaggtattaaaacctgagatttaaaatcctttccattggtgtdaacatacattatttatttatkkakkttattktatkttattttttgagatggagtctcactttgtcacccargctggagtgcagtgacgtgatctcggttcactgcaagctccgcctcctgggttcacgccattcttctgcctcagcctcccaggtagt

SEQ ID NO: 25735 - DNA, 149 bp, Homo sapiens
  misc_feature 115: r=a or g
cagcccctaacaaccagttcctataattttgctttttccagaatgttatttaaatggaatcatacaatatatacgcttttatgttacatatatctctagttccttttttcttgcrgagtcagattccattatatatgtatgccacaatt

SEQ ID NO: 25736 - DNA, 235 bp, Homo sapiens
  misc_feature 19: w=a or t
cttctttgtataggaagcwtattttggtttaggtacaatgataagaaagtttaattttataatccataagaccagataccttcagaaatgatttttcctgtgggatttctatgactggtattctgactagtgtgaaatgacagctttggatgtctatatctacacccatcaaaacctcagagcttcatgcactgctataacttttctgttaactctgggtaaattcggaggttgc

SEQ ID NO: 25737 - DNA, 301 bp, Homo sapiens
tttaaagacatctgaggtaattcatttctctttgtggctatgcccttaacatgttatacagttgagttcatttatttcatttcctcagatttttagggattgtcctcgttttttcttttgattcattgttttcatttgtttgttttagaaacaatatcttgttctgttgcccggcctggagtgcagtggcatgatcatagctcagtgcagccttgaactcctgggctcaagggatcctcctgtcacagcctcccaaatagctaggcctacaggcatgcaagtaccaccatacctggcccac

SEQ ID NO: 25738 - DNA, 255 bp, Homo sapiens
gtcttataatgttaaacaatattttgaaacttttcttcaataaggtaatatcctttgaagggaattgcagatgaaattagaagggaacactagaaaacttacgtgtgaaattcaatttgaatgcttgctgctgttgctgggggaagaaattacattgtacactgagaaattttgtcatctaccataaaaatctaagtggcaattttagtcattgacgaaaatctaaaacttttcaagttttttgttttttttttt

SEQ ID NO: 25739 - DNA, 215 bp, Homo sapiens
agacctactgctcagaccctccaggggcagggcccaggattgaagagggaagccctgctccacacgtgttcatcaggaaggacccacagactgctgctcctggaggcctctcggtttatggatgtgtgtctgttccataaaccctcagagggtcacctggagacccgctaaaatgcaggttcttgggccacatcctagaccttctgaccgaccca

SEQ ID NO: 25740 - DNA, 351 bp, Homo sapiens
  misc_feature 131: k=g or t
  misc_feature 188: k=g or t
  misc_feature 335: n=a, g, c or t
actatcattccttattgagattccacgtcaggacatagagagctgttccactctttgacagctgcagaatagtccaatttatgaaaatatcaaatttgttttacagtattctgttgataaatatgtaagtkgctcccaatgttgaactattaaaagaaccctgcagtgggtgaccttgtacatgtgtkatcctactcaggtgacaaatgcccactggaggtggcattgctaggtcagagggtgtgtgtgttttcatatgtaagaacactgcctaatttccttcctagatcattagcaatcgagactcctaacaacccttaaacatagatggagangggggctttatcctga

SEQ ID NO: 25741 - DNA, 283 bp, Homo sapiens
  misc_feature 86: s=g or c
tcctgatgtggttcctccttagtgtttgcctggagccaatctggcttctgcctgggtaggtattggttaaagctcctctgtcagascagctctcaattgaagtaaatagcgcagagaagcagatagtaagatgagaaaacttccagttcccagggtagccctcactcttgttaaatgaggcatgttaggacgtgtccaggtcaaaagctgcaaattcccttagatttgcaggaaatagaggaaatgggtaagatatggagcttctctgctataggtgcccaga

SEQ ID NO: 25742 - DNA, 299 bp, Homo sapiens
attcatactagacctgttttttttaaattgatacataataactgtacataatttgctggtatgtgtgttgttttgatacatgcatacaatgtgtaatgatcaaattagagaaattgggatagccattccctcaaacatttgtgttgggaatatttcacttcttctcttctagctattttgaattaaacaataaattgttaactgtagtcacctcctatactattgaaccctaagtcttattccttctaactgtatttttgtacccgttaaccaacctcttcagtcccccacacaccaac

SEQ ID NO: 25743 - DNA, 158 bp, Homo sapiens
cctttgaataaagtatgtattgtactataaaaaaaatgaacctggccgggcgcagtggctcaagtctgtaatcccagcactttgggaggctgaggtgggcagatcacttgaggtcaggagttcgagaccagcctggccaacatgatgaaaccccgccc

SEQ ID NO: 25744 - DNA, 211 bp, Homo sapiens
gttattaaaacaatacaactatgaacatttttgttcatgtaccctggtgcacgttttcattgttttcaaccagaggtatacctaggagtggaatggctgggtcatagggcatgactgtttccaagcttaccagctactgccaaattgcttcccaaagtggttgtaccagtttacatttctaccagcaagagaatgagaattttggaaggcc

SEQ ID NO: 25745 - DNA, 146 bp, Homo sapiens
agtaatactggatttgttattttgcttatttggattatattagttattttttggtttatttgatagcattccagatttagttttgctataatgcttgttttgaaaatgtggattttttccaaaagggttgatatttcagggaacac

SEQ ID NO: 25746 - DNA, 157 bp, Homo sapiens
  misc_feature 11: k=g or t
  misc_feature 12: d=a or g or t
  misc_feature 16: r=a or g
tcgcatttctkdcctrctgtggtcccagtctaacataggcataggaaagatactctcagctactccaataaaggttgagattaacactaagaatcccttgcttaacgtaaaataatagccactatggcaagaagccatagatggagttgccccaaca

SEQ ID NO: 25747 - DNA, 226 bp, Homo sapiens
cattctaaatcgccacttttcacttagtatagtgtcagctgaaaaccgtaagaagagaaacaccttccatctgatttaaaatatgttttagggccaggtgcagtggctcatgcctgtaatcccagcaacttgggaagctgaggcaggaagactgcttgaagccacgagtttgagatcagtctgcacaaaatggacctcgcctctacaaaaaaatttaaaaattatc

SEQ ID NO: 25748 - DNA, 322 bp, Homo sapiens
  misc_feature 171: m=a or c
  misc_feature 178: s=g or c
  misc_feature 233: w=a or t
  misc_feature 236: w=a or t
aactcctggtaaatactgatctttttgctgtttctacagttttgccttttccagaatgccagagagctataatcagatagtagatagtcttttcagattggcttctttcacttaccaaaatacatgtaaggttcctctatatatttttgtggcatctcatttaaaaaaaamaaattasccaggtgcagtggctcatgcctgcagtctcagcactttgagaggccaaggcaggwggwtagcttgagttcaggagttcaggaacagcctgggcacatattgagtcctcgttttgacaaaaaaatcaaaaaaattagctgggcct

SEQ ID NO: 25749 - DNA, 312 bp, Homo sapiens
  misc_feature 1: r=a or g
  misc_feature 176: s=g or c
rgctggtcttgaactcctgacctcatgatccacccacctcggcctcccaaagtgctgggattacaggcatgaaccaccgcgcccggctgtctgctggtattttcttagcataacttcattttgtaaattctactttataatattattttataaagtccctgaaaatcatgggattstttagctgagcacagaaatttctaaatgggttgtgaccaacatttacaggcttatcaggcttagtagttaatttgtttcttgagtttgatttggttgcatggtatcaaatcctgatcaaacagataagtggtttgc

SEQ ID NO: 25750 - DNA, 94 bp, Homo sapiens
  misc_feature 24: w=a or t
aaaacttgggtctgactgtgagtwcttcccccattagcttttcacctaataggtttagcagccattgataatttcttttcttttttcttttttt

SEQ ID NO: 25751 - DNA, 366 bp, Homo sapiens
  misc_feature 20: r=a or g
  misc_feature 131: k=g or t
  misc_feature 247: r=a or g
  misc_feature 248: r=a or g
  misc_feature 249: r=a or g
  misc_feature 329: s=g or c
ctcttcttctgaaaaagagrtcttgaatttggactcatatcaagatgctctgaagaagaacaaccctttaggatagccactgcaacatcatgaccaaagacaaagaacctattgttaaaagcttccatttkgtttgccttatgatcataatagttggaaccagaatccagttctccgactgaaatgaatttgcagtagacaagtcaaaaagaggtcttattcatgttccaaaagacctaccgctgarrrccaaagtcttagatatgtctcagaactacatcgctgagcttcaggtctctgacatgagctttctatcagagttgacagtsttgagactttcccataacagaatccagctacttgatt

SEQ ID NO: 25752 - DNA, 155 bp, Homo sapiens
taaaaaatttagttgttgactgagcatggtggctcacgcctgtaatcccagcactttgggaggcagaggcaagcagatcccaaggtcacgagtttgagaccagcccggccaatgaaactccgtctctactaaaaatacaaaaattagccagacaa

SEQ ID NO: 25753 - DNA, 71 bp, Homo sapiens
  misc_feature 61: s=g or c
agattctggggctggtcaggaaaccaaggagacccccccccccaaccatggacccaccgtsgccaagccag

SEQ ID NO: 25754 - DNA, 391 bp, Homo sapiens
cagtcccatctcttctcctcctttctgtctaaccagaaacacatttccgttgttctctctttgtgtgcatggctcaccaccaaatctcagagcagtgtgtggtgaagcactggctggtgtctacttctccaagaagcagtctgcattagcttgttctcacactgctaataaaagacatacctgagactgggtaatttataaagaaaaagaggtttaatggactcacagttacatcggaggcctcacaatcatgatggaaggtgaggaggagtgaagtcaaagtcacatcttgcatggcagcaggcaagagagagcatgtgcaggggaactcccctttataaaaccatcagatctcatgagacttattcaccgtcacaagaacagcatggga

SEQ ID NO: 25755 - DNA, 351 bp, Homo sapiens
  misc_feature 277: r=a or g
aatcttatcttggaaatgctttctcttgatcactgaagggtatcaggaaagagaatagtgaaaaattcattatgtaaaataattacatcctaccagtggtgggattttaaaaatttaatgtgcgtggaaactgcttgtatagaggattatcatgtattagatcatacttcaccatggtaagattgtaatagacttagaatgtaccaaatatcacagccaaggctatataccacttaaatcacccaaaacagttctatgacacttccagtccaataaratggttacaaatatgttatacccattgcttgtataaggggtcccatgtaaatctaaagtaatgtgcagcacata

SEQ ID NO: 25756 - DNA, 379 bp, Homo sapiens
  misc_feature 113: m=a or c
  misc_feature 259: m=a or c
  misc_feature 324: m=a or c
  misc_feature 328: m=a or c
  misc_feature 333: m=a or c
cctagaatagttaaagagagacacatctagatgggatgaaaggtgccctaagcaggagaaactgaacaaaaggctagaggcatgggccaggtaaaaattgggcctagagtgamgactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcmactttgaatgctttcttacttgttttgtgacctaatttatgtggaagattgttatttcattaggmtttmgtaamatttttttttctgattctaaacttattgtgaaaattgagctgtaca

SEQ ID NO: 25757 - DNA, 297 bp, Homo sapiens
  misc_feature 7: h=a or c or t
tatagahagtattatttaagtgtccttgcttgggtactagggagtgttacacaatggttcactggcactaagctcaccatacttatgttggggagcaagacctgatagccagcctttacatgggagtataattctgtcctccatctcataagccccagtacctgagccagaatgattataaccaaccacactgtctctttatcatggatggctttagcagtaggttattttcatcattgccatttgtagctctacagtggttatagtaatttctcatcttttaagtctctccctcaa

SEQ ID NO: 25758 - DNA, 297 bp, Homo sapiens
  misc_feature 7: b=c or g or t
  misc_feature 8: h=a or c or t
  misc_feature 129: m=a or c
  misc_feature 131: r=a or g
  misc_feature 147: r=a or g
  misc_feature 196: v=a or c or g
  misc_feature 197: d=a or g or t
  misc_feature 198: r=a or g
taaatabhtagaagacttacttaaggaagtaatagcaaaaaactttccaaacctgaagaaagataaaaatattcaggtaaaggaaaatcaaaactctacaatcagattcaatccaagtaagactacccmargacatattataatcaractgtcaaaaatcagaggcagagagaggatcctgaaggcagcaaaagavdrgaagcaataacataacataaaaacgggctcaaatgtacctagaagtggacttctcagccgaaaccttatgggccagaaaagagtaggatcatatattta

SEQ ID NO: 25759 - DNA, 184 bp, Homo sapiens
  misc_feature 140: w=a or t
  misc_feature 152: w=a or t
  misc_feature 154: m=a or c
cattatgtaatggccttctttgtctcttttgatctttgtggtttaaagtctgttttatcagagactaggattgcaacccctgcctttttttgttttccattggcttggtagatcttcctccatccttttattttgagccwatgtgtgtctcwgmacgtgagatgggtttcctgaatacagcagc

SEQ ID NO: 25760 - DNA, 344 bp, Homo sapiens
  misc_feature 7: h=a or c or t
  misc_feature 9: k=g or t
  misc_feature 121: k=g or t
  misc_feature 131: m=a or c
  misc_feature 162: k=g or t
  misc_feature 172: s=g or c
  misc_feature 173: s=g or c
  misc_feature 174: m=a or c
  misc_feature 212: r=a or g
agctgchaktgagactggaaaaatggctctcagagttccgcctctgcagtagaggaagacactccagaaggagttgagaatgggtgctgagtgcctcttcaggatgtctgtcacacctcakgaaacctgcmaggaataccaaagggagtggaaaaatccaakgttgggaagssmtgggacattgaagttacaactggacgataaaaacagarttttttccttgtgacgtgaccactgtgatgtaaagctgtatctccttcatttcatcaagaaattttaaaattctcccccaacgtgctttcatctttcccttcattgccaactctgtaagaagtaccacgctc

SEQ ID NO: 25761 - DNA, 415 bp, Homo sapiens
  misc_feature 6: r=a or g
  misc_feature 7: n=a, g, c or t
  misc_feature 8: s=g or c
  misc_feature 9: h=a or c or t
  misc_feature 36: k=g or t
  misc_feature 37: k=g or t
  misc_feature 337: v=a or c or g
  misc_feature 338: n=a, g, c or t
  misc_feature 408: v=a or c or g
  misc_feature 411: s=g or c
aaattrnshagagtaggtttctactttggttataakkaataaaattcatgcttttgtgtacacactagacatctaaagcaatcaactatagttaacaagcagtgctcttaccaaaaggtaactctttactagaatccggcacaccatttaatatcagtatgagcatatggtgggtttaataattgttttccatgtttataagttttctttagttttataagcagttaaaaagaatccctttcactgaaatacaatctgtggtgggacttctagcttttctcaatcttacgctgctagatttatgtcactgccaaagctatgcaatgggtgatatttvnactatgctcaaacaaagcaaccagaaaaacacatatcactgaataatacagatattctgaagtcaagcavtasccca

SEQ ID NO: 25762 - DNA, 149 bp, Homo sapiens
gtttttagtttttggggtccccgtgctgctgcaaggcgaaacgggagggagtgacccctgcgcccctcagtcccccctacgacgtcgcctccatagtctgcggagaagcggagactgcgcgcctcgcctcacagcgaaacgccgcgcga

SEQ ID NO: 25763 - DNA, 335 bp, Homo sapiens
  misc_feature 7: w=a or t
  misc_feature 8: w=a or t
  misc_feature 9: n=a, g, c or t
  misc_feature 136: r=a or g
  misc_feature 151: k=g or t
  misc_feature 303: d=a or g or t
  misc_feature 304: n=a, g, c or t
aaacaawwngaaatatttatataacgcaaagtctctagctgctgtaggatgtgcagtttaaatgatctatccttgtaatacttctcagtattgggatggctagttctactagaatgttgaatgcagcagaaaataraatcagcatggcgtkggcatgtacaacttacatgtaaactaaggtgtttaaattagatttcaaatacactggatactactatttcccaaactatgggcaaatgtagtactaagaagaagtctctctgggaaaaaaaatgaaattttatacctatttctatactaaadntttaatttgaattgagttataaacccgaacc

SEQ ID NO: 25764 - DNA, 252 bp, Homo sapiens
  misc_feature 6: y=c or t
  misc_feature 7: n=a, g, c or t
  misc_feature 8: n=a, g, c or t
  misc_feature 9: n=a, g, c or t
  misc_feature 37: r=a or g
  misc_feature 203: k=g or t
  misc_feature 227: r=a or g
  misc_feature 231: k=g or t
  misc_feature 234: r=a or g
  misc_feature 238: r=a or g
  misc_feature 239: k=g or t
  misc_feature 249: r=a or g
ctcaaynnnactcctagaagaatttactcctagaagrattttccaggtttctaaaattaaatcacttttctaaacatagtaactaaagtttgaaaagctggaaatagtgagctgggaagggaatgggttggagtatgaagaaggcagcaaacacaggttcattgttgaccagtgattaataatgcggattgttaattagcctkcgttgattatgaggtgttttcttratcktaratarkttaagaccargga

SEQ ID NO: 25765 - DNA, 166 bp, Homo sapiens
  misc_feature 7: h=a or c or t
  misc_feature 8: h=a or c or t
cattachhtggcttttattgtttgctgttttgctttttaatatagctaaagtatgcagatttatttagctttaagttttgttctcaattccctagtggaaaaaaaaaagcaccaaaaaattcaatttttacatttcaattcaaatgcaagaacttggaacagaccg

SEQ ID NO: 25766 - DNA, 189 bp, Homo sapiens
  misc_feature 7: m=a or c
  misc_feature 8: h=a or c or t
  misc_feature 9: w=a or t
agggaamhwttttcattctaagaatatcacacttttgaaatactgttctgttacgacttcttgatgaaactgaaaatttgtctagtcaagaaaacttttagaaaattttgtctagagaggattgcgtaatgcctggtatataattacggacacacacacacacacagacacacacacacacacacactt

SEQ ID NO: 25767 - DNA, 213 bp, Homo sapiens
  misc_feature 7: n=a, g, c or t
  misc_feature 8: v=a or c or g
agctgtnvctccggcgggcgtgttgggtgtgtcgttttaggctctgtgacccaggagcaagacgcaataagcgggtgcagtggaggtagaaacgggaaatgcagtaccctttccggaagctactccgcccctcgacagggtcttgctgtgtcgcccaagctggagtgcagtggtgtcatctgggctcattgcggcctccacttcctggatacc

SEQ ID NO: 25768 - DNA, 140 bp, Homo sapiens
  misc_feature 132: w=a or t
acaggctcagttctgggtactcacacagagctctccaagctctctgacgtgatcccttggtttcaaccaatacctctctgcctagtgttcctacagctgtgtctgtagggcctctgatcacttagtcttttwgcagccac

SEQ ID NO: 25769 - DNA, 128 bp, Homo sapiens
gttgcccaggctggagtgcagtggtgctatcttggctcactgcaacctctgcctcccaggttcaagcgattctcctgccttagcctcctgagtagctgggactacaggcgcccaccaccacgccccct

SEQ ID NO: 25770 - DNA, 198 bp, Homo sapiens
  misc_feature 7: n=a, g, c or t
  misc_feature 8: n=a, g, c or t
ggtcagnnctctgcatggaagtgtgtgaaaacaaggcaggttcaaggataaaatgtggcagttttctccttggctgcatgttagaatcatttgggaatttctgaaatttccaatgcttgggctgattcaatcagattctctggaagcagggtaccggcatctctagttttaaaatgtctgcagatcatacccatgtag

SEQ ID NO: 25771 - DNA, 365 bp, Homo sapiens
  misc_feature 7: n=a, g, c or t
  misc_feature 8: n=a, g, c or t
  misc_feature 306: h=a or c or t
  misc_feature 307: n=a, g, c or t
  misc_feature 361: n=a, g, c or t
  misc_feature 362: d=a or g or t
  misc_feature 363: m=a or c
tgtaagnnttttcgtgactggcttatatcacttagcctaatattggctgtttaacttgaaattaattaaaaatttggttccttcgttgaactagccacatttcaagtaccagatagcccatccggctggtggctactgtattggatggtgcagatagagactatttctatcatctcagaaaatgctcctggacagcgttggtctgaaggaaaactggtggctcgcactgagagctgattggaggggggacaaggagaaaaagtagcagatatttttttatactctgccaacgtgaataatctgachncttttctctaccacaaaaatgtaccagctacatgatacctttacatttacaacndmcc

SEQ ID NO: 25772 - DNA, 173 bp, Homo sapiens
tgtcccttgttaattttcatcagtctaaaagagactttctcccatttccagttgtctcccttggttgctataacagcataagatcaacaatgagaacggtcatattggtgatttctggcagccatgggaagactttacttttagtgcaaaaactatagaaatttcacccatgc

SEQ ID NO: 25773 - DNA, 119 bp, Homo sapiens
  misc_feature 7: m=a or c
  misc_feature 53: n=a, g, c or t
tttatcmcggggacacagctggctgcctcacccgcaggctgcagggagacctnccccagcctgcagccccaggcccgccccgcgtcacatgagccccagggctcccaccccctcccgat

SEQ ID NO: 25774 - DNA, 247 bp, Homo sapiens
aaggcattgatgaaaagttttctttgagctcccttgtggctgtgcagaagagtttattcctgaggttgctctcatttagggttggaatctttgaagataaaatacttcttcctacctctcacttgagatcaaggaaacctacataagactcccagagcaaaaggaccctgtaacacttgtgccttggcattgccatatgctctgttgcgcaggaatggggaggaacggccatccacatgccaccccc

SEQ ID NO: 25775 - DNA, 131 bp, Homo sapiens
cgcagcattttgggaggcccaggcaggtggattagctgaggtcaggagttcgagaccagcctggccaacatggtgaaaccccgtctctactaaaaatacaaaaattagccaggcgtgacggcgcgcaccta

SEQ ID NO: 25776 - DNA, 111 bp, Homo sapiens
  misc_feature 7: r=a or g
ccattcrttagctattactcttttatctaacttcctatccatcactcaactgcaagtgcttcctctaaatctttataaccaaatccagtggtcttttctcagtctttactc

SEQ ID NO: 25777 - DNA, 245 bp, Homo sapiens
acatggctcactgcagcctcgacctcctgggttcaagtgatcgtcccacctcagcctccctagtagctggtactggaggcatatgccaacacacctgtctaatttttgtgttttttgtagagacaagggtttcactaacagttactctttataactacttaagttaacctacaaataaaaaatggcatgaagcttttactgttggggggaagttttcagatgttactacaacattaagcccaatt

SEQ ID NO: 25778 - DNA, 426 bp, Homo sapiens
  misc_feature 373: h=a or c or t
  misc_feature 416: m=a or c
tcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaathaagtccgaacaaggtcagttggtgaatgtgtagcattctatamatgtggaaac

SEQ ID NO: 25779 - DNA, 285 bp, Homo sapiens
cctgatctcttgactgtcatcaaatgtttcttacctctaaaccaaagtttcattttataatttaatttttctcattttttctgttctcttagcttaagaaaagatcattacaaactttttgtaagtttttcatatatgcttgcaaagggttgtaaaactttattgtgattattcttgctttaagctgaaacttccctaatctttctttagagattgtggcatagcatgatagtttcttttccatatccaattgttttctgtaatgaatacagaaatatgggcaca

SEQ ID NO: 25780 - DNA, 209 bp, Homo sapiens
catgtgcctggcatcatggtagcatggcctagggtattagcatatcccaaaacacaggtgtactccctgctttcgtagggcttcctggccaagagtgagactgacatggactcacactaatgaatgaaccttctcaatctgaagcatatgctcctacaggaaaacataggtcttgtgagaacaggtcaccatcatcatctccatggcac

SEQ ID NO: 25781 - DNA, 339 bp, Homo sapiens
  misc_feature 298: n=a, g, c or t
caggagaagaggagtgtcgaaatggatacagcctcatgttttcaccagtcacatctcttactactgctagtcgctgcaacactcctctacagtttgagctttgtcaccgaaaagacctggatttggcaaaagtaaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagacnaggcatttcggacagagttcaacttgatgtatgcctactca

SEQ ID NO: 25782 - DNA, 152 bp, Homo sapiens
  misc_feature 8: r=a or g
  misc_feature 9: w=a or t
caaaatarwggtgtcttttgtagaaggacagaaaatcatgtcactgcatcttaacagttttaaaaaattataaaataactagacactaatgaattgtaccaaattaagactctctaggcctagagagtcagatgactcccagacaggcctac

SEQ ID NO: 25783 - DNA, 283 bp, Homo sapiens
  misc_feature 7: k=g or t
  misc_feature 8: h=a or c or t
  misc_feature 118: s=g or c
acccackhcggcgggagccgcccgttcgcgctgccagcagcttccgcctgctacggtcctggcaagcacctcgggatcccattccttcacagggaccctagccagttaaagctgatasattcctgtgggtcaactatgcaactaactcagattttgagcaaacaaagctctcaagttggtgatcctcaggagtctctgcattagttggacagctcttctggaattatcttctaagtcaactgtgggttgggtaggtggctctgctgatttttcgctggaccga

SEQ ID NO: 25784 - DNA, 180 bp, Homo sapiens
  misc_feature 7: n=a, g, c or t
  misc_feature 8: y=c or t
  misc_feature 9: n=a, g, c or t
aaaatanynaaaattagctgggcatggtggtttgtgcctgtaatcccagctgcttgggaggctggggcagaagaatcgcttgaacccgggaggtggaggttgcagtgagcagagattgtgccactgcactccagcctgggtgacagagcaagactccatctcaaaaaaaaaaaaaaaaaa

SEQ ID NO: 25785 - DNA, 183 bp, Homo sapiens
ttcaacccagaatttcatatccagccaaactaagtttcataagtgaaggagaaataaaatcctttacagacaagcaaatgctgagagattttgtcgccaacaggcctaccttacaagagcccctaaaggaagcactaaacatggaaaggaacaaccagtaccagccactgcaaaaacatgcca

SEQ ID NO: 25786 - DNA, 174 bp, Homo sapiens
  misc_feature 8: y=c or t
  misc_feature 9: m=a or c
  misc_feature 72: d=a or g or t
  misc_feature 73: s=g or c
ttaaaaaymcaaattcatactgatattttcagtttaaaattagggctataggtttttacataattatatttdsctgacgtctacatcttctttcttatgaactgaaaaacatagttgacaacaacactaacataattattcatttgctttatcctacggttaatacagcagcat

SEQ ID NO: 25787 - DNA, 105 bp, Homo sapiens
cactaagtgtcctagatatatgtttttgctattatcttttatcccaaggtatgatcttttattcctgtatatattcaatcttctgtaggtttcattaggcccggg

SEQ ID NO: 25788 - DNA, 252 bp, Homo sapiens
  misc_feature 7: n=a, g, c or t
  misc_feature 102: r=a or g
tcttggnaaatgtgttgtggcttatgctactaggtctcatggcccagagattgtgtgggatgtatctgcctgcatagctaatcacatattactgtgtttgaragatataaacttgaacattttaatctttctctgtcttggccttacttggctaatttttgttaaactaagtcataaatatattctacatctactcaaggttcacttcattcagtagataccatgggaataactaaagtttaccgaagctac

SEQ ID NO: 25789 - DNA, 225 bp, Homo sapiens
  misc_feature 7: m=a or c
tgatttmcagatgttaaaccaacgttgcattcctgggataaatttcacttggttatggtgtatgatcctttttatctcttgatggattttggtatgcaagtattttgttcaggtttttttgtgtctgtattcataaaggataattggagtatatttttcttgcaacatcgttgtctggttttagtatcaagataatactggcttcatagaatgaactgggaatgt

SEQ ID NO: 25790 - DNA, 249 bp, Homo sapiens
cgggattgcagacgtccgccgccatgcccagctaattttttgtgttttcggtggagacggggtttcgccatgttggccaggctggtcttgaacttctgacctcaggtggtccacctgccttggcctcccagagtgctgggattacaggcatgaggcaccacgcccggcctctaatgagatctttagctattacagcgtgtcttactctgtgtacttagtagtggtaagacagtgttttgaccagttgtg

SEQ ID NO: 25791 - DNA, 256 bp, Homo sapiens
  misc_feature 7: n=a, g, c or t
tcaaatnataggatttttcattgaattgatttgactggtttgtagctccccaataccaccatccctaaatttgacaagaattaggacatgttgtcttgcaaaaataaggttcatgaagtcacaagaaattggtgaaattatgtatatctacagaaggaatacattagcagcttttaatccactaaaaaaacaagagtcttggagaatgggacctttatcttatctctgtgtctcaaatcttagcacaacgcctggc

SEQ ID NO: 25792 - DNA, 169 bp, Homo sapiens
aaaaattaccatgtaaccatttatgcgtgtctagttcaatggcatgagtgcctttaccgtcctgtgcaggcatcttcacaagccagctcttcacctccttccgtcaccccgtattaaaactccgcacccactcaacactcactccccgtctccccccatcccctgtgcc

SEQ ID NO: 25793 - DNA, 382 bp, Homo sapiens
  misc_feature 7: y=c or t
  misc_feature 8: w=a or t
  misc_feature 287: n=a, g, c or t
  misc_feature 288: n=a, g, c or t
gctgtcywaatgaccctttggacctatttcccagccatgttccaagatgatggtgaggagtctagccccacagccagtatgctatctctattcagataactcccagctcacaggcctcccaccaggctctcacccactctgatgttttcactcctgactcctaagaagcagattggcaatttagtgtgagtctgtcagacagcctagagagtaatcaatactgagagaaatggacatatttcctgtttattcaaaatcctgatgaaaattttaaggagcactatttnngaagggatgactgggaaccttgcaagaacaaacagcttaaaattcatgaacagaaatagcaacgtttattcatgatgtttcaaatgcccctaac

SEQ ID NO: 25794 - DNA, 142 bp, Homo sapiens
ctttcactaagcattaaggctggtgtatgcacattgttacatgtgtcagaaatatgttgtatgttatttttattgctgagtgatatttcattggatgaatatgtcataatttaccctttctactgatagacatatgggtttc

SEQ ID NO: 25795 - DNA, 104 bp, Homo sapiens
  misc_feature 5: m=a or c
  misc_feature 14: r=a or g
  misc_feature 80: m=a or c
agagmcgccccgarctaagcagggcggtcggggctctgccaggaaacggggcaggaatggcctctccgtcttccagatgmgtgcgctgaggcctggaggggctg

SEQ ID NO: 25796 - DNA, 139 bp, Homo sapiens
  misc_feature 17: k=g or t
  misc_feature 19: n=a, g, c or t
  misc_feature 23: k=g or t
  misc_feature 25: m=a or c
  misc_feature 111: r=a or g
  misc_feature 115: m=a or c
  misc_feature 125: r=a or g
  misc_feature 132: m=a or c
gattttggcctaaactkanaatkamaccggatctgtgtgttccggtcccaatactccggcccctcccgctccatccacggcgcccgcggctcctctctcggactcgcgtcrtcgmtgtcgaaccrcaacgamctgcgta

SEQ ID NO: 25797 - DNA, 118 bp, Homo sapiens
ctgcatcggttccaagtgtggcaagtaagttttcggctctgaagaactgacactagctagatttgtattcagagtgtgagagcaagctctacagatagaccttattggactacttttt

SEQ ID NO: 25798 - DNA, 261 bp, Homo sapiens
caggaaacaacaggtgctggagaggatgtggagaaataggaacacttttacactgttggtgggagtgtaaactagtcaaccatcgtggaagacagtgtggcgattcctcaaggatctagaactagaagtgccatttgacccagccattgcattgctgggtatatgcccaaaggatcgtagatcatgctactataaagacacatgtacatgtatgtttattgcggcactattcacagtggcaaagacttggaaccagcaccg

SEQ ID NO: 25799 - DNA, 150 bp, Homo sapiens
tttgtagtctgtgtcaggaaagttttcttcatatctattctgtctccctcctctttgattttaaatttttttcttttacccagtaggacaaaaaagagcagttggtcatcatccccaatattcttagtcttcagtatgcttcaggcccaa

SEQ ID NO: 25800 - DNA, 204 bp, Homo sapiens
  misc_feature 13: s=g or c
  misc_feature 24: w=a or t
ccttcagattatsattttacctcwgaggaatgccactcaagaatttataattaggccaggtgcagtggcttacacctgtaatccaagcactttgggaggctggggtgggtggatcacggggtcaggagttcgggaccggcctggacaacgtggcggagcccatcttaaaaatgcaaaaattagccgggcttgctggtgggctgc

SEQ ID NO: 25801 - DNA, 439 bp, Homo sapiens
  misc_feature 3: s=g or c
  misc_feature 4: m=a or c
  misc_feature 300: d=a or g or t
  misc_feature 303: b=c or g or t
ttsmggatatccagttgaaatgtcctctgattataacctccatcaccaaggctatttgtacgtgtcacattccccttccagactaaggatggttgttctgccagtattcttggttgtgtcttatcctatctccacaaagactttatttatttatttttaattattatactttaagttctggggtacatgtgcagaacatgcagttttgttacatgggtatacacctgccatggtggtttgctgcacccatcatcctgtcagccttcattaggtatttctcctaatgctatccctcccctdgcbccccacctctctagaggccccggtttgtgatgttccctgccctgtgtccatgtgttctcattgttcaactcccacttacgagtgagaacatggcagtgtttggttttgtgttgttgtgatagtttgctgagaatga

SEQ ID NO: 25802 - DNA, 395 bp, Homo sapiens
aacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcaccgac

SEQ ID NO: 25803 - DNA, 315 bp, Homo sapiens
attttttccatcactgaacatttaggttccatccacctcttggctattgtgaataatactgcaagcgacatagatgtgcaaatatctctgtgagatcttgttttcagttcttttggatatatatcaaggaatgggattgctggtcatatagttgctggtaattctatttttaattttttgaggaacctccattctgttttccatgggctctaccattttacattccacaaacagtgcacaagtgttttaatttctttatgtctttaccagcaagcacttgttatacagtctcccttctttcttttcatagtgggc

SEQ ID NO: 25804 - DNA, 212 bp, Homo sapiens
caaagatgtactgtagtgctatttgaagtacctgtaacaaaacagttggccctctgtatccatgtactctgcatctgtggattaaaccaattgcagatcaaaaatattagaaaaaataaaaataatacaaataaaaatacagtataacagttatttaaatagcatttacattgcattaggtattagtctagggataaagtatacaggcggac

SEQ ID NO: 25805 - DNA, 155 bp, Homo sapiens
aaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaa

SEQ ID NO: 25806 - DNA, 208 bp, Homo sapiens
taacaagttcccaggggatacttatgctgctggtcttggggatcacactttgagaacctctgcattagagacatttctttagacctaagggctttgaagtctcttctcctgagaaattggtgtggtttcattagggtttatcgtgaaccttgtttgtgaacctggttttctttttgtttgctttgcttcgcgtcagaaattcagattt

SEQ ID NO: 25807 - DNA, 198 bp, Homo sapiens
  misc_feature 169: m=a or c
  misc_feature 170: m=a or c
  misc_feature 197: r=a or g
  misc_feature 198: m=a or c
ttgtaaaatgagttatctcagtgtccagtccaaaattcctattgtaacatgctgtcagatatgtgtctctttccaatgcagtaagcttctccagggatttcttcaagtagacaacattcagtgcaatcttcatcatcacagattctcagaaatgtgtggctttcaagcmmgtgaatcttgagaaacttaacagggcrm

SEQ ID NO: 25808 - DNA, 186 bp, Homo sapiens
caacacaatattaagggaaaagaacaaagttggagaattgacactgcccaagttcaagacttactgtaagactgcagttatcaagacagtatggcactagtgaaagaatagaccaatagatcagtggaacacaatagagcccagacacagacccttgtaaatatagtcaaatgatcgttggcattg

SEQ ID NO: 25809 - DNA, 185 bp, Homo sapiens
tgttacacgtatcaatagctcattctcagttttggtggggttttttttgcttttaatatcgtacagtcagccttctgtatccactggttctgcattttccctttaatcacttttgctgcaccacaaaagttttgttatgttgtatttttatattagttcaaaatatttccttctttcccctaaga

SEQ ID NO: 25810 - DNA, 149 bp, Homo sapiens
ttagtggagacagggtttatccatgttggtcaggctggtctcgaactcccgacctcaggtgatccacccgcctcagcctcccaaagtgctgggtttacaggcgtgagccaccatgcccagcgatcttattttttaaagttccccaagtg

SEQ ID NO: 25811 - DNA, 145 bp, Homo sapiens
tatctatttttgtcaagaacccaatttttcatgctctgcaaattgttttctgtttctatgtaaaaattttaattatactcctatactttattataaaagatactgatttgattagcatcctcttaccagaaacacatactagaca

SEQ ID NO: 25812 - DNA, 183 bp, Homo sapiens
  misc_feature 44: r=a or g
  misc_feature 111: m=a or c
aagaaagagctgaagagcaggccaggaaggaacaagaacaaaargctgaagaagagaggattcgtatggaaaacattctgagcggaaaccctctccttaatctcactggcmcatcccagcctcaggccaacttcaaagttaaaagaaggtgggatgatgacgttgtcttcaagaactgtgcaa

SEQ ID NO: 25813 - DNA, 161 bp, Homo sapiens
ttgaagctaatatgaaatgcaggatctgtctagccttctttgtctaagtcggctggtgaatatagatgagttggaaataggaccttcttcctcctaaaggtttaagattatcttaatccaggaaagggcatgctaataattgagtgtggtgtcaaacaggc

SEQ ID NO: 25814 - DNA, 173 bp, Homo sapiens
  misc_feature 22: s=g or c
ataaaagcccttgggcccttcscaactgggtgccagccaactgtggctgcctgggacactccatcttaagtccctgtgcctctgccgtgtgttactgagtgcctaggccgtgccagcctgtattcatctgtactatgacctgaagaggcagaggccatcattgttggtccagg

SEQ ID NO: 25815 - DNA, 188 bp, Homo sapiens
attaaaaattatgttcagagttgtgatttgttagattatcagaaaatgaaggatttctcaagttatattattatcaagatatattatatcccccacgaaagtggtacatttgttaaaattgatggacctacattcagacatctttaccacccaaagtccatggtttacattagggttttttttttttt

SEQ ID NO: 25816 - DNA, 202 bp, Homo sapiens
actttgagaaccgctgactaggctaatgcctgtggatgagaaaagaggcttagagaaattatgttttgcctaattgacaaaaccaattagtggctgaaacaacacagaaggccaggtttgtcctctcacttcctaacttgaggacagagaaatatattctgatgtccctaactggcagtctgctatggtagtgaccacgagt

SEQ ID NO: 25817 - DNA, 162 bp, Homo sapiens
tttgaatctgggacagaactgcatcacctcactcccagagaaagttggtcagctctcccagctcactcagctggagctgaaggggaactgcttggaccgcctgccagcccagctgggccagtgtcggatgctcaagaaaagcgggcttgttgtggaagacca

SEQ ID NO: 25818 - DNA, 190 bp, Homo sapiens
  misc_feature 7: m=a or c
ttgcatmgatacacacctttttctttttgtcttttagtcttgctgcagtgtatcggacgagcttaaccagatatccagcactagccttctaacagtttctaactcagtggtgacattttttagttcttaactcccacaatccttcttagcctaacaaacctcttaattaaggtccatgaaagaccaggaa

SEQ ID NO: 25819 - DNA, 283 bp, Homo sapiens
  misc_feature 7: n=a, g, c or t
  misc_feature 8: s=g or c
  misc_feature 123: y=c or t
gacgccnsgctggtgtgtgtcggtgtgtatgtgtgtgtgtgagtgtgcgcgctccgagtgtgtgtgtatttgtgtatcggcggtcccgcaggtcccggatgttgcggacagtatgaggcaagygcagggggacggggaccagcagctgtcgccgccgctctcagatcgagtcttgctctgtcacccaggctggagtgcagtggcgcgatctcagctcactgccacctttgcctcctgggttcaagcgattcttctgcctcagcctcccgagtagctgggaaat

SEQ ID NO: 25820 - DNA, 294 bp, Homo sapiens
cagcagcgcccctgggcccctggttggctgcgtctgggatgctccctttgcccctccttggggtacagctgcggacacaccactgcctggctgcagtgtggagctggcgcctcagcagcaccgtggccaccatctgtgctttctgtcatctggcccctatggtttgctgtcatcttgtgtgtctagggacacaggctgctgatcatgctgtagctgtttgagtaagaaataaacaatctaggctgggcacagtggcacacacctgtaatcctagcactttgggaggccgacttg

SEQ ID NO: 25821 - DNA, 140 bp, Homo sapiens
  misc_feature 114: m=a or c
ttaaataaaatagacaataagcctcctggtctacccgctgctcctggtctacctgctatctgctgtgcaccttccctcttccatcctgtgtccccagaagcagccactttgggmtccgtttcgtcttctgctgtcgacca

SEQ ID NO: 25822 - DNA, 127 bp, Homo sapiens
tcgaaaagatcgggtccggcgctccagaacagaacgatccctgaggctcccttgctcgaactgtgggacttaccctactatggtccgagcctaccctatttcattatactcaagtaacgccccagtt

SEQ ID NO: 25823 - DNA, 135 bp, Homo sapiens
tctcataacgtatattattaataaatgtggtcctataatttatactgaaattaccttaggatatttttgcataatactctcttactgcttacattctataaatttttcacgtgataattgtctttgcgtaactgg

SEQ ID NO: 25824 - DNA, 107 bp, Homo sapiens
tcaattaatttttgttgttaatgttgatgtcttcattggatgggtcataatgttccatgaaacctctcaagtacacaattgtatgttctttgtatcccttacccact

SEQ ID NO: 25825 - DNA, 230 bp, Homo sapiens
  misc_feature 7: h=a or c or t
agttcthcctgagtgagactctacctcctcctccgaccccatcctagacttcaacatctccctggccatggccaaagagagggcccaccagaaacgcagcagcaaacgggccccgcagatggactggagcaagaaaaacgaactcttcagcaacctctgagcgccctgctgccacccagtgactggcagggccgagccagcattccaccccacctttttccttctcccct

SEQ ID NO: 25826 - DNA, 262 bp, Homo sapiens
  misc_feature 5: n=a, g, c or t
  misc_feature 7: b=c or g or t
ttgcnabctccgcctcctgggttcaagcaattctcctgcctcagcctcctgagtagctgggattacaggcgcccgccaccactcccagctaatttttgtatttttagtagggacgaggtttcaccatgttggtcaggctggtctcaaactcctgacctcgtgatctgccctccttggccttccaaagtgctgggattacaggcgtgatggagatgatactccctaaatcacaagggtgtggtgtgaagatgaaatggcaaca

SEQ ID NO: 25827 - DNA, 127 bp, Homo sapiens
aatcttgttctaaatttttagttttcttctccagtccttgtgtgctttagggtggttttgattagattgggcttgacagttacccagtcccagatgagtgtcccctttcctgcacctccccccaaat

SEQ ID NO: 25828 - DNA, 208 bp, Homo sapiens
  misc_feature 8: b=c or g or t
aggaagcbagcagctgtctccaaacccagagaaggggaaacaggaatcgattaggaataaaggattataatccactttccttctgaggaaaagctgggaaccttctcattttgccttatgaaaactaaagctgaatcgactgctgccaaacatctattaggcaaaattggcctcttgcccatgatttgactttccagcacaacctcca

SEQ ID NO: 25829 - DNA, 191 bp, Homo sapiens
  misc_feature 4: w=a or t
  misc_feature 5: n=a, g, c or t
tgawntgttagtatggatattggtttgttgaagaaaataggctttttttctttttttgttactgtgcaaatactttaatagcaaacctgattaatatttttcagatgtagaatgtgtgaagtaatttgatgtctttgctagtttagcttctggttaatctacgtacccttttttaaaggaaaacagacctc

SEQ ID NO: 25830 - DNA, 188 bp, Homo sapiens
  misc_feature 4: n=a, g, c or t
  misc_feature 5: n=a, g, c or t
  misc_feature 128: s=g or c
attnngtggcaaagttatctggaagcaaatgatgaagcctcaagcactgccaagtctggccctgtcgcccaggctggggtgcagtggcgcgatctcagctcactgcaagctccgcctcccgagttcasgccattctcctgcctcagcctctcgagtaactgggactacaggcgcccgcgaccacgccc

SEQ ID NO: 25831 - DNA, 291 bp, Homo sapiens
  misc_feature 129: r=a or g
cgggtgctagtttgctttagttggctggctctggccataataagacaatagcgtgcactgctgctgccctattcgcaggagcagacaactaaggtgctaatgaaaacacacacgggctttcgtgaatgraaagtcacatgacttgttctgtttcctttattgaaagagaaacctttacaaaaatagtacttcatagaaggaagcatagtatgtggaacactaaaccaggaatcaggaaaccaggtttctagttgctgatcttaatgagtcattgtgtgtctatgggggaga

SEQ ID NO: 25832 - DNA, 257 bp, Homo sapiens
  misc_feature 7: s=g or c
  misc_feature 11: n=a, g, c or t
  misc_feature 12: h=a or c or t
  misc_feature 115: k=g or t
  misc_feature 123: w=a or t
  misc_feature 208: r=a or g
cttcttsgaanhtgttcctggaaaacccagtctccagcaacctgatatgtaactgcaaatctgcaactctagaccaaccttctaaagagggatttaagacctttttcaagaatckggcttgawtttttttggcccatggttctccctttattttactcaatgttctcaaaactaaaatggctctttaatttgattttcgtaaaatggraatttggtagatcatattttatttactatgttgttaaaatgccccaatc

SEQ ID NO: 25833 - DNA, 303 bp, Homo sapiens
tatttaatgctttctgtttggagtctctgtttttctctttgcttaaaggtaaggtatcattacagaagctcgataaaattctcatttcaggaaattaagtgtatattcaacatatacagaagtaacattcatttgcatggattctcttttgagtagattctgaagaccaagaggtatcttacccatcaaactagctttccttcacatttctcttccgaggttcactcaccttttccctccgttatcattcttcccttcccagctaatatagtaaagctacctacaatttaaaaagaagagcct

SEQ ID NO: 25834 - DNA, 278 bp, Homo sapiens
  misc_feature 7: w=a or t
  misc_feature 8: w=a or t
  misc_feature 114: r=a or g
  misc_feature 174: r=a or g
  misc_feature 222: r=a or g
cacatawwcaacatatgtaaataaatgcttgctctcagctcagcaaatattgtttgagagcccaccatggagtagggaggttataagaggaataaaatgattcatgcttttgargtatgtcagttaacaatgcagtatgtatgatacaatagaagttagcacaaatgttatggracaaagaaggggaagggcttaaaaaattactaaagaaatccataagaraaagttttaaaaatattgaaaagaaccctagtgatgaaaatttgagagaccctcgc

SEQ ID NO: 25835 - DNA, 212 bp, Homo sapiens
  misc_feature 7: y=c or t
  misc_feature 8: m=a or c
  misc_feature 123: r=a or g
  misc_feature 141: w=a or t
  misc_feature 164: m=a or c
  misc_feature 201: r=a or g
acttatymtttttggtcttggggtagagattcctttttcttcccattcccaaaggtagaaagactgtaattttttatgcttatgtttgtctagactttctgttaagtcgctatcacagctggrctcacttgtgcacttggwcacgactgagtttgtcctgagcmattgtggtagaattgacctcgaggtgcccaatctatratagttccacg

SEQ ID NO: 25836 - DNA, 282 bp, Homo sapiens
  misc_feature 7: n=a, g, c or t
  misc_feature 8: b=c or g or t
aaactanbagaaaggacatccacaccaaaaccccatctgtacgtcaccatcaacaaagaccaaaagtagataaaacaacaaagatggggaaaaaacagagcagaaaaggtgaaaatttttaaaatcagaacactactccccctccaaaggaacgcagctccttgccagcaacggaacgaagctggatggagaatgactttgacaagttgagagaagaaggtttcagatgatcagacttctccaagctaagggaggaagttcaaacccatcgcaaagaagcgg

SEQ ID NO: 25837 - DNA, 212 bp, Homo sapiens
ttaaacctcctttcaatcataatttacactagttttaactatataattttgtgtgatctgatataaacagaggattacagttttgtccatttacaagtctaaataagccactgaatggtttataactatttttcagtattgtgttctatatttataattatgaagaacgttgagaatgcaatcatccttaatagcaagagtaagccacccgc

SEQ ID NO: 25838 - DNA, 170 bp, Homo sapiens
  misc_feature 7: n=a, g, c or t
  misc_feature 113: w=a or t
taaaaanaaaaaatctaactatgttttattttccaaacccagttttactaacatgttgtagcttctcataaaatattttgaactagtaacattaagttttgacaaaagcttgwaacctgaggggaaaaaaaattggtcagatactgtgagagagatttcaaaagaatagg

SEQ ID NO: 25839 - DNA, 158 bp, Homo sapiens
ttccctcagtgggtacatcttgcatgactatagcacaataccaaaaccaggaaatttacattggcataatgtatgtatatagttatagatcattttatcatgtgtgttgatttgtgtaactaccaccaccaagatacgaaactcttctgtcaccggaa

SEQ ID NO: 25840 - DNA, 205 bp, Homo sapiens
ataagttgacttattctttatctctgtgaacagcaggtctatccatttagacatccaagcttgcagcctaggagtcatgcttggttctttctttttctcacctcacataaatcagtgaacaagccttgagagttctctctagacctctttgctgtgtctgacacatcttccctccattctaagtgctgctgtcttaggccacaca

SEQ ID NO: 25841 - DNA, 267 bp, Homo sapiens
  misc_feature 42: m=a or c
  misc_feature 53: r=a or g
  misc_feature 77: r=a or g
  misc_feature 93: w=a or t
  misc_feature 94: k=g or t
  misc_feature 100: m=a or c
  misc_feature 173: r=a or g
  misc_feature 207: m=a or c
  misc_feature 208: w=a or t
  misc_feature 225: r=a or g
tgtttctacgtatgtagaatgtatagggatagaagagttgamaagggaaagcraaactcctcaagtagcttccttaraatgtcattcataggwkatgtamtggaattgctcattctgtgactttatttgtgtcctaaacattcttcagtgaaaataattttatttcagtcaarcatttatgaggaaatgagatcacatctttgtcamwggatgctacttgaagarggagtactttgtaaccactttgatatgctgttatcaccacct

SEQ ID NO: 25842 - DNA, 139 bp, Homo sapiens
ctttagattcgctcctccgggcagggagcggagacggaggaggaggagggagaggctgaatgttggctcgggagacgtacgaggaggaccgggagtacgagagccaggccaagcgtctcaagaccgaggagggggagat

SEQ ID NO: 25843 - DNA, 228 bp, Homo sapiens
  misc_feature 85: m=a or c
  misc_feature 141: w=a or t
  misc_feature 144: v=a or c or g
  misc_feature 164: r=a or g
  misc_feature 187: w=a or t
acatcttacattcatcatgttctctatgtaggcaagtgacttcctctgagataacctccaacccattttccaacagattatctgmatggtccacttttattcaccctttaaaatcagcttaagagactccaattcctggawgcvttccttaaagcaactccccrgcttggtctgagtcctcttcttwatgccagaagccccacatgtacacctgaactgtctgcttat

SEQ ID NO: 25844 - DNA, 239 bp, Homo sapiens
caccatttaacttttttcagagtaaaatttgtgttaaaaagttatctttcactttgtagaaagtacagtttgtcaggttacaaaatttgttcttctaaaattaacattttgttaaaactgaattggactgaccttaagaaaataaaagcaggtgttttaaaatgtctcttctcttccatctaaaacaaaacttcttattcattaataatttttgggtttgtaatagtagacggacatta

SEQ ID NO: 25845 - DNA, 225 bp, Homo sapiens
cttcattccacgtaatttcacgtggactttaggttaactggggtgtttgaggttatttataggttatcagtgcaacatttagatcacttgagataagagtaattcactatcaacaggtaagaggattaagtcagttggcattgtttttctgtgtaaaagaaaaattgtatgagattctatcataaagtgtgtaaaatgtaacaaaagttagaataagtaaaagct

SEQ ID NO: 25846 - DNA, 110 bp, Homo sapiens
acacggtttttgacttccagtccatcgcagtttcacctcgcggctgtcattgagaaataaaaccttttcccggtttttttgttttgtttttgaggagtctcgctctgtcg

SEQ ID NO: 25847 - DNA, 393 bp, Homo sapiens
  misc_feature 7: n=a, g, c or t
  misc_feature 8: n=a, g, c or t
  misc_feature 9: h=a or c or t
  misc_feature 152: m=a or c
  misc_feature 370: w=a or t
  misc_feature 372: d=a or g or t
tatagcnnhactgcagccttgaactcccgggctcagatgattttcttgccttagcctccaaggtagctgggactaccggcatgtaccaccatgcctggctaattttttgaatttttttttgtggagacagggtctggctgtgttgtccaggmtgggctcaaactcctgggctcaggtgatcctcttgcctcagattcccaaagtgttgggattacaggtgtgagccactgtgcctggccagtttacaaaattttaagtcttatttctagagacttatctaaagacactgttgtgtttacatttattctaagaataattggctttggggtaccacagagtattatcctgccaacacacttgttattctttwtdtttcacttgagcaaaacgcct

SEQ ID NO: 25848 - DNA, 98 bp, Homo sapiens
cacagtcttgatcaccaagtattcccattttgtgtcacccacctatactattgtattcctagtgccatagtttctttttttttttttttttttttttt

SEQ ID NO: 25849 - DNA, 314 bp, Homo sapiens
  misc_feature 7: y=c or t
  misc_feature 8: s=g or c
  misc_feature 126: r=a or g
  misc_feature 135: m=a or c
  misc_feature 140: d=a or g or t
  misc_feature 193: m=a or c
  misc_feature 283: r=a or g
  misc_feature 300: r=a or g
ataccaysaagcctgttttataattcctgactcccagaaaccctgagatgtattcacagcctgtagtcaccctccagaacccaagcaggaccttggaacttcactccatataccactccaaagcargttttctgmtccadtgtgatgagaaatgtgatgttcactgaaatgcaccgtgagtctggagaactamtgttcagccaccttgggcatggcatctaaatgtacagtatcgagagtgtgatagccttccctggaaacaagaactaaggtccataaatcraatctcaagtcaagagragaaagccgtcact

SEQ ID NO: 25850 - DNA, 120 bp, Homo sapiens
tatcttttgttcaggtttagtttttaaagcacgtgaacgtttacaaatgtaattctgtaaatcaactgcccaggttccaaatcccactcacaacctacattcattaagtacactctgaat

SEQ ID NO: 25851 - DNA, 274 bp, Homo sapiens
  misc_feature 44: v=a or c or g
  misc_feature 252: n=a, g, c or t
  misc_feature 253: n=a, g, c or t
agattcccttctacttatgttttgtgtatctagtagagattttvctttgtggttaccatgtagttatataaaacattttattcttagactatgtcaaactgataactttggtcatatataataactctacacatttactctcccccattttatgttttgatgtcaaaatttatatcattttctaatttgtatcccctgacaattgtagctatggttcttttgatagatttgtctattaaccactgcactagnncataaaattgcttcacacacc

SEQ ID NO: 25852 - DNA, 199 bp, Homo sapiens
  misc_feature 150: m=a or c
  misc_feature 166: k=g or t
  misc_feature 167: k=g or t
tagagatatgctgaaccgttcagtttccaaacgtgcaaactggaggaaattgaaaagtccttgaagacggaagcttttggttcatatccaaatttcaattcagattttttttttttacaaaagccaatatatcagccaatttttagcgamatcctcttaaatcatkkggatatttaagtgaatgtaaaatgcccacctt

SEQ ID NO: 25853 - DNA, 177 bp, Homo sapiens
ttcatcacccagcctcttctcctctggcccacccagcgtccaggctctttctccctctcccctcctatctagaatgtcccctgcttctagcctcaccagaccccccaagctcccactacttcttccataataatagtaataacaatggttatcatcatcccctgcacatcccgcctt

SEQ ID NO: 25854 - DNA, 200 bp, Homo sapiens
gcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggga

SEQ ID NO: 25855 - DNA, 142 bp, Homo sapiens
taaatagaaaacatgtagtaagataatagatttaaacccagatatatcagtaaatgaactaaaggctttagtagtagtagttgttgtcatctgtaagatggttaggatgggtttttctcaaatacctaaaacaagggtacag

SEQ ID NO: 25856 - DNA, 445 bp, Homo sapiens
  misc_feature 7: s=g or c
  misc_feature 8: y=c or t
ctctttsyctcaaggaagtcaaaaaacacctgcagccttactgtccccttggaaacaagatgaacatctacattttctagagtgggacaagaatctctgttcatatttatgtcccatgcatttgcacgtggccggacaaaggactttgcttctgccagcacatctgtcttcagatatgagaggaaacagacacaacctggaggcggcaaagaagcagctctttctcaagtgacctcctctatctccctacttcctggctaatggggcagccttgatccttgggaatccaggacagatatccactcgtgacaaactagctggaagaatgacaaccaatcaggttccaagcaccactggatgtgaaccacagaatttcctcctctccttgtggaatgtcagcttacgtctgacaaaaaatgtaaaactgagagagttacaatcttaa

SEQ ID NO: 25857 - DNA, 287 bp, Homo sapiens
cattatctctcgctgcaggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatccccgc

SEQ ID NO: 25858 - DNA, 191 bp, Homo sapiens
  misc_feature 7: d=a or g or t
  misc_feature 8: h=a or c or t
  misc_feature 117: m=a or c
acccccdhtcaaaactaaaaactgtccagtcgccattttttctgtttttttgtttttttttttaatttctaggagatgcatggttaactatcaggggtgacatgccactagatctgmaatttaacttaaaatggttcagagaaggctggatgcggtggttcacgcctgtaatcccagcactttgggaggct

SEQ ID NO: 25859 - DNA, 162 bp, Homo sapiens
ttattttatagtgacatgtttcagtctttccttttatattcagtattttctttgtggttaccatggggattacatgaaatatgctaaagttagaacgatttattttaaacttaaaacaacctcaattgcatataaaaactcaactcctttacagcaccacta

SEQ ID NO: 25860 - DNA, 353 bp, Homo sapiens
tgactctatctttgtttcatttgacttctatagcaccgtacactctgggttttcttcctatcgctgtacacaactttctaccgtttttaatagatttcctctcttcattccttaaattctccatttttcttgagttctgccctaatctcccttcttgtctcaatctgtactcctgagttatttcatctgcttccgtgagtacaaatatcatctgtgtgctgagaactctctggccaaaatctgcagctggatctctctgtaagctccagatatgtatctatcattttagcctgcagtcttcatagattggcccataggcccacaaatgcaacagtttcagacagaacccaagg

SEQ ID NO: 25861 - DNA, 225 bp, Homo sapiens
tccctatttctttggtcccaatgtacaggggaacactatttgaggaacttgccacaatgaagtaaaaaccccaacagagaaagcactccatcagccaccacatttgggggaaagtgcattgtgaaagtccgtaaatcaggagttagaaaattagttttaaacttattttctcatttaaaaacatggattcagatttctaagggagtataaagtgtgacaaagcca

SEQ ID NO: 25862 - DNA, 150 bp, Homo sapiens
  misc_feature 47: w=a or t
  misc_feature 48: w=a or t
  misc_feature 116: s=g or c
  misc_feature 119: w=a or t
caatagagaagagcaaatgtagtttaaaaattacaaaatctaaaggwwaccaagaaagaagagagaacaaagagacaaatatagaaaatgcctattattttagaagcataaactcsaawtcagaataacattaaatgaaaaaggaccttc

SEQ ID NO: 25863 - DNA, 324 bp, Homo sapiens
  misc_feature 7: n=a, g, c or t
  misc_feature 8: n=a, g, c or t
  misc_feature 112: m=a or c
  misc_feature 293: n=a, g, c or t
  misc_feature 294: n=a, g, c or t
  misc_feature 317: n=a, g, c or t
  misc_feature 318: n=a, g, c or t
atgctgnnacggggactgaagatggcgccgcgaggtgagattccggaggtaaacggttgtcctccaccccgctggaaatcctgttctttctgaacgggtggtataatgctamctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccactcagtattagcgtnnccttgaccttcccatctgccatnntggcca

SEQ ID NO: 25864 - DNA, 430 bp, Homo sapiens
  misc_feature 7: n=a, g, c or t
  misc_feature 8: n=a, g, c or t
  misc_feature 9: n=a, g, c or t
  misc_feature 10: w=a or t
  misc_feature 20: y=c or t
  misc_feature 47: w=a or t
  misc_feature 292: h=a or c or t
  misc_feature 293: n=a, g, c or t
  misc_feature 294: n=a, g, c or t
  misc_feature 306: n=a, g, c or t
  misc_feature 307: n=a, g, c or t
tgaatgnnnwaaggtgcctyagtgaagtttcagaaggaaatggggawcacgttattagaaactggagggaaggctatccttgttataaagtggcagaaaacttggctgaattatattctactgtgaggtggaaaatagaacttttaagcaatgaacttggatatttagctgaggaaatttccaagtaaagtgtaggatttgttatctggtttctccttgctttttagagtagaatatgagaggaaagagataaagtgagtaaggagctgttaggttaaaagcaaccagagchnngatgatttggannattctcaggctattacaaaaagtgatatagcttgctctggggattacccagagcagagacaaacttttgctgggaaggttaggtatgtaactcatggatccaatcaatcatctaagcagaagc

SEQ ID NO: 25865 - DNA, 250 bp, Homo sapiens
  misc_feature 19: r=a or g
gattcagttaatgattttrgttggggagcgtctcctgggtgatccaggtgggcacaatgtccttaaaaggtcctaataagtgaaacagggatacaaaaggtcaaagtcaaaggagatgggaaagtggaagcaggctttacaatgatcaggccaagggccgggcacgttggctcacgcctgtaatcccagcactttgggaggccgaggcaggcagatcacctgaggtcaggagttcgagaccagcctgact

SEQ ID NO: 25866 - DNA, 128 bp, Homo sapiens
gtcacatgcaacatttacggaaactggctagaagacagcaggggaactcgagaagttggttgttttcagcagattaaaacaatacaggttagtgctttttgccccctggaaaacttttcgtagccaca

SEQ ID NO: 25867 - DNA, 153 bp, Homo sapiens
  misc_feature 7: k=g or t
  misc_feature 118: m=a or c
tattttkagtagagatggtgtttcaccatgttggccaggctggtctcaaactcctgacctcaagtcatccatccgcctcggccgccaaagtgctgggattacaaacatgagccaccgmacccagcctccttgattattttcttccctccaacc

SEQ ID NO: 25868 - DNA, 192 bp, Homo sapiens
  misc_feature 37: w=a or t
  misc_feature 117: m=a or c
  misc_feature 119: r=a or g
  misc_feature 164: m=a or c
acccccgctcaaaactaaaaactgtccagtcgccatwttttctgtttttttgtttttttttttaatttctaggagatgcatggttaactatcaggggtgacatgccactagatctgmaratttaacttaaaatggttcagagaaggctggatgcggtggttcamgcctgtaatcccagcactttgggaggct

SEQ ID NO: 25869 - DNA, 217 bp, Homo sapiens
  misc_feature 19: b=c or g or t
  misc_feature 33: y=c or t
  misc_feature 74: s=g or c
  misc_feature 104: r=a or g
  misc_feature 105: b=c or g or t
  misc_feature 106: s=g or c
  misc_feature 155: r=a or g
  misc_feature 156: r=a or g
accgaggagagcggcctgbcggaagtgggccaycatatctggaaactacagtctatgcttgtgaagcgcaaaasggaataaacatttaaagactcccccggggrbstggaggatggacttttccatggtggccggagcagcagcttacaatgaarratcagagactggtgctcttggagaaaactatagttggcaaattcccattaaccacaatgac

SEQ ID NO: 25870 - DNA, 121 bp, Homo sapiens
  misc_feature 19: k=g or t
  misc_feature 20: s=g or c
  misc_feature 104: r=a or g
cacattttattttgtattksagctgactgtatttatgtcttattttccctcctaggttgtaatgtcttatggtcagggaccatattctctttgtctttgctaarataccatatgccgcacc

SEQ ID NO: 25871 - DNA, 298 bp, Homo sapiens
aatagaaattgtctgtgaatggaggctcatccttgtaaaccgcttaggcagcttaagagtcaacagggatttggaaaaaccagcaagcctgtgtcaaaaatgaggctccccttgaatggggcttgagctacagattcaaacagcggcagtgacattttgatctccatttcctccttttcttgtgtcttttctctgtgttacactgtgagtgtggtgactggggcttcccgtggctttactcttcactgttcatccagctcccagtcctgggaggaagttcacctccacgccctcgcct

SEQ ID NO: 25872 - DNA, 184 bp, Homo sapiens
ccttgctctattttagttgtttggaaaatgttatcatacatgagaactagagatttccaaacttcttgttcagtagagctggctccagaaattgaattaatatattttaatattatgaaatatctcaggcatatttaaaaaatcacaaataatatttaacatcatgtactgacaacccagctca

SEQ ID NO: 25873 - DNA, 148 bp, Homo sapiens
actcccttcttggattttttttttaacattgtactcacctgtttttcttcttaactcattggctgttaattttcagtattctgtatggcttccctcctctgcttaactctcctgaataaggttcccaggagtctacttttcactgcct

SEQ ID NO: 25874 - DNA, 197 bp, Homo sapiens
tttcagaaggtcacaactattttaataatactaagatgctgtatgccttttaaattcattctcccatgagtgcacattggagtttttccagacatgtgatactgcaaaagattgaatgcaaaagtatatatttgggtgcagctgttgttgctcaagctagacattaaagaaatttgcaaagatgtaaaacagtgcct

SEQ ID NO: 25875 - DNA, 133 bp, Homo sapiens
  misc_feature 116: r=a or g
atggattgtatcgtatgttagatttttgataaaatttggccaatttttacagaagaaattctctgatcatttagttctatctatttagaaatatgtaaaactggatttttttttargataatatgtgacccaa

SEQ ID NO: 25876 - DNA, 238 bp, Homo sapiens
  misc_feature 139: m=a or c
tacttcacttagaataatggtgtccagtttcatccaggttgctgtgaatgcattacttcattccatcttatggctgagtagtattccatggtaaatatttataacacactttctttatccacttactgatttgatgggmatttaggctggtttcaaattcttgcaattgcatattgtgctgctataaacatgcgtgttcaagtatctttttcatataatgacttattttcctctgagc

SEQ ID NO: 25877 - DNA, 168 bp, Homo sapiens
  misc_feature 134: w=a or t
ttcgatttatggctgtagtaaaacattgtgatctaggagccacatattaggagggacattagcaaataagtctatgatgtcagagatttcgaaaattatatggaatggttgaaaaaaaatcatatggaaatggwaggcactatttgacctaaagaagacatgaggggc

SEQ ID NO: 25878 - DNA, 98 bp, Homo sapiens
catttgttgaccacatccttgcatttctggaatgtgtcccacttgatcatggtgtattgtctttttgatatgctgttggatttactttgccagtattt

SEQ ID NO: 25879 - DNA, 127 bp, Homo sapiens
  misc_feature 25: r=a or g
  misc_feature 49: m=a or c
taaatatccatttatcttttgtatrtctaagactcatcctgatttttamtatcacacatgaataaagcctttgtatctttctttctctaatgttgtatcatactcttctaaaacttgagtggccgtc

SEQ ID NO: 25880 - DNA, 167 bp, Homo sapiens
  misc_feature 7: w=a or t
tgaagawaatatcatttttcttttagttacattggattttctgtcttttgtgttacatcatttcacttctaagtctagatagagattatatttatcctattttggatgcatgtgtttcatgattctgcattttgtctttcatgagatctagaagtttctgagcccgt

SEQ ID NO: 25881 - DNA, 224 bp, Homo sapiens
  misc_feature 45: m=a or c
  misc_feature 115: k=g or t
  misc_feature 179: h=a or c or t
ccgttctggaaaggcacccatccttattgctacagatgtagcctmccgtgggctaggtttgtatagataggtgtctctgtcaatggtatatgtatcttttggtttaaagattcgkcatttcaaattcagacttcaagtttagaaagttgtatatacatgtggttagataaatatttgahagaaaaaaatacaaagcgtgattctccccattccctgccccccca

SEQ ID NO: 25882 - DNA, 232 bp, Homo sapiens
  misc_feature 180: r=a or g
  misc_feature 181: s=g or c
taacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagrscacaagttagaagaaaggtcacatatttcaaacacaactagatggggcttg

SEQ ID NO: 25883 - DNA, 333 bp, Homo sapiens
  misc_feature 7: n=a, g, c or t
  misc_feature 38: k=g or t
  misc_feature 88: k=g or t
  misc_feature 132: m=a or c
tgtaggntgggcttgtgctgactggctcgtggaggaakcctgtcaaggaggcttggtggcctgatgtttcccacaaacactgtgttakgcagataatgaagttttcgcttccatcggtgttcctctctggcmacgttaggtgaggggtttgctttagctttgggtatcctcttcccttggatacccagagatggtcattagtaataattttgtgtcttggctggagatggaaacaattagccaacagaagagaccagtcttctagagttgcaatctggaggacatcttttgctttgaaaagatacaattaagaatctgcaaacgatccgccgt

SEQ ID NO: 25884 - DNA, 131 bp, Homo sapiens
  misc_feature 9: r=a or g
  misc_feature 10: r=a or g
  misc_feature 81: k=g or t
  misc_feature 93: v=a or c or g
  misc_feature 96: m=a or c
  misc_feature 101: r=a or g
  misc_feature 109: v=a or c or g
  misc_feature 113: r=a or g
  misc_feature 119: r=a or g
attcatttrrttatgcttctgactttacttgttctccctaggggaatatcagttatgcgtgcttagtaaagttgtgttatkttccaagatgavaamttgcrtatatttvagartcattrttcaagggcggc

SEQ ID NO: 25885 - DNA, 108 bp, Homo sapiens
taaaaataaagagattttcctgagagaactgatttcaaattttgtctttgtacaggttggtttcttcaaacggaacctgaaggagaagatggaggctggcagaggtgt

SEQ ID NO: 25886 - DNA, 146 bp, Homo sapiens
caaatgtccccaaaagttgccaaatgcccccaggggcagaatcggccccaagtgagccccctactctgcacggaataacctgtggattttgatgtttccctgaccctgggttcaggccagtctctacccagggcagaccccactaa

SEQ ID NO: 25887 - DNA, 206 bp, Homo sapiens
  misc_feature 8: n=a, g, c or t
  misc_feature 9: n=a, g, c or t
  misc_feature 129: r=a or g
  misc_feature 136: r=a or g
  misc_feature 137: r=a or g
  misc_feature 198: r=a or g
ataagtgnnccatgttaggaaagccatcccttcatcatttaagaaaatggagcagcatgttatcttttacttagttgtagaaaatcaagatcctctcatattatagcaaggttttagaagaccctccaraaagtarrggtatgtaactcagtgcatagtattagataaagctatactctgctactgtacttaatttgrtacttttt

SEQ ID NO: 25888 - DNA, 240 bp, Homo sapiens
ctagattcatgtttttgcacgtgaaggtccagttgttcagcacaatttattgaaaagtctatcttttctccattatatttcctatgctccttttcaaaaatcagttgactgtatttatatgggtctgtttctgggttctctattctgtttcttcatctgtttgtctaatcttttgcagatatcacactaccttaattgctatagctttatggtaagtcttgaaatcaggtagtgttagtc

SEQ ID NO: 25889 - DNA, 142 bp, Homo sapiens
aaaaataaaaagaaaaggaagaaagaggggaagtagaaagatgatgggcaggcagctgtaggagtttttcaagtgctcaaatgaagggaataaatggaaagattatcaatagctattccaaatttttctttccaatgggccc

SEQ ID NO: 25890 - DNA, 100 bp, Homo sapiens
tattgaccatttatttttggaattggacctcagagcacactgtggattttagaaaagcgtgtgtgtgtgtgatgttataattataggagacctgcagatt

SEQ ID NO: 25891 - DNA, 275 bp, Homo sapiens
  misc_feature 100: r=a or g
ccctgggcatttccaagcaactcaactgctgaggttgatgagttcttggactaagatatggttaaagtcttaatgcgaaatagcaacagctggtcctgargagaggtgcaataacaaccccttaacatggctgatttggcgcatatcagtttgccctgcagtgttgtgagtaacagtcagtgataatgtttgcaattccataattcagcagtctttccttggcaccagatgagagcagtccttgcatgcaggaatgagtcatgtaatagcagagg

SEQ ID NO: 25892 - DNA, 307 bp, Homo sapiens
  misc_feature 8: n=a, g, c or t
  misc_feature 9: y=c or t
  misc_feature 100: k=g or t
ctatttgnyctgtagtaaactatttatctgtgtttttgaaatattaaaccctggatcagtcctttgatcagtataattttttaaagttactttgtcagakgcacaaaagggtttaaactgattcataaataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcat

SEQ ID NO: 25893 - DNA, 96 bp, Homo sapiens
tagtatttttcagagttttaatttctttattgacatatgcttgtctttttatcatatatcaattgacatatgattgtcttttattgacagaaacga

SEQ ID NO: 25894 - DNA, 134 bp, Homo sapiens
  misc_feature 114: k=g or t
  misc_feature 117: m=a or c
atataaatacagataaatcagacgttacagtggtgacgtagtaaccatcatggcaatggaaaggagtccaattcatagcctaaaacttcaaatgtattcttaggagtcagattktamtgaaatattttacccac

SEQ ID NO: 25895 - DNA, 182 bp, Homo sapiens
acccgggtagctgggattgcaggcgcatgctaccacgcctggctaatttttgtaattttagtagagacggggtttcgccatgttggccaggctggcctcgaacgcctgacctcaggtgattcatccgccttggcctcccaaagtgctgggattacaggcgtgaaccaccgcgcccgacctct

SEQ ID NO: 25896 - DNA, 247 bp, Homo sapiens
  misc_feature 245: r=a or g
cagacagcaaaaatagggaaattttggacttaaatagttttagctcaaagggacctaacatacttatatagaacattctattcaactgaagcaagatacacattcttctcaagtgcccatggaacattcttcaggatagatcatatgttaggccacaaacaagtcttaccaaatttaagaagattaaaattgtatcaaatatcttttctgaccacaatggtatgaagctagaaatcaataactgrga

SEQ ID NO: 25897 - DNA, 182 bp, Homo sapiens
cactaaaaataaacaagtaaaaaaagaggaaattgtaacaatatatcttatttaacccagtatatctaaaatagtattgtttcaacatgtagttcaacatataaaaattatgagtgaaatattgtacatttttgtttctgagctaattgaaatcagcatgtcgttaacactgcagcacatcc

SEQ ID NO: 25898 - DNA, 182 bp, Homo sapiens
  misc_feature 115: k=g or t
  misc_feature 122: s=g or c
  misc_feature 123: r=a or g
  misc_feature 128: s=g or c
  misc_feature 171: y=c or t
  misc_feature 172: k=g or t
  misc_feature 177: w=a or t
  misc_feature 178: y=c or t
acccgggtagctgggattgcaggcgcatgctaccacgcctggctaatttttgtaattttagtagagacggggtttcgccatgttggccaggctggcctcgaacgcctgacctcakgtgattsrtccgscttggcctcccaaagtgctgggattacaggcgtgaaccaccgykcccgwyctct

SEQ ID NO: 25899 - DNA, 183 bp, Homo sapiens
  misc_feature 114: r=a or g
  misc_feature 152: w=a or t
cccgggtagctgggattgcaggcgcatgctaccacgcctggctaatttttgtaattttagtagagacggggtttcgccatgttggccaggctggcctcgaacgcctgacctcargtgaatttcatccgccttggcctcccaaagtgctgggwttacaggcgtgaaccaccgcgcccgacctct

SEQ ID NO: 25900 - DNA, 199 bp, Homo sapiens
  misc_feature 7: s=g or c
atttctstgcaaaatatggtggtctttggggcggggtggggaggcgagtacctcccccgtcccccgggaggggggtacagacatttggaaatagtttctaaaaatgcttcgcttccacttctcatctgaaaagaaatggcaagctttgcggggtggggaggtgggagcacggaggacgaagcttgacgcaggggctgtg

SEQ ID NO: 25901 - DNA, 146 bp, Homo sapiens
  misc_feature 9: n=a, g, c or t
  misc_feature 10: b=c or g or t
aaggacttnbcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccggtgt

SEQ ID NO: 25902 - DNA, 386 bp, Homo sapiens
  misc_feature 7: y=c or t
  misc_feature 368: n=a, g, c or t
  misc_feature 369: w=a or t
cgccttycatcatttttgcctggattattttaacagtttattggctatcttgcctctaaccttgcttgcctccttttgtcctatctgccacatgttgtcagattcatccaagacacaaaactgatcttacaggtgaggtgctctattaattgtgccccattttcttcaggattgattttaatttctgagtatagcataaatggcacatcatgatttgacttttgcccattccatcttcatttcaggccttttctcctatgtgcataatctgctatagtggtacctatctacttggcaggttttcctgcattaatttttcctcatccatgtgtcttcccacacttgccttctatatggatttctgttgnwctttcaaaatacaacgc

SEQ ID NO: 25903 - DNA, 100 bp, Homo sapiens
ggaagaaaaaagcaagatgggaccgcaagctggacgtgactgtaaggggtcatggctgcggaatccagcaggggcattggggttgacgtgcactcagcgc

SEQ ID NO: 25904 - DNA, 101 bp, Homo sapiens
tctttagtggtgatttctgagatttttgcgcacccatcacccgagcagtgtacactgtacccaatgtatagtcttttatccctcacccctcccgacccacc

SEQ ID NO: 25905 - DNA, 193 bp, Homo sapiens
tctcaaactacgctgccttccgaagtctggcatttgttagctcatgcttccttgtagtccagcttcttatgtgcctgttatattctccagtaagattgtaagccccttaagggcagggacgtctttgcatctctagcactgctatagtgttctatccttagttatgaactagataaataaatggtggtggcag

SEQ ID NO: 25906 - DNA, 209 bp, Homo sapiens
tctttaacctctcttcttcattttcctatagcaagctggctgcctctttccagagtatggaagtcaggaactctaacttcgctgctttcattgacatctttacatccaacacttatgtgatggttgtgatgtctgatccgtccattcgtaagtttaaacttagctgacctaggttcaaagccacatactctttaaacaattgtcccaga

SEQ ID NO: 25907 - DNA, 84 bp, Homo sapiens
tctgccttggtgaggggagaggaagaaattttacaggctttttattggccggttatttttctgtgtgtcccatacaggcccccc

SEQ ID NO: 25908 - DNA, 488 bp, Homo sapiens
  misc_feature 9: n=a, g, c or t
  misc_feature 10: v=a or c or g
  misc_feature 116: r=a or g
  misc_feature 117: s=g or c
  misc_feature 201: y=c or t
  misc_feature 378: b=c or g or t
  misc_feature 430: d=a or g or t
agcgtcgtnvcgaggccacccggaagaccaagccggcatggccgaaacagaagccctgtcgaagcttcgggaagacttcaggatgcagaataaatccgtctttattttgggcgccrsggagaaaccggcagagtgctcttaaaggaaatcctggagcagggcctgttttccaaagtcacgctcattggccggaggaagctyatcttcgacgaggaagcttataaaaatgtgaatcaagaagtggtggactttgaaaagttggatgactacgcctctgcctttcaaggtcatgatgttggattctgttgcctgggtaccaccagagggaaagctggggcggtaaggaaggcatatgctcttttccctttttgctggcabataatatcaaggattcttttcttgctcactctttttctttgtgcctgttgcdatgcttaaatgtgaataagcctttattgtttaagattctatatgctgcactaaccttt

SEQ ID NO: 25909 - DNA, 250 bp, Homo sapiens
  misc_feature 139: k=g or t
  misc_feature 140: w=a or t
  misc_feature 149: y=c or t
taaaacttggaatacaacctactaaccttatttttatttgtactactggaagttcctctagcatttttgaagtagcttggaaaaaaattgagattcagttgtggttctacttacatttttactagagtaagttggagakwcaaatcagygagtagtcaagtcttcatataatcaaagcttttaaaatatgataacaaaaacttcaggtgttagatttagcttcacggaaaacctttttttggggggcact

SEQ ID NO: 25910 - DNA, 145 bp, Homo sapiens
  misc_feature 120: k=g or t
  misc_feature 121: r=a or g
tttgagacagagtcttgctctgttgcccaggctggagtgcagtggcaggatctgagcgcactgcaagctccgcctcctgggttcacaccattctcctgcctcggcctcccgagtagctgkractataggcgctcaccaccacgca

SEQ ID NO: 25911 - DNA, 256 bp, Homo sapiens
  misc_feature 8: m=a or c
  misc_feature 9: y=c or t
  misc_feature 254: h=a or c or t
  misc_feature 255: n=a, g, c or t
  misc_feature 256: d=a or g or t
caccagcmygctaaaggtaactgattacttccgtttagtcaactttgtctcctttccccatcagctgttatttagaacatatctttgaaagaaaaagcaaaagaaaaaaatacaatagtgatagtgttagctgttaactgctaataatgttaactgctttatcaaaagcttagaagatgccaaaggacaactttgagaatgtaacaaaattaggaattaagcaaggaccacaaggcagaaaaagaagcagaathnd

SEQ ID NO: 25912 - DNA, 136 bp, Homo sapiens
  misc_feature 87: k=g or t
  misc_feature 133: r=a or g
cttttttttttcttttttccggcgttcaagatgtcgaagcgaggtgaggttttgtttctggaggatcctccaccatctgtcgtgcaktggctggcggattcgtcaggagcggtggccctaggcagctggggcrcgt

SEQ ID NO: 25913 - DNA, 191 bp, Homo sapiens
  misc_feature 112: k=g or t
  misc_feature 134: k=g or t
tattaatatttatccaatcagtgatggacatctggttgttcccacttttgggttatgaataatgctgcatgaacatttttgtacaagtttttgtgtgaacatatgttttcakttcttttgggaatgggattcckgggtcaaatcgtagctctatgtttaacattttgaggaactgccatactattctgaag

SEQ ID NO: 25914 - DNA, 207 bp, Homo sapiens
  misc_feature 121: r=a or g
gtaaaacccacatttgcttccatcacacctcactactttacttctgaaaatattcgtacggtgaacattcctgttggcaagatttatacttctagggattgtccaagttttttttgtggargtttctagagaacaacagccatcatcagcatctgaaagacaggcccctcgagcacctcagtcaccgagacgccaccacacccacca

SEQ ID NO: 25915 - DNA, 217 bp, Homo sapiens
  misc_feature 19: r=a or g
  misc_feature 109: r=a or g
  misc_feature 126: r=a or g
  misc_feature 132: r=a or g
agacagattaacaagagarcaataaacagaagtgtattaacatgtatatttcatatctacacgggtgatacccacagcatgagtagttctcaaagacgtggcaaacacraacaagcaaatgtttaraaataraaacactcgtataccatgagttaatctgggactatgccccttccagatgttttttaattttctctttctttcttccttcccgtca

SEQ ID NO: 25916 - DNA, 249 bp, Homo sapiens
tgcaaaacaatgaaattggacctttatcttacaacttaaaatcaactcaaaatattaaagacattataagacatgaaactctaaaactcctggaagaaaacaggaagaaatctccttggcattggtcttatcaatgacttttttggatatgacaccaaaagcacaggcaacaaaagcaaaaataaagtgggattatatgacactaaaaagcttctgcacagcaaaggaaatagtagacaaagagcgact

SEQ ID NO: 25917 - DNA, 134 bp, Homo sapiens
cacgcctggccagatcttatttggaaatggtattctgcattgtaatttttgttctgttttatttttacattttctttttatgacatatctaggatttgctttaaaacatcccagccaagaaaaagaggggtccc

SEQ ID NO: 25918 - DNA, 94 bp, Homo sapiens
ttttaaagcagtttttggtgacagcaggacgggctcgaatttaacttgtgcatcccttaatggtgccttctcgcacattatctgtaacgccccc

SEQ ID NO: 25919 - DNA, 95 bp, Homo sapiens
agacaaccctggggtcccatccctgcagcctacaccctggtctccacccagacccctgtctctccctccagacacccctcccaggctaaccctgc

SEQ ID NO: 25920 - DNA, 252 bp, Homo sapiens
  misc_feature 7: s=g or c
caatgcsctatcacagctgtggctatagtgcaactctgtgactgcaggtggcttctgagcaggactggtagagacaagagagagagaaaaaaaggaatcccctttatactgtcttgtttgctgaagttcattttccaagtcttctgggcagcaagagaggggctttctcttgaagttttttgccatatgtacacagaatgcatttctgggactcaggcacacccctaagtgaaagcaggaatataaaggaga

SEQ ID NO: 25921 - DNA, 157 bp, Homo sapiens
  misc_feature 7: m=a or c
agaggamaactgcagacagaaaaatgtggccggatgctctgtgggcgggcggcagcgatgttcggccaggtggctccaaggagaggaagcagtgatgcattgaggtaagagagctgacagatgaaaccacatggaccctaagacagagtggaagggt

SEQ ID NO: 25922 - DNA, 182 bp, Homo sapiens
catgagttattaaacagtttttaggataactttattaataaaagagaatctcagcttaatactttcaaattgtttgttaacactctgttcagcagtaaagagccattctaccatgaaaaaaagttaatcttgttcattgctgaatttctatcccctagatggggactctgcacctgaggtaa

SEQ ID NO: 25923 - DNA, 225 bp, Homo sapiens
cgtgcttttattattccttttacccatctagatttctggcttcaagggacaaatttttaaagtatctgatagagtgtcttgtagattgtcaactgtgatttaaagatactgaacttcctggctgggtgtggtggctcacgcctgtaatcccagcactttgggaggccaaggcgggcggatcacctgaggtcgggagttcaagaccagcctgaccaacgtggagga

SEQ ID NO: 25924 - DNA, 273 bp, Homo sapiens
  misc_feature 7: h=a or c or t
  misc_feature 8: n=a, g, c or t
  misc_feature 233: m=a or c
  misc_feature 244: w=a or t
  misc_feature 245: w=a or t
gaagathnaggtgaatctcgctgcccaataatgagatgcaggtgaatctcactgcccaataatgagatgcaggtgaactggggaggaagagagtttttatttctgtaactggttacaaggagaaggcctggaaattatcaccagaccaactcaaaattacaaagcttttcagagtttatatcccttctaagctatatgcctacatgtaagtgtgcattcatctaaagacatamgtgattaaacwwctttgaatctataactaaggtctgagtc

SEQ ID NO: 25925 - DNA, 220 bp, Homo sapiens
  misc_feature 7: m=a or c
  misc_feature 8: n=a, g, c or t
caaatgmnatggagatatttaaaaagataggtatgtgtctgacaactaaaagatacttaaatggcagtttggggaagtattaattagtggctgacccttttgtagtgttaaatgttctgtctgactgtgtggcttcaggtaggtctcttaactttgttaagctccagcttctttaactgaaattgggagttaagagtagtgtgtattccacggggggata

SEQ ID NO: 25926 - DNA, 233 bp, Homo sapiens
  misc_feature 71: k=g or t
  misc_feature 72: s=g or c
  misc_feature 204: m=a or c
  misc_feature 221: m=a or c
  misc_feature 229: r=a or g
ttttcattcctctgattttagcaaagcaaatcttactgaaaaatagcagagccaggggaacagacgcatgkscttctgggagtcacacaaaagcagagagattttgaactgaggggcgacagctttgccttaaatgcagtatgacaggcgcttcttggcagaccagtaaaaacaaaagcccatagaccttactcatcccaaggmcgacaagccagctgtamagggcgarccga

SEQ ID NO: 25927 - DNA, 343 bp, Homo sapiens
ctgttctcacagctgtgatcacgagccattgtcattcaagtgcccaccttgtcttgctgtgtactcattgtcttctatcaatcgggccaatccgaagtcagcaatcttgcatatgagtccattccccactagaatgtttgctgatcgcagatctctatggatataattcatgcgctcgatgtaagccattcctgcagccacctgtggaaacccagggaacaggacatgttacaccacgacccaatgtacttagacacgtcattaaatctatggcacatcaagttaccctgcagggcctacctgtgctgccatgtccacaagatttggtaatttcagagctcaa

SEQ ID NO: 25928 - DNA, 189 bp, Homo sapiens
  misc_feature 182: m=a or c
  misc_feature 183: w=a or t
cactgttgtacagtcactgtatcatagatagatctctgtctaactgaaattttgtaccctttgacccagggtctccccagcttgcagctctgtagccacccttctgctctctgcttctgtgagttcagttttttaagattccatatataagtgagatcatacagtatttgtctttctgtgcmwggcgat

SEQ ID NO: 25929 - DNA, 173 bp, Homo sapiens
  misc_feature 7: n=a, g, c or t
  misc_feature 8: v=a or c or g
  misc_feature 9: w=a or t
  misc_feature 92: s=g or c
ttaaaanvwgtggttatcacaagtctcgagggggaaactactgcataaaataactaacttggaataaatattttgcatcagtttggattgtsttgtgtaagaagtatattttctttaaaattagatgagtggattcttttttaggggaaatatttttagaagttgggggctaa

SEQ ID NO: 25930 - DNA, 396 bp, Homo sapiens
  misc_feature 2: n=a, g, c or t
  misc_feature 8: n=a, g, c or t
  misc_feature 9: n=a, g, c or t
  misc_feature 76: m=a or c
  misc_feature 262: m=a or c
  misc_feature 264: m=a or c
  misc_feature 268: m=a or c
  misc_feature 282: m=a or c
  misc_feature 286: m=a or c
  misc_feature 337: h=a or c or t
  misc_feature 338: n=a, g, c or t
  misc_feature 382: w=a or t
anctttanntctgcagtaaaatatcaggaatcattctcagtgaccacatttttctggaatacaaattgctgttcamgtgcagccctttagttataggctattcagttgttcttattgtcctctatgtagaatggatgcttaaactataatttgtagaagctgaaatggaaaatgggcctgaggtgtttcctggtaattagctgtcctgcctttccatggctggttgcttagaaatgacagtttgtgccactctgcgaaattmcmtgamtgcaaagcacccamtcamtgcaggagaccacacgttgctttgtgaatcagtgggggttggggcagcaghntgttcttttttctcagctttgatttgttgttaattgagcaagcwgtaattgtagacgt

SEQ ID NO: 25931 - DNA, 130 bp, Homo sapiens
  misc_feature 62: r=a or g
aaagcctagttgaaaggcacaaattcctagaaagacacaactgaaactggatcaagaagaartagataatctgaatgggactataataaataaagacactgaattagcagtcaaaaaacttcacacacac

SEQ ID NO: 25932 - DNA, 145 bp, Homo sapiens
ataactgttttctcatatggttaacattttttcttgcctggctaaagaaatccttttctgcccaatactataaagaggtttgcccacattttattccaaaagttttaagttttgtctttcatcttgaagtctaatgtatcaggaa

SEQ ID NO: 25933 - DNA, 278 bp, Homo sapiens
  misc_feature 6: s=g or c
  misc_feature 8: h=a or c or t
  misc_feature 9: m=a or c
  misc_feature 144: k=g or t
gactgsghmtcgccaacaccctggggaacaagggggctgtgggcgtctccttcatgtttaatggcacctcatttggctttgtgaattgtcacctcacctcgggaaatgagaagacggctcggtgagggggcgctttcccatggkctctttacacccatcccattcacctgaggcctgttcccgctcccataccctagcccatgaccctcccgcaggcctgtctccagagaccccctgctctcttatcccaattcaagacccttctgttcctgacccac

SEQ ID NO: 25934 - DNA, 250 bp, Homo sapiens
  misc_feature 7: n=a, g, c or t
  misc_feature 8: n=a, g, c or t
ctgctgnntggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctagcccc

SEQ ID NO: 25935 - DNA, 292 bp, Homo sapiens
  misc_feature 251: r=a or g
  misc_feature 252: r=a or g
ttaaagacttaaatgtgagacccagaactgtaaaactactgggaagaaacataggggaaacactctagcatattggtctaggcaaagattttatggctaagaccctaaaagcacaggctgcaaaaccaaaaatagacaaatgggattatgttaagctaaaaagcttctgcacagcaaatgaaacaacaaagtgaagagagaacccgttgaatgggagaaaatatttgcaaaatatctgtctggtgacaagrractaatatccataatacacaattccaacaactcaacagcc

SEQ ID NO: 25936 - DNA, 253 bp, Homo sapiens
  misc_feature 7: n=a, g, c or t
  misc_feature 8: n=a, g, c or t
  misc_feature 59: r=a or g
  misc_feature 238: w=a or t
  misc_feature 252: n=a, g, c or t
  misc_feature 253: r=a or g
cagactnncttgggcaacacagggcgacccccatctctacaaaacataaaagatttttraaaaattagccaggcatggtggcacatgcctgtggtctcagctacttgggaggctgaggcaggagaatcatttgagcccaggaggtcaaggctgcagtgagctttgatcacaccactgcactccagcctgggcaacagagcaagaccccatcctccacccccccaaaaaatagaaagawaaaaaaagtttgcnr

SEQ ID NO: 25937 - DNA, 118 bp, Homo sapiens
aaaagaaagctagtactttgtgatacctttgtatcaacaggacagacctttttctgcatctgattaatgagaattttaatttttgttactttcaagtttccattttcttgaccacgtc

SEQ ID NO: 25938 - DNA, 129 bp, Homo sapiens
tccaaaccactaactaaccagaggagagccccttcttccacctccagggagaatttcagatttaatttgtccgaagatagcgtgctctcttcttactcatttgccatcattacgaggaaaacaaacctt

SEQ ID NO: 25939 - DNA, 191 bp, Homo sapiens
  misc_feature 59: m=a or c
  misc_feature 61: w=a or t
caatttactgtattagtccgttttcacgctgctgataaagacatacccgagactgggamgwaaaagtggtttaattggacttaaagttccacatggctggggaggcctcagaatcatggtgggaggcaaaagacacttcttacattgtggcaagaaaaaatgaggaagaagcaaaagcagaaacccctgat

SEQ ID NO: 25940 - DNA, 191 bp, Homo sapiens
cacataaatggtaattgatgccatagaagtgagtgcacttacccaggaagaatgtgtctgtattgaatgaaaggggctcagtatgggtcactgaggaacaccaagaaggtagctaccttagatggcatattgggaactgcttccttgtgtcctagagagaatacaaaacccacagctgggaacatatgtct

SEQ ID NO: 25941 - DNA, 143 bp, Homo sapiens
ctttattttctttaacttcaggtttaaattgagcatttccttttgttatgaatgtaggcagcagaccgcagtgcccttggcagtgcctatgagacggagtattgtcataagaaatgagttgtcgaaacatcgtttgccctcag

SEQ ID NO: 25942 - DNA, 242 bp, Homo sapiens
  misc_feature 138: r=a or g
ctcattatattattcttgttactttggggtaaatctgaaaattcttcagagccactgaaggctttttcaacaggggaatgaggaatgacagatgaaactgcccttctagcaagtacagccctggagtcggaagactaracagcgggctgccaaggagggtcactgtgatgcaggactgagctatgagagtgtcactgggggcggaggggaggatctgggtgtgaacagtattaaggagactc

SEQ ID NO: 25943 - DNA, 94 bp, Homo sapiens
attattcttcctttaatatcttgagaatggcttttgttaaaggagaactgatactttgtgatattattatttgcaatttaattgagaaggggat

SEQ ID NO: 25944 - DNA, 169 bp, Homo sapiens
  misc_feature 16: y=c or t
acactagttaaaagaycagtggatttaaatacactaaactatagtttaaaagtattttcaaatattctgcttggccaacaacttacggtgccttcagttatttaatatataatcagatattcaaaggtttaaaacaatattttcatcttagtttataaatatgaggccc

SEQ ID NO: 25945 - DNA, 203 bp, Homo sapiens
ttcttgctaaactggatgtttttgtttgttactatttttagaaagctcttcatttcatagttttaactggttattgctgttatgtagggatggtcttgctttattaatataaaatttttatggagacacataaagagaaaagtgcaccactataaattcatgcccttcagtgaattttctttaagtaaatacatccacatgtc

SEQ ID NO: 25946 - DNA, 145 bp, Homo sapiens
acgtgacacggagggggccgaattctgctggaggcagcgccatatcctggaggtgaaggtaccacctcatggagacccccgcggccgccgcccccgctgggagcttattcccctccttcctgctcctggcctgcgggacgcctct

SEQ ID NO: 25947 - DNA, 251 bp, Homo sapiens
aaactttggccctgcgcctcgtccagcctaggttccacccttttctgggaacgtgagtatcaaccaagaatgaatctcgctgtgttgtccaggctggagtgcagtggcaccatctcggctcactgcaacctctggctcccaggttcaagcgattctcctgcctcagccccctgagtagctgggattacaggcacgcgccaccactcccagatcttcacttcaggtcagctccaaggaggctatccttgccc

SEQ ID NO: 25948 - DNA, 253 bp, Homo sapiens
ctgacaagaactagacagatttttggagcagggagcatccagggcaaacgcacgacagtcctccgcagtgcatctcaccggacaaacatccccggagccacaggaggggaggaaggggctctccgggcgtgcgcacctccccagccgccgcgctgtcccatccccgacccctaatctggtcaacctggaccccggcactgctgaattgcatcccctcttctccctttctcctcggcctcctcctttccacaaa

SEQ ID NO: 25949 - DNA, 148 bp, Homo sapiens
aacaaactattgacacgggcaacgacctggatggatctcaagggtattatgctgaatgaagaaaatgttcatctcaaaaagtcacatactgtatgattccattgacatcacatcctttaagagatgaaactgtagagatggagagcaa

SEQ ID NO: 25950 - DNA, 318 bp, Homo sapiens
agccttttgtatttctggattttcagctgctcaaccatctccttccacagtgcccaaaactgaagaccagcgtcctcagttagatccttatcagattcttggaccaacaagtagccgccttgcaaatccaggcagtggccagatccagctttggcagttcctcctggagctcctgtcggacagctccaactccagctgcatcacctgggaaggcaccaacggggagttcaagatgacggatcccgacgaggtggcccggcgctggggagagcggaagagcaaacccaacatgaactacgataagctcagccgcggccc

SEQ ID NO: 25951 - DNA, 93 bp, Homo sapiens
gtgcagatcttaattctttgccagactctggtgttgtagaatatttgagcacaggtggagtagaaacaaatcacaaagactttaaggagttga

SEQ ID NO: 25952 - DNA, 145 bp, Homo sapiens
  misc_feature 121: m=a or c
ttttagtagagacagggtttcaccatgttggccaggatggtctcgatctcctgacctcgtgatctgcccgcctcagcctcccaaagtgctgggattacaggcttgagccaccgcgcccggmcggtcattcattcttgcaacaagc

SEQ ID NO: 25953 - DNA, 196 bp, Homo sapiens
cttttgtatttcagtggtgtcagttgtaatactgtttcgtttcttagtgaggttatttggattttctctcttcttttcttggttaatcttactaatgtcctgttaattttatttatcttttcaaagaaccagatttttgtttcatttatcttgtgtatttttgtgttttgttttaatttcatttagttctgctcga

SEQ ID NO: 25954 - DNA, 179 bp, Homo sapiens
tgttatcgaagctcacagaggactgattcatacccccaattccaatcattaaacctataataagggaagatggctttccagtgactagattgcttgcattatttggtctctgccagataataaagtttctataaaatatacttagtcattagaagatttctaagtgaacatgatcaagt

SEQ ID NO: 25955 - DNA, 389 bp, Homo sapiens
  misc_feature 72: r=a or g
  misc_feature 73: k=g or t
  misc_feature 76: n=a, g, c or t
  misc_feature 91: r=a or g
  misc_feature 361: m=a or c
  misc_feature 362: h=a or c or t
  misc_feature 372: n=a, g, c or t
  misc_feature 373: n=a, g, c or t
ttgatagtgatgtattttattattttctttttcttaagaaatgccagtgtgtcctagaacctagataacgarkgcnacttacacttataarataacttgcatctaggctgggcgtggcggctcacgcctgtaatcccagcactttgggaggccgaagtgggtggatcacttgaggccaggagtttgagaccagcctggccaacatggtgaaaccccatctctatcagaaatacaaaaaattagctgggcgtggtggtgggcgcctgtaatcccagttactcgggaggctgaggcaggagaatcacttgaacccgggaggcagaggttgcggtgagccaagagcgcaccattgcactccagmhtgggcgacannaacgaaactccatctc

SEQ ID NO: 25956 - DNA, 363 bp, Homo sapiens
  misc_feature 7: n=a, g, c or t
  misc_feature 8: n=a, g, c or t
  misc_feature 9: h=a or c or t
  misc_feature 336: k=g or t
  misc_feature 350: r=a or g
  misc_feature 351: d=a or g or t
  misc_feature 354: s=g or c
  misc_feature 355: r=a or g
actaacnnhtcagaagcagaagcgccctggtgattctatgccacaccaccattccccaggaaaatgttctccactgagacaaaatccttaaatttttagaatggccttattatggattacagcaaacatctcagcacatctttctcagcaaggatctcaaaacagcattgggatggccttattaatagatcccttacgaaaactcagaaaagttagagaggcactcagaatcttcctaaaatatgaaatgttgaaatctggattctttttttaccatgactgcaaaatgtaagccactacttgggctcaccttgttgaatcagatttcttctccckagccattttgatgrdatsrctcccaga

SEQ ID NO: 25957 - DNA, 235 bp, Homo sapiens
atctcatatttacagagtttagttaattctaattagctttgttggaggtcataaaccacattattaaccttgaaccgactctgtgtttacttgagttcctctgcataatagcatgtcaccaccatcataaacatgttggtattgcattatgcttctagaggagacatccaccaatatttgaaaatctggctggtccgagtgcagtggtgtttacaactaattgatcacaaccaag

SEQ ID NO: 25958 - DNA, 172 bp, Homo sapiens
ctgattctttgtctagtcctttatttactgaacattgtaatacaagtttgttgagtatgtggagtctgttgttctttaaagagtactgaattttcttttgttgtacactaaagtgacctgtggatccctttgctcctttgaaggcttattttcaagctttattcagccaggg

SEQ ID NO: 25959 - DNA, 266 bp, Homo sapiens
  misc_feature 7: h=a or c or t
ctatgthcatatgtacacattatttagcttccacttattagtgagaagtgagaacattcagtctctgactttatgtttctgagttgtttcacttaagataatggcctgcagttccatgcatgttgctgcagaagacatgatttcattctttttttatggctgaatcgtatgccattgtatatatgtactacattttctttatccagtcatccattgacggatatttaggttgattctatatctttcccattgtgatttttcagttt

SEQ ID NO: 25960 - DNA, 134 bp, Homo sapiens
  misc_feature 39: w=a or t
tgttaaccatctcttcataagctaaggcttcctttctgwtttcattttgtttgtgtgctttctagctcactcatgtgactgcactgaaatctaaggatcggaaaggtatgtaccaatatggaaacactgttttc

SEQ ID NO: 25961 - DNA, 322 bp, Homo sapiens
  misc_feature 7: b=c or g or t
ctcttcbcaaaggacctgcccccagccagtcatcctctgcccagcttttctggtcccaagcttgtagccagctcctccagagaggtttcacccagtcacggaaactctgtggcctgaggtttagggaggtctggtagaggtaactccctggaagaggctgctgctgagaactgcctgaaactcccacttcctctgtgactgcaggtttccaaccacaagcaccaaagcagaggggcaggcagcacaccacccagcagccagagcaccagcccagccatggtccttgaggtgagtgaccaccaagtgctaaatgacgccgccg

SEQ ID NO: 25962 - DNA, 108 bp, Homo sapiens
  misc_feature 18: y=c or t
  misc_feature 19: y=c or t
  misc_feature 48: s=g or c
  misc_feature 75: m=a or c
  misc_feature 104: m=a or c
aacattaaacactttatyytggatgaatgtgataagatgcttgaacasctcgacatgcgtcgggatgtccaggamatttttcgcatgaccccccatgagaagcmggtc

SEQ ID NO: 25963 - DNA, 224 bp, Homo sapiens
  misc_feature 7: k=g or t
agagatkgtaaagaaaatttactcttttctgtctatgattttctttcatttgtttaggtttgttccttttgttttctttacattttctgatgtttaaaaaaatacccagtatacctttattaacaataaaaagtaacctttgtcaaaagcacaaagattttccctatcagcacatgtagatcattgtttttaacagctactactattctatgctatggctgctc

SEQ ID NO: 25964 - DNA, 230 bp, Homo sapiens
  misc_feature 8: s=g or c
  misc_feature 9: m=a or c
agtcccgsmcacgcgcctttggaggctgcggtgggatttccttttgccttcggttggggctgctgtttctcttcgccgacggtgacagggctttccctatgttgcccaggttcgtctcaaactcctgggctcaaaagatcctcatcttctcaagtggttgaatatacacgctccagcgaccatgcctggctgaatgaagagctttgagattttgaagaaacaggaacgtc

SEQ ID NO: 25965 - DNA, 271 bp, Homo sapiens
  misc_feature 8: h=a or c or t
  misc_feature 171: k=g or t
aattaathccctatggagatctgaggccaagcacacctctgaagcagtgcatggcttggaatcctgtctgctcttcaccgaaccattccttctgcactcacctcctccagaaagccttccaaaccaggtcttaactccatcatcctaactaccttgtcagcactcactttkgttaacactttgattcagcagtacttgggttccatgagtatttgagcatagttgtgtgtgtgtctcatctctctcaccccaaacccactccaacccaccc

SEQ ID NO: 25966 - DNA, 104 bp, Homo sapiens
  misc_feature 8: y=c or t
  misc_feature 9: y=c or t
agactctyyccacaccactgcatgcaccaggggatttgcatattgtcccacagggaggaccttcccttgtgagtctgagataaaagctcagctgtaactgtgcc

SEQ ID NO: 25967 - DNA, 402 bp, Homo sapiens
  misc_feature 8: n=a, g, c or t
  misc_feature 9: y=c or t
  misc_feature 302: s=g or c
  misc_feature 383: n=a, g, c or t
attatttnytattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgggtagctgggaccacaggcatgcaccaccatgcccagctaatttttgtattttgggagagacgtgatgtcaccattttgcccaggctggtcttgaactcctgagctcaagccatstgcccacctcggccttccaaagtgctgggatttcaggcgtgagcaccacacctggttcagtttcccttattattaacatcnacattagaatggtacattt

SEQ ID NO: 25968 - DNA, 92 bp, Homo sapiens
  misc_feature 6: h=a or c or t
  misc_feature 7: n=a, g, c or t
  misc_feature 8: n=a, g, c or t
  misc_feature 9: v=a or c or g
attgchnnvtgatgtccctgctgtgtggatcctggcaggtcccaacccttctctgaacttcagtttcctcatctcaagaataatgaccacac

SEQ ID NO: 25969 - DNA, 129 bp, Homo sapiens
ttatcatgtactttctttgccccaattctggaatcaactatttccccaagaacccctgtttccttttagtggaggatgatatttaaaaactaagcacttggtgtgctcattgcttctgtgtgctattac

SEQ ID NO: 25970 - DNA, 436 bp, Homo sapiens
  misc_feature 9: n=a, g, c or t
  misc_feature 10: n=a, g, c or t
  misc_feature 255: k=g or t
  misc_feature 256: k=g or t
  misc_feature 388: m=a or c
  misc_feature 413: r=a or g
attttcaanntgttatgagtgtttagatacacatgatcactattaaaaggaagggaggtaatagcctatatatcctaccatgcccctcaaggctctgttaggagactaaaatacaaaggtcatttaaaaagttaaaagcttatgcatgtgatgttggtattgctgctaatgactaggcatctagaggtcaaaacctagagctaaggatattgaaccctgtgttttgtctcgttttaagtctagttttttgtggakkggggaacatacctagccagcttgcttgcagaaggcatgagtgagcaggctgaaggagggacccaaggccagaacgtcctccatattctagctccatgggctctttcacttgatccctgctttatgacccaamttctgttgaaggatttgccagatartgtttggggcaggaacagctgtt

SEQ ID NO: 25971 - DNA, 179 bp, Homo sapiens
ctagacttgatgatactaagttttagcagacactagtaagtggtttgtatttaaccatactgatgaagcagacagattgaggcacagattttagtggctttgtagcaataaatagggcatggtgtgccttaggaaaagaatgtttataaagggaattataactgaaattaaaggaggcg

SEQ ID NO: 25972 - DNA, 177 bp, Homo sapiens
  misc_feature 43: d=a or g or t
  misc_feature 44: h=a or c or t
attattattaatttattttactttaagttccaggatgcaagtdhagaacgtgtaggtttgttacataggtatatgtgtgctatggtggtttgctgtacctatcagcccatcatctaggtttttagccctgcatgcatagctatttgtctgagtgctctccctccccttgccccccgc

SEQ ID NO: 25973 - DNA, 99 bp, Homo sapiens
  misc_feature 7: v=a or c or g
aggttavtcccttgtacccggcgaactcaggaaagttcactcgatttcgctacaaacctgcagcactcggcctggaggtaacctggttgggagcgaatt

SEQ ID NO: 25974 - DNA, 221 bp, Homo sapiens
  misc_feature 7: n=a, g, c or t
  misc_feature 8: h=a or c or t
ttgctanhgagctgttttgagttccttacatattttgggtattaaaccttatcagatatgtgatctgcaaaactggcaaggtctggagagtgtaaccagtgtgctctgtcactcacacagcaaccctgatctccggagaactgagcccatcttggagagccccttgcagaggaccagcagtggcagttcctccagctccagcacccctagctcccagccgc

SEQ ID NO: 25975 - DNA, 107 bp, Homo sapiens
aaaatgttttcgtaagtacacatttcctgtgaactttttgaagacccctcatatatccgattgttgtgctgtgcccttgaaatctcttttactctagagcagtcccc

SEQ ID NO: 25976 - DNA, 147 bp, Homo sapiens
tttgattataataaaaaaacttgagatttgaaaattgctttttgaaaattttttggaaagtatttgttttgtgtgtctatttcctgtaaaaccctttgaagtattttcttaatttttgaactgcaatattgaaaaatctggaggatt

SEQ ID NO: 25977 - DNA, 220 bp, Homo sapiens
ccagttgcctgggttctaatcccacttcttccttggaccagccagaagagcttgggcaacatttcactttgccccctgcctttaccctaagcctcagtttcctcttctgtgagatgggtagattgagaatctagaatctctaccaattctaataattcataagtgtaagatttcaggtttctatctaggaatctgtaagagtcaaacatttgccaccgcg

SEQ ID NO: 25978 - DNA, 247 bp, Homo sapiens
  misc_feature 7: n=a, g, c or t
  misc_feature 8: n=a, g, c or t
  misc_feature 177: r=a or g
atatacnnaagaaaattgaaaacatatggccacacgaaatcttatatacaaatgttcatagcagcattactcataatagccaaaattggaagtatttcaaatgtccttcaactgatgaatggataaacaaaatttagcatatccaaatcatagaatattactcagccataaaaaggratgaagtactgatacatgctacaacacaaatgaccttgacagcattatacgataatgtgaaagaagccac

SEQ ID NO: 25979 - DNA, 304 bp, Homo sapiens
  misc_feature 7: n=a, g, c or t
  misc_feature 8: y=c or t
ctgtttnyaccccaactgggtttgctgcagttcacttctgacactattcaggatgtggagacctcacagtcttccatagtactgtcctcacctcagatgccagctgcaagtcttgggagtcccccggctacctgcaggtcagccagctaacagcaataaattaaggggtttccaaggtctcaggttcaataatttgttagaatgactcatagaaatcaggaaagctctgtatttaaagctacagttttattaggatacatatttgagcaagatctggaactggacagtttccatgccctcaacc

SEQ ID NO: 25980 - DNA, 180 bp, Homo sapiens
  misc_feature 25: s=g or c
tttgctaagagcaccatgcgcgcasagccatctccactccaaagttagacaaaatgccaggaatgttcttctctgctaacccaaaggaattgaaaggaaccactcattcacttctagacgacaaaatgcaaaaaaggaggccaaagacttttggaatggatatgaaagcatacctgagat

SEQ ID NO: 25981 - DNA, 149 bp, Homo sapiens
caacaaacaaacaaacaaacaaacaaaccccaaacaaacaggaccaaaactaaaaagcaaatctaaatcaacaaaatcccgaagttaggtctttcccccatccatgtcagcagtctctgtgttgtccaccagatgtcagtagcaccggc

SEQ ID NO: 25982 - DNA, 273 bp, Homo sapiens
actaggatgcctagtgacttattcttgaatgttgctctttatcacaatcctgttttttctcctttgatagccttcatattgcttaccattttaatctaattgactgtccttgggaaaagatgagagtatgctaagactttgatcttgctttcagaaagggatcatttatctttgcattccccagatacccagtgtactctgtccctggcagattaagcttgataaatggcaaataaagtcgggaggcattttgaatgtaattagccatagccc

SEQ ID NO: 25983 - DNA, 340 bp, Homo sapiens
  misc_feature 7: n=a, g, c or t
  misc_feature 8: y=c or t
caatggnygcagaccattttgctcctaagaccaccctccctccaccccttggcagtggctacaccatcttaaagcctcccaaagtactgggattaacaggtatgaggcaccgcgcccggctcagatggtgactttcattcattgcattcaatcatgcagcccaccaaccctttgttatctgcctgcaaggtttattccggtcagtttgagtagtaagttgctataaccatattatgtgttaatagagttgttcatgattgtgaagattaaacaaggtactggagtcctactttatgtaagggatgggctccaagatcagaggatgagttaaacgctgtaa

SEQ ID NO: 25984 - DNA, 279 bp, Homo sapiens
  misc_feature 7: v=a or c or g
  misc_feature 29: r=a or g
  misc_feature 57: m=a or c
  misc_feature 70: r=a or g
  misc_feature 101: k=g or t
  misc_feature 111: r=a or g
  misc_feature 116: m=a or c
  misc_feature 117: m=a or c
  misc_feature 119: r=a or g
  misc_feature 124: m=a or c
  misc_feature 126: m=a or c
  misc_feature 129: m=a or c
  misc_feature 131: r=a or g
  misc_feature 184: m=a or c
  misc_feature 240: r=a or g
tatttavcaggaaaactttctaaagcagraccaggagaaagattgcactcctcccamattgtccaaccarcagaatcaccaaatcaccaagcaggagtgakgagagcagargtcammtrgtggmcmatmargcagtctatccgaggcagaactccttatctgaggaatttagaagtatttagamttccctgttatctaaagctggcctgtggttccaggcttctttccccaaaatgtatragtaactagagtttttgtatatctccagaatgcatgcct

SEQ ID NO: 25985 - DNA, 157 bp, Homo sapiens
  misc_feature 55: k=g or t
  misc_feature 103: d=a or g or t
  misc_feature 107: m=a or c
  misc_feature 108: w=a or t
tggattagcgtcaacccaaatattatcgactcattttagaaaaggaaaatgtgtkattccaaattcttggagatttattaatggggaaatcggatgtcttgtdtctmwgtggtttgatttgaggaaagaggtcaagcgaacattttaactacatcaa

SEQ ID NO: 25986 - DNA, 163 bp, Homo sapiens
gattattttctgttatcttctaagacgtttatagttttgcattttacatttaagtctgtggttcactttgagttaatttcacttattttttgtgggaggtgaaaggtcagtgtctagattcactttttgcatatccagctgaatatccagctattccagcagc

SEQ ID NO: 25987 - DNA, 319 bp, Homo sapiens
  misc_feature 43: s=g or c
  misc_feature 275: m=a or c
catcccagaatgcatatcgatcagctctcagccaggcttcgasaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaamctagaacccaggcctcaagtctttaccccacccctttcttgttc

SEQ ID NO: 25988 - DNA, 241 bp, Homo sapiens
ttgacagtatgaatctgcttcaatttactctgcctgtctcctccagttgccactagtttttcttactgaagtttaacagctctttatataataaggaactcagccctttgccacttgaattgcaaatatatgtttctagtttggcatttgtattttgactttgtttatggtattttttcttcttttcagtgaaaagacattaaaatggagccacaccataattactattttatagccaccg

SEQ ID NO: 25989 - DNA, 201 bp, Homo sapiens
tcttctccatttcattcttgcatgtccagattctttgtgttttgttttgtttttaagacagggtctcactctatcgcctaggctggagtgcagtggcgtaatcacggttcactgcagccttgacctccctagttcaaatgatcctcccacctcaccctcccgagtggctgggattacagacatgcaccaccacgccctttt

SEQ ID NO: 25990 - DNA, 153 bp, Homo sapiens
ctttgaatttaatattagtgccactatatattatacatattcattcaacaaattgaacaacagccacatagtgctaaatcctaggaacacaaataaagaactctgttctgtgttcaagctacttccagactaaattactcttttgagcattct

SEQ ID NO: 25991 - DNA, 178 bp, Homo sapiens
attgaaggaagagaggtagaaagattctgtcgtctataaggaacttaaattaacgagcaagaaacaatccagttgaaaagagggcaaaggacatgaacagacacttttcaaaagaagatacatacgtggccaacaagcatatgaaaaaattctcataatcactaatcactagagagat

SEQ ID NO: 25992 - DNA, 441 bp, Homo sapiens
  misc_feature 47: s=g or c
catttaacaacagagaaaaatcaatgtttaacaagtaacttgcatasgataacttgctagtcagtggaaaaccagaatttaagcttcattctatcttattcatttattacttcctatttattataacttattattccttatcacatttttattatttataacccaaaaaatgtgtcaaacttgtttctaatctccaagcgaggagtttgtttttttcttttttctttcaaaagtcaactgtagcgataaaattttggtcagttgtgggtttttattagttagatttctgcaatggagattttattgttggtttaaaaatgcttgcaagtatattcatgtatatgtttcttgctgtttttctcaagcttgaagcatagatagatagatagatagatagatagatagatggatagatagaggtgtttcccaaagtggttcctc

SEQ ID NO: 25993 - DNA, 221 bp, Homo sapiens
  misc_feature 54: s=g or c
  misc_feature 83: k=g or t
  misc_feature 173: k=g or t
ttatttgtgattcatgctcccatcttctgccagaatggagctgaagaggctcasagggagcaaacatcaggcaggccagggakcgagaaagcccagaggagtgcttgcaaagaaaggtgcttcttctggagaagagaagcccagcaagtgaatgaatttcccccaaacagcakggaggtaccctccttcacctgacgctgcttcaactctgccccatccct

SEQ ID NO: 25994 - DNA, 237 bp, Homo sapiens
aattttttgtattcttttagtacagacagggtttcaccatgttagccaggatggtctcgatctcctgacctcgtgatccacctgcctcagcctcccaaagtgctgggattacaggcgtgagccatcgggcctggcccagccttttcaactcatgagaaatgaagagctgggaggggctgtcccatgtcaaaggaactaaggcaccaccaagcaccaccacacgcatcacggggacat

SEQ ID NO: 25995 - DNA, 405 bp, Homo sapiens
  misc_feature 15: s=g or c
  misc_feature 16: s=g or c
  misc_feature 309: b=c or g or t
aacgcgcgggctcgssttcggtttccccagacctgctcgcagcaccctgctgtcttcccggtccggcccgctgcccgcggcgccagcaccatgctcttctattcttttttcaagtcccttgtgggcaaggatgtggtcgtggaactaaagaatgacctgagcatctgtggaaccctccattctgtggatcagtatctcaacatcaaactaactgacatcagtgtcacagaccctgagaaataccctcacgttatcagtgaagaactgcttcattcggggctcagtggtccgatacgtgcagctgccagbagatgaggtcgacacacagttgctacaggatgcggcaaggaaggaagccctgcagcagaaacagtgatggctcctcctcctcttcccctccctctc

SEQ ID NO: 25996 - DNA, 461 bp, Homo sapiens
  misc_feature 346: s=g or c
gagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattccgggaaggctgatgggcatccctcttcccagccacagaaccagagggagtccccaggtagatggttccaagaagggagttgaatcttgggttccgsctcttgcctgtgacccacggggaccccagtttatgcctcactgttccttggtctgtcaagagagcctgaaatagcattaggttctcctgtccttctcagtccttgacaattaatt

SEQ ID NO: 25997 - DNA, 364 bp, Homo sapiens
  misc_feature 341: m=a or c
acaccctcaatgctcctcatgggccagcatttgttcagcagatgaattatgagtgccgactctgtgcctggcagtgggatcagcacctgggacattgagaccaatccaggtcactggtgcagtcacgacagtaggtgtggcagcaggcctgctggctgccgcaagccttgtggggatcctgctggccagaagcaagcgggaaaggcaataaatccaagaaattgtcccaacaaccaccaattcttacggaggaatattatttagccagcaggagtggagtttggtttactgattttactgttttgtgttcatgaatctttattttaatggagttaaaagcmcaggaaaatgtatttggaaatgc

SEQ ID NO: 25998 - DNA, 156 bp, Homo sapiens
caaggacatgcaaattaaagtaaccatcagatactacatttcacccatcccattgaaaattattgaaaattattttttaagtgataatacctagtgtttgaaggggtgtatgcacaggataatacctagtgttcgaaggggtgaacacacctggac

SEQ ID NO: 25999 - DNA, 343 bp, Homo sapiens
  misc_feature 319: w=a or t
catattgggtgattagttgtgtctgggatcgttgtcctttgcttgtgtgattggccatccaccgtgtgtcacccttgtgagtggcgatggtcatggctgggtgtgtgcccatccggctcctgatggctgtttccaatcttggagtgtgtgtcaccttgtcagggcccgtctggcgtcaagtacaagagtaggagtaggctgggtgtggtggctcacacctgtaatcccagcgctttgggaggccgaggtgggagaatcacttgagcccaggagttcaagagcagcctgggcaatgtagcaaggtcttttaactacaggwaacacaaaaattagctgggctaca

SEQ ID NO: 26000 - DNA, 173 bp, Homo sapiens
agttccgcttccggcagcgcgagataaatcacgagaggaagcttaaatctgtcgtttgaatttaggaccacctcggtgagtggtcgttctggtgtgctgtgtcatacctactgttttttaaagtgaggcgtaacccgacagtaatttcaaaaccattcgcctcgaccggcctt

SEQ ID NO: 26001 - DNA, 233 bp, Homo sapiens
aatcttgctgtgtttgagtagtcttcagttctgtgagacataggtcatacgtggcgagttcagctttgaagcttgtcttctgaaactggtaacctggatggctttgtagctttgctgttgttgaatgaatttgttgtagattttgtcttaaaaagggggacaattagtaacacaagacttaacaaaaaggcatgtccttatatgtacatccagctgtttccaagatggaaccc

SEQ ID NO: 26002 - DNA, 406 bp, Homo sapiens
  misc_feature 226: r=a or g
  misc_feature 289: r=a or g
  misc_feature 319: r=a or g
aacgcagtaaaaggtctttgactcctgaggcagattctaaattacgacttataaaaaaatgcattcaacagtctcaggttaccagagtaaatccacatttaccttttgaagtactaatttttcccactgaacattcaccaacaggactcattattcagggacataatttaattgaattgtgttttctcccacacagctctttacgtacactaactatctagatcaratttctaccttaattggtcaggctcgttctcgtctccttcgtctttcaggaacagagcctcaraaaaatcgttgttccccttacccgattacragttcaacaggctttgctacttgcattgcttggcaagtgcatttggcacgtttcccaggtataattgataatcactatcctcatgta

SEQ ID NO: 26003 - DNA, 364 bp, Homo sapiens
  misc_feature 363: n=a, g, c or t
aagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacagtgtacagtattttctccaaggtacactccgatcggaatgtatacccatcagcaggtgtcctctttgttcatgttttggaaagagaatattttaagggggaatttccaccttacccaaaacctggcgagattggtaatgatcccataacatttaatacaaatttaatgggttacccagaccgaccang

SEQ ID NO: 26004 - DNA, 399 bp, Homo sapiens
  misc_feature 44: k=g or t
gaatgtgactttaattggattagtatctgctggttttgtttgtkgcctttttctttgtttctatttttgtctctgacttgtttccactttttgtggtttaactgagcattatgtaagattgcattttcactcctgtcttactgtcacttactcttttttttcccccacccaaagcagagtttcactcttgttgcctaggctggagtacaatggagtgatctctgctcactgcagcctccgcctcccgggttcaggcaattctcttgccttagcatcctgaatagctaagattacaggcatgcgccaccacgccctgctaatttttgcatttttagtagagacggggtttcatcatggtttcaaactcctcagctcaggtgatccactcaccctgtctct

SEQ ID NO: 26005 - DNA, 128 bp, Homo sapiens
  misc_feature 7: s=g or c
gaggcgsgctcccaatccggttccatccggttctcccaccgcccccgctgtgggtctcagcagctcgggcggcgggaggagtggcagcggcaaggcagcccagtttcgcgaaggctgtcggcgcgccg

SEQ ID NO: 26006 - DNA, 203 bp, Homo sapiens
tgttgcaaataacattcaaaaagcacccagagacggggaggctgaggccgacttccccaaggctctggttggccgtggtgggagttgcaattgcccttcttttcagtaacttcctgtggcatgagttgattttgcttttcaagcatgaaaaacttcttttcagctcttcccattggaaaacaattactaacatttgcctccat

SEQ ID NO: 26007 - DNA, 157 bp, Homo sapiens
gcgtgcttgagaaggttcaatggcgtggcagggactagcggccgagttcctgcaggtgccggcggtgacgcgggcttacaccgcagcctgtgtcctcaccaccgccgcggtgcagctggagctcctcagcccctttcaactctacttcaacccgctc

SEQ ID NO: 26008 - DNA, 473 bp, Homo sapiens
  misc_feature 321: w=a or t
  misc_feature 368: s=g or c
  misc_feature 372: s=g or c
  misc_feature 378: n=a, g, c or t
tgaatcctgttaaatagttttagaacataatctgctaaaagttctgaagctcctttccaatacctgcttctcctgttcagttacttaagatagaatataggcatttaggcattgcacggagtcctttggggaaggtgaggtgctggcagaatttaattatagacagatgcattagtttcctgttcctgctgtaaaaagaaaaaaaaaagccacaaacttagtggtttaaataaacagaaatttatcatcgtaaagttctggaggtcagagtgagttgaggcgagcctgcaggactgtgttccctctgcaggctgtaggggwggacgtgtttccttgccttctccactggtaaaggccacccacatttstcastggggnccccttcgtctgtcttgaaagcacatcattccagcctctacttctatggtctcatctcctccttctgactttgatgctttctttactgataatga

SEQ ID NO: 26009 - DNA, 204 bp, Homo sapiens
gcaacgtgtataacctccactcacccttcctctctcctgctcatcaaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccacactg

SEQ ID NO: 26010 - DNA, 219 bp, Homo sapiens
  misc_feature 128: w=a or t
  misc_feature 138: k=g or t
attgggttcttggttttcttgctattgaattgttggagttccatatattttgaatattagctcattatttcatatgtgatttgcaaatattttatcccagtttgtgggttgttgctttactcaattgwttcctttgckgtgtagttaactttttagtttgatgcaatcccattttaaattaaaatttttgttttagttgtctgcgcttttggaggccat

SEQ ID NO: 26011 - DNA, 202 bp, Homo sapiens
  misc_feature 3: w=a or t
  misc_feature 4: n=a, g, c or t
  misc_feature 5: m=a or c
  misc_feature 117: m=a or c
  misc_feature 121: m=a or c
gawnmaggagaaaaaccgccctgtggcgggaggcgagacatgttggcagcaatgctgctttattattctttattccactgagatgtttgggtggagagaagcaaaaatctggcctamgtgmacgtccaggcatagtacctccccttgaacttatttgtgacacagattcctttgctcacatgttttcttgctgaccttcccc

SEQ ID NO: 26012 - DNA, 115 bp, Homo sapiens
aagcggtcttactgtaccgccgtgtgcattccctcatacggtcaggagttatgactcattttgaagatgtaattcttgtctctctgatcccctcgcgggtgcaacacaccaaaca

SEQ ID NO: 26013 - DNA, 170 bp, Homo sapiens
  misc_feature 8: y=c or t
tcatttayaatcagaatggactcatggattcctactttacttgaatgattataatccatgatatcatgtatttttatgctcaaattactgcagacttggcctttgaaaggaaccccttcaaactgcagccttgatgtcctgggctccagcaatccccttgtcacagccca

SEQ ID NO: 26014 - DNA, 140 bp, Homo sapiens
  misc_feature 12: m=a or c
  misc_feature 13: m=a or c
  misc_feature 125: s=g or c
  misc_feature 126: m=a or c
ccatggtggtammagaatttgcagctaccctttgggaagtccacggggcatgtggtgttcttgctggaataacaggattcagggagagccaaaaggccataaggttgaagctatgcaaagggtasmattagaattccaga

SEQ ID NO: 26015 - DNA, 197 bp, Homo sapiens
  misc_feature 7: y=c or t
  misc_feature 43: k=g or t
  misc_feature 107: y=c or t
catagaytgctgatttaaactgtaattgtattgccgtactgtkggctggaaatcccaaatctagatccagcagagttggttctttctgaggtctgcaaggaagggcytgttccatgcctctctccttggcttgtagaaggcatcttgtccctatgactcttcacattgtctttatgtacatctctgtgcccaacgaa

SEQ ID NO: 26016 - DNA, 108 bp, Homo sapiens
tgcctgtggtcccagctgctcaggaggctgaggcaggaggattgcttgaacccgggaggcggaggttgcagtgggccgagattgtgccactgcactccagcctggcga

SEQ ID NO: 26017 - DNA, 153 bp, Homo sapiens
  misc_feature 7: s=g or c
tgcaatscgaatgatagagatggattgacagatatgactcttttacattatacctgcaaatctggagctcatggtattggtgatgtggaaacagctgtaaaatttgcaactcagcttattgacctgggagcagacattagtttgcggaggcgc

SEQ ID NO: 26018 - DNA, 166 bp, Homo sapiens
  misc_feature 48: m=a or c
accagggagatcctcttttatgacattgggcctttatggaatcaggcmacggacagccaagacgtagatccatccaagacttgactgtaactggaacagaacctggtcaggtgagcagtaggtcatccagtcccagtgtcagaatgattactacctcaggaccgtg

SEQ ID NO: 26019 - DNA, 158 bp, Homo sapiens
  misc_feature 7: r=a or g
  misc_feature 96: r=a or g
gattcartagactctgaggttttccaagtacattaaggacttaaatacagaatgtcttaaaattttagggctattgatcaagagaaagcttctcgrggaataaagttctgttaggttttagccctattctgctttcaaaattcttaactggatgccgg

SEQ ID NO: 26020 - DNA, 225 bp, Homo sapiens
  misc_feature 7: m=a or c
  misc_feature 8: s=g or c
  misc_feature 109: s=g or c
  misc_feature 174: k=g or t
  misc_feature 175: k=g or t
aattgamsgttgaagatgtttgccaaaggcagtaaatggtattatcctgagttataaatgcagggagccatgggagttgggaggtgatgtcttgtgaaatcatgcggastactgcataatgttcaggccatgagtgttatttatagattgttggtttcgaaagtatctttagckktgaaatacagcccattatagctgatgggaagatagcatgtgaaggattgg

SEQ ID NO: 26021 - DNA, 293 bp, Homo sapiens
  misc_feature 6: y=c or t
  misc_feature 8: h=a or c or t
  misc_feature 9: m=a or c
  misc_feature 49: y=c or t
  misc_feature 130: v=a or c or g
attcayghmgaattatgaagtttggaatgtgacttttattttaagattytgagggaactcctaaaggcatttcacttttgacctttatctgaaacttgtggctgactattgctgggtaataggcaccaavtgtgcatttttgttgtgtctgaaaatctggatgtgctgttcggcacagatggagcaaacacgcagcaaactaaggaccgtcagtggcttcccattggctcattgaacaagttaacaccactgcagtattttagttattttaaaaactaactttaaagaacccc

SEQ ID NO: 26022 - DNA, 219 bp, Homo sapiens
  misc_feature 20: s=g or c
  misc_feature 24: r=a or g
  misc_feature 56: r=a or g
  misc_feature 145: r=a or g
  misc_feature 146: r=a or g
  misc_feature 147: r=a or g
caatccaaataacattctastgartctcccctgattgcttactttaaactcaaagraaatataatcaagggaggacaaagcacaagtataatgaaagcaggaagaaaatttccttttatgctcttgcagttaattatatagcaarrracagctttctcccacctgctctccacctcagcttcttaactaggcaaactcctacttgtcctccaagaaccc

SEQ ID NO: 26023 - DNA, 254 bp, Homo sapiens
  misc_feature 7: m=a or c
gagagcmcgaagtgttacatatggcagaaaataaatgtctctgattactttgctacctttaaaaaaatctatatgtgtttgcaaaacagcctagggggatctaccacctacacagcatgaattattcataagtcataggtgcacatgtatgagcaagttatttttgagaaagaaactgcctataatataataaacctgtcaggtctttgggtattgtttaatttgtgtgttgttgctgttttatctggaccaga

SEQ ID NO: 26024 - DNA, 273 bp, Homo sapiens
tagagtaactactatatatttaattgtttgaatataccatagtttgtccattcttctatgcaagaacatttaatttgcttttaggtttttgctgttacacacaaagctacaataagcacatcttcttcttgcacacctcccacccctagttgccatttttctatacagcaaaaatactcttggaaaattataaatggtgtcacaaagacactgagttaaccacggctagcgagggtttagacacctctgtgatcagagctcatgacccgggct

SEQ ID NO: 26025 - DNA, 186 bp, Homo sapiens
ataatatttggaagtatttcattactaacaatctcagtacaacatgaaaattgttgcttctcatctaaaatacaattttgtctatcagaataaacacaagtgaaattttcacctacattaacattatgtctttgcagctttaggtttgttagatgtgttcttaagcataatttttagccacaaacc

SEQ ID NO: 26026 - DNA, 109 bp, Homo sapiens
taccgcaaattaaatctgtctaaatcaaaactcattctctttctttccaaactgctctttgctctagagatagatccctgtatcagttaatattattatcctctcacac

SEQ ID NO: 26027 - DNA, 237 bp, Homo sapiens
  misc_feature 119: r=a or g
  misc_feature 139: r=a or g
  misc_feature 146: m=a or c
aattttttgtattcttttagtacagacagggtttcaccatgttagccaggatggtctcgatctcctgacctcgtgatccacctgcctcagcctcccaaagtgctgggattacaggcgtragccatcgggcctggcccarccttttmaactcatgagaaatgaagagctgggaggggctgtcccatgtcaaaggaactaaggcaccaccaagcaccaccacacgcatcacggggacat

SEQ ID NO: 26028 - DNA, 229 bp, Homo sapiens
  misc_feature 19: r=a or g
  misc_feature 20: r=a or g
  misc_feature 156: w=a or t
  misc_feature 206: k=g or t
accaaatgatgtatgttarrtagttaataatttttgatgtttgcaatccccaaattggttagattgtccgtcattgcaaacgagtatataccactaattgtatgcagtcacattcccctcttcgttctgctccttcttattggtatttttagagawaaatacaaataacctaatctgctaaatactgtaactccattctcactgtkacattttgtaaatcactccaact

SEQ ID NO: 26029 - DNA, 201 bp, Homo sapiens
  misc_feature 67: r=a or g
  misc_feature 100: k=g or t
  misc_feature 101: r=a or g
aacagtgattttttcttttgtaggaacctccatatttaagaattcccagtagctactttttacccartatggcaggcattacattcatgccttaggatakrttatagtgattgagtttctgtttctaaacatttttgatggaaagaatgagtataagaggcagttcctttttgcagctccacgccaggggaccagggtaat

SEQ ID NO: 26030 - DNA, 152 bp, Homo sapiens
  misc_feature 20: r=a or g
  misc_feature 114: w=a or t
  misc_feature 125: s=g or c
actagtggctctgttgcatraacaccttcctggccacccatatgtccgcagaagcgcaagaagtttcctgataggcttgctgaagatgaaggggacagtgagccagaggccgtwggacagtccasgggacgaagacagaagaagtagagaca

SEQ ID NO: 26031 - DNA, 196 bp, Homo sapiens
  misc_feature 85: m=a or c
aaaaagaatatttctatagtttgtaaaaagttttcatgtatatcatttaatagttagaagaactttacaagtttcaagtttcaamtgagaaaattgatattcagagaggttccaaggaccagaaccatcattaacttgtaaaaggcagagtcctaagcccagtatttgcttctacttcactgtttgtggtgtgcag

SEQ ID NO: 26032 - DNA, 56 bp, Homo sapiens
gtgtgttgtttaatttctacatatttgtgaatgtcccaaattttcttttttttttt

SEQ ID NO: 26033 - DNA, 153 bp, Homo sapiens
  misc_feature 7: n=a, g, c or t
aaagganctcccgtctgtaaaatgcccgacacgtggggctttcgtcagtagattccccttccccacgagccagagtcctccagccagctggcagggagcgctcctatcttaaacactttttttttgaggtctgtttgtaaaccactgcgtacg

SEQ ID NO: 26034 - DNA, 141 bp, Homo sapiens
  misc_feature 123: m=a or c
  misc_feature 128: w=a or t
aagagcagtttcagtaaaatcaaaaagccagattttagtaggctgaatgaatgtgtggtaagaaagtgaagacagcataaaccgctgtttgactgtgaagatgggagaaatttggtggttacmaaaawaagccactagttc

SEQ ID NO: 26035 - DNA, 224 bp, Homo sapiens
ccttgttcccctggtaaaagattttaaacagcctagccttaatcagtaagtaatcagctattgttgcctcatctattgtatagctttctcatagtgagaatttccgcttaatttttagctggtgcttgaagtagtcatactgagcttcttaatatatatcccttttaacttaaaggttgtcacactatgtatgttttttttctattttcacacttaccgacctc

SEQ ID NO: 26036 - DNA, 304 bp, Homo sapiens
  misc_feature 6: m=a or c
aatgcmgtacttgtgctaaaatggcgtaatttaatggcttttgacctaggcacactggtatttcttactggtcttttttcaaagcttttaaaagtcttttttccagagcataagtgaaagatgcttctgttctatatggtatacacatgatggttaacacctttgctttttttcctagtttcattgagaagcagattcagatttaatttattcagaatttagatcgggatgtatgtttattcattttcttttttagattatcccttagatttttttaaattgcttttttctgtttgtgggtgca

SEQ ID NO: 26037 - DNA, 226 bp, Homo sapiens
  misc_feature 7: y=c or t
  misc_feature 8: s=g or c
  misc_feature 106: r=a or g
  misc_feature 195: m=a or c
taaaacysctttctagttactgtacgtctcaaagcaagctagggcctggcccagtagagaggctctggtgcctgcttctgcccaggggctccaggggtgtgtgcarcgctggcatcataggaagtccctcggcaactggcatgtgtacccagcgggctccctgtgagtgtgcaccctgttacctcgtgagctcamtggggctcacatggcttgttaccatcccgct

SEQ ID NO: 26038 - DNA, 126 bp, Homo sapiens
  misc_feature 70: m=a or c
  misc_feature 71: w=a or t
  misc_feature 78: m=a or c
  misc_feature 79: w=a or t
gtacctccgagaggctcggcgttgagcccgggtagggccaggtggctgccctttcacctagggtagtccmwggtcgcmwccgctcttcgcccaaaaggggatgcagctccgggaaacaagtgaatt

SEQ ID NO: 26039 - DNA, 153 bp, Homo sapiens
ctctttcgaacaaagacattggtttgcccaaggactacaaataaaccaacgggaaaaaagaaaggttccagttttgtctgaaaattctgattaagcctctgggccctacagcctggagaacctggagaatcctacacccacagaacccggcag

SEQ ID NO: 26040 - DNA, 156 bp, Homo sapiens
  misc_feature 3: k=g or t
  misc_feature 4: k=g or t
  misc_feature 26: y=c or t
  misc_feature 33: k=g or t
  misc_feature 34: k=g or t
  misc_feature 59: k=g or t
tgkktgactgtttaatttgaaagttyacatttkktatgctttgtgttggtgtgtaattkttgtactcttggtggctagtttttgtcaaatcttttttggaatattgcttaaatgttttgattttatgatagtgaagcttgtattcagtgttttgcc

SEQ ID NO: 26041 - DNA, 118 bp, Homo sapiens
  misc_feature 8: r=a or g
  misc_feature 25: m=a or c
  misc_feature 53: w=a or t
  misc_feature 56: w=a or t
  misc_feature 62: v=a or c or g
  misc_feature 76: k=g or t
tgattatrtagaagagttggctttmaaatgtttgcaaatgtcttttttttttwaawactggvagaaaaaatattckgttgtgtctcatacagtgcttaggatgtctttcacagagcgc

SEQ ID NO: 26042 - DNA, 166 bp, Homo sapiens
  misc_feature 50: s=g or c
  misc_feature 51: m=a or c
  misc_feature 150: s=g or c
ttgtttgagacagagacttgctccttcacgtaggctggagcgcaatggcsmcatctcggctcactgcaacctccgcctcccaggttttcaagtgattcttgggcctcagcctaccgactagctgggactaaaggtgcgctccgacactcscggctaatttccggcc

SEQ ID NO: 26043 - DNA, 388 bp, Homo sapiens
ttggactgcgggggcgctgggggactagaaggcccacattccatggaaatccagggattccaggaattccagcatccagcggaaattcagagaaccatggcccctgagtaattcctctgaaggaaacgtagtcaagaaagactaattaatttatacctactccttcagctccagcccggcacttaattagtaccttagtggtttcaacgaatgaatatgggaaagagtgagagaaggagtgaagcagaagttagccctccaaagctatgcttctcgtccccaaactatcaccccctccacgctggggaggagcatgtggctgtcccagcacctgcggactcttctggcattttgtaggtgagggctaaggatgctatagatcctgcac

SEQ ID NO: 26044 - DNA, 165 bp, Homo sapiens
cccaaaagaatctggttaaattactgacccaaaactacataaaataattagtaagaaagccaagtctaaaacccacgtgtccagacttttatagcacactactctctaattctgattttaaaaataatgttatttcggtatatggtgtgaatttgtccaggtagc

SEQ ID NO: 26045 - DNA, 147 bp, Homo sapiens
  misc_feature 99: k=g or t
  misc_feature 118: s=g or c
  misc_feature 136: k=g or t
agctttctgcagtcctgacctggccaagggtaaaactagatcggctgcgggctgtgttccctgggcttcctgctgcttcactcctgggaggcagcacakagtggttgttacggggaasgttttcctaagtgctgtkaatccaccctt

SEQ ID NO: 26046 - DNA, 364 bp, Homo sapiens
  misc_feature 172: k=g or t
  misc_feature 178: r=a or g
  misc_feature 179: k=g or t
  misc_feature 181: r=a or g
  misc_feature 182: s=g or c
attatatattgtcctattctctaatgacttcccaccttttctgagcatctgataattttttgttgataaattgttttatgtatcttgtttccccagcttgttccttgtgagcaagaatgatttccatgtcatattttgaaattcacaaatcactgtatagtccagggtcctkagtaarkgrstaaaatgcgattagtactggaaccagaaaaactgcaaatttcctaatcgtcagagggaactgaatgtagtggagatgtgggctgtctctcagctcttgtggcttcctgttacatggataaatggtttgtgatgatgcattgataaaatatttttttgagaggatgggggtaaggatctatta

SEQ ID NO: 26047 - DNA, 377 bp, Homo sapiens
  misc_feature 295: r=a or g
  misc_feature 319: r=a or g
tagtaaattttcattgcaggtttatttgttcatatttctggatatataatccattactgttaaacttcatatcaatgttccgatatttcttcatcttatgttttatgttacaaaacaggttatttcactatatgtatgtttaattgattaattcttccctttttttggaaatgaaacagcactctcaattattgggacagaaaagttatttcatagggaatacttcaaacactgatatctacaacaggcagtaagattcgtcacaacaattggtatactgtcaatataccatacraagttccatctggtcttgattaaraattattttagttttctcaggaaaatgatacagagggagaattgcctagattatatga

SEQ ID NO: 26048 - DNA, 360 bp, Homo sapiens
  misc_feature 74: w=a or t
  misc_feature 78: w=a or t
  misc_feature 145: m=a or c
  misc_feature 146: s=g or c
  misc_feature 148: m=a or c
  misc_feature 149: s=g or c
  misc_feature 175: k=g or t
acacaacagcttgaatatacttaacactactaaactgtacacttgaaaacagtttagatggtaaattttatgtwatgwgttactgcaccagaataaaaagaaagaagggatctgttgttatgggtgtcatgtatttgggtggatmsgmsgtgaaatctgtacacaagtagagggkgttgggtgggggtgggaagaagagaggtcatctcttatcatggggaggaaggtagaggaatgggaacaagtgcagggcagctgtaggtttggaggtggaaactggcagtttgtggtggaagtgtgaggaccttctcttctggtggcttgtttcctcagttgaacacaagattatgggctgagaga

SEQ ID NO: 26049 - DNA, 442 bp, Homo sapiens
  misc_feature 402: n=a, g, c or t
ggcctcaactccattaataggatgtcaggacacttccttctcagtttgtgggttttaaattagtaggtcatcatttgtgtctcagaagtgtagcagttataaaggcggcggaagaaaggaaactgagaaataggaagtacttattagtgatacagatcttggttggtacaggacacactgcatttagtctcaaatatgctgtaggttaggaaaatgaaaatacggcctgaaatgtgcatttggggttggatgatttctgtcatgtcagaatgtgaccttgtttttctcactcatttgatttatcaaatagtttatggccattgccctggttcctgctgataccaggctaaccaattgccaatatgctgactcgcccgacagtgatggtgactctgtctccgncagatgcagacaaggaagacggagactgggtcatctggac

SEQ ID NO: 26050 - DNA, 440 bp, Homo sapiens
  misc_feature 345: y=c or t
  misc_feature 409: k=g or t
ctgccgtcttgaaattgttaatatttttactaagaagctccttatttttattttgcactgggccctacaaattaagtagctcaccctgcttgtagttgatgactagaggacatgattgataagtcacatttcatgtctaattcaccctctgtattaattatggaagctagacccagggtaaggacccttggttgtaaacttccccagttcagagcattttctcctatgtgctcaaagacgcattcactgcctacctgctgcctctctgttctcttttggatttgtcttctttgtcttctccttattattccttcaattatctaaactcaggtattgatgtatgtytgttcatggaatccaaattttggcatgcaatggctgttctttccagagggatctttcttagggkacgttctgtcttttcagtctttcttcctatt

SEQ ID NO: 26051 - DNA, 140 bp, Homo sapiens
cttaaggaacaccttgcaagcaaggaagtggaagtagcaaagctggagaaacaactcttagaagagaaagctgctatgactgatgcaatggtacctcggtcttcctatgaaaaactccagtcatccttagagagtgctca

SEQ ID NO: 26052 - DNA, 375 bp, Homo sapiens
  misc_feature 187: r=a or g
  misc_feature 240: r=a or g
  misc_feature 251: d=a or g or t
  misc_feature 323: w=a or t
  misc_feature 325: m=a or c
  misc_feature 338: v=a or c or g
tagaacaatggaacagaatagagaacccaggaataaagctgcatacctacagccatctaatctttgacaaagtcaacaaacataagcaatggggaaaggactatctattcaataaatagtgttaagatcactggtgagccatatgcagaagaatgaagctagaaccctacattttaccatatatgaractgaactcaaggtggatcaaatatttaaatgtaagacctcaaactgtaagartcctagaagadaacctatggaacaccgttctggacattggccttgggaaaggatttataagtcctaaaagcaattgcagcacwamacaaaaattgacvagtgggatccggctagactaaagagcttctgcacagc

SEQ ID NO: 26053 - DNA, 202 bp, Homo sapiens
  misc_feature 13: w=a or t
cccctcacatgtwtgcatgccacaagtaatggtggtctgctcaaccttcattcctaactctgcacttcatctgcaggttggccatactcaagaacctgaaggtgctcaggatctgcttcatgatctccgtggctatccctttcactttccggtgaagtaaaggctttctcattactagaaaccatccaagttaactagcgcc

SEQ ID NO: 26054 - DNA, 156 bp, Homo sapiens
  misc_feature 12: s=g or c
  misc_feature 20: s=g or c
  misc_feature 26: k=g or t
  misc_feature 116: s=g or c
cttcagaaacascattgtasggagakgatccgacgacatcatctaggtcactatgctcaggtcactgaactctgactctttctttccttgcctgtaaaattaggtttagtgcgtasaattttttgtgagaataaaataagttaattatgtgaatac

SEQ ID NO: 26055 - DNA, 263 bp, Homo sapiens
tttatattattttgcctcaactgttaaatcatatgtgtttatttctacatcttctcttttatagctttatttagttttatagatttaaccactttttttttatactttatgttctgggatacatgtacagaacgtgcaggtttgttacacaggtatacatgtgccatggtgatttgttgcactcatcaacccgtcatctaggttttaagccctgcatgcactaggtattggtcctaatgctctccctccccttgcccccggcc

SEQ ID NO: 26056 - DNA, 137 bp, Homo sapiens
cttgccagcagttcttcttagccagtgtgtaatgtttggcagtcagttgagtacaaagcatatgcttatggttaatttaatttgcatttctctaattataaatgcaatttcatatattcatatacttagccagttga

SEQ ID NO: 26057 - DNA, 346 bp, Homo sapiens
  misc_feature 323: k=g or t
  misc_feature 327: b=c or g or t
  misc_feature 332: k=g or t
ttgctcataacaccaaaatagtgaaataaagtgttcacaagagaaaggaaaacattatcatagtttaataagttttatttgtgcttttattttcattcacattttatatattctctctcatggcaatttaattttagcttgtttatcagtgagatgtacccatgtgatttttttttcccccctcaattctgatactagacacatacaatttttttgtttgttttaatgctctctgagatgttctcaagacacacgtgattttaaagtcagtgcctatgtggctctttttcctccagtatattattttccattctttttttttkggcbgtgtkgcccaggctggatt

SEQ ID NO: 26058 - DNA, 118 bp, Homo sapiens
aaggatattactgggtaatcggcaaaatttaagtagggactgaggattagataatagtattatatcaatgttaaacttcctaattttgatcgttgttttgtaatcaggtgagagcccc

SEQ ID NO: 26059 - DNA, 272 bp, Homo sapiens
ctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgc

SEQ ID NO: 26060 - DNA, 205 bp, Homo sapiens
ggctgtttcttcatagcggattccttagaagtagaattgtcaagttaaagggtaaatctatgtgtgatttttctagatccccaaatttccctcagtaaaagtggtgtcattttgacattcccatcatagttatgagaatgcctgtttccctcatttttgccaactatgctgtcaagcttttgggttttttttttgtttttgtttt

SEQ ID NO: 26061 - DNA, 415 bp, Homo sapiens
  misc_feature 340: y=c or t
  misc_feature 344: k=g or t
gagaatatgcttggagtcattgccaaaccagctaatttctgtcttgtcttttaaattgaattttgcattttgtaccgtgggtttgtatagacctcttaaatggtctctttttccttccatttgcttccatttccttcgagtgctgggattacaggcgtgagccacaaatattttttatcctaaatgttttggaatagtgtcgagtctctgtctctttgggatatggcaccacctagtgttcactggtgtaatgccaggtggtgtctacaccaggaggacctatattcattcctttgggccttttaattttagaagattctagtaactgcatgttattttytgtktttgtttttggagacggagtctcgctctgtcgcccaggctggaatgcagtggtgcgatctgggctcaccgc

SEQ ID NO: 26062 - DNA, 287 bp, Homo sapiens
  misc_feature 113: s=g or c
atttttagtggagacagggtttcatcatcttggccaggctggtctcgaactcccgacctcaggtgatccgtctgccttggcctcccaaagtgctgggattacaggcgtgagcsaccgcatgttgcccaattatttttcagtagtatttttttgttttatttaatttcattttataagagcagtgaattaagtacacattatggaaagtttgcaaagggtacttcctgtcacccttttttttgcacggtcctaacactgtgtacttggtacccttttcacccaacagt

SEQ ID NO: 26063 - DNA, 355 bp, Homo sapiens
  misc_feature 70: r=a or g
  misc_feature 126: y=c or t
  misc_feature 175: y=c or t
  misc_feature 207: y=c or t
  misc_feature 208: s=g or c
  misc_feature 219: w=a or t
  misc_feature 227: m=a or c
  misc_feature 246: m=a or c
  misc_feature 273: y=c or t
  misc_feature 274: y=c or t
  misc_feature 286: b=c or g or t
cgattttccttcatctgtgactggtgccatagacacaggtttatagttttaacttacagtattgtttgaratttacctgtttttcttgtcaaacctgagcactcctcctgctgaagtttcttattyaattccagagtactgtcctctactctaaggcattacttttaagtgtatyatgaaggcagtcttcaaaggatatgaccagtysgggtaattcawattaaacmaggaaaagatttgtttggmagtaactggtgtctctaagaggaattyytagatgtcagtbtggaggctctttcccccctcaattgagagctcttgttattcagagctccaagactagacctggctaaca

SEQ ID NO: 26064 - DNA, 234 bp, Homo sapiens
  misc_feature 178: k=g or t
  misc_feature 179: w=a or t
gtatgaggatacctttttagaatctgaagaaatcggaacaaaagtagaagttgtggaaaggaaagaacatttgcatactgacattttaaaacgtggctctgaaatggacaacaactgctcaccaaccaggaaagacttcactgaagataccatcccacgaacacagatagaaagaagkwaaacaagcctgtatttttccagcaaatataacaaagaagctcttagccccccatc

SEQ ID NO: 26065 - DNA, 153 bp, Homo sapiens
tatttttattgttttcttattttacaggataatgaattggaaaagatcacaaggaggttcaccatggagctagcaaagaagggctttattgtgtggccacatagattttggtataaagtgggaacatctaaaaaaatcttttttttttttttt

SEQ ID NO: 26066 - DNA, 163 bp, Homo sapiens
  misc_feature 17: s=g or c
  misc_feature 117: k=g or t
atttttttagctgaaasactgaggcagagctccccctacccaggctccactgcccggcacagaaataacaaccacggttactgatcatctgggagctgtccaggaacccgacaggakccggacgggccacaccatccacaggcaccaaatggacgacccggca

SEQ ID NO: 26067 - DNA, 443 bp, Homo sapiens
  misc_feature 150: y=c or t
  misc_feature 151: y=c or t
  misc_feature 323: w=a or t
  misc_feature 324: y=c or t
  misc_feature 426: s=g or c
actctctctcttcctgctctgctacggtaagacgtgctttgctttccctttgccttccgccatgattctaagtttcctgaggcctccccagccatgcagaactgctggagtgcaatggcgtgatcttggctcaccacaacctctgcctcyyaggttcaagcgattctcttgcctcagcttcctgagtagctgggattacagggtcttgttctgtcacccaggctggagtgcagtggcatgatcactgctcactgaagcctcaacctcccaggctcaagaaatcctcccacctcagtcttccaaggagctggactacagatggwyaccaccatgcccagctaatttttgtatttttactagagatggagatttcaccatgttgcccaggctggtctcgaactcctgagctcaagtgatcctcctgcstcagcctcccaagtgct

SEQ ID NO: 26068 - DNA, 344 bp, Homo sapiens
  misc_feature 142: v=a or c or g
  misc_feature 247: y=c or t
  misc_feature 248: k=g or t
  misc_feature 290: r=a or g
  misc_feature 304: y=c or t
  misc_feature 321: s=g or c
ccattgctgaaaacttaaagcttcatgtgagaaatccttggtcagaactgaagtaatgatcacctttctgaaccatttctccctccctgaagaaaaacagacatacagatgttgcttggttaaaatggaatagatttaccavaaataacagtttaatccatttcctgtaactcataaggttcccgatgaaatcaagcttttccattcctcactatgacttatgaaactggttaatctagtgtctgaykatacattttttatattatagaacattagtacatttgacagargtgactgctgaggygatttctttagaaagasaacatagatgataatagcccgct

SEQ ID NO: 26069 - DNA, 73 bp, Homo sapiens
  misc_feature 72: m=a or c
atcattttcctctattcaccctgtctaggttgccagcaaatcccacgggcctcctgacgctgcccccggggmc

SEQ ID NO: 26070 - DNA, 392 bp, Homo sapiens
  misc_feature 221: w=a or t
  misc_feature 222: w=a or t
  misc_feature 293: y=c or t
  misc_feature 322: r=a or g
  misc_feature 323: r=a or g
  misc_feature 367: w=a or t
  misc_feature 378: w=a or t
ctttcagggccttcctctctatggcctcaacttcctcttctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccwwaaaaaatttatgtgagattatggatttgttacttagcttgatttaatcatcctgtaacgtgtacatatatyaaaatgttatgtataccataaatatatarrattttatcaacgaaattcataacaatctctcagaccacagagawatcaaattagwactgaggactaaga

SEQ ID NO: 26071 - DNA, 140 bp, Homo sapiens
tttcatgtatctgggaaatgaggtgctttagtcaactgaatctgcccaaaactaaaaagcattaattaaaaagtacttaactcagaaattataaaaatagcagacatcaataaaatacattctacacagaatacgcccac

SEQ ID NO: 26072 - DNA, 139 bp, Homo sapiens
tggtaagatggatgaggtttactgagtttttatcaacagatttctcagatggctcttatgattgagaacattccaattctggaaagatgaagctgcctgcagctgtcacatcagacatccagatgtcaaaccgagcgct

SEQ ID NO: 26073 - DNA, 403 bp, Homo sapiens
  misc_feature 12: y=c or t
  misc_feature 239: m=a or c
  misc_feature 295: s=g or c
  misc_feature 302: k=g or t
  misc_feature 327: s=g or c
tagattaagtgygactgtggtcagaaaggctgttctcaggagggaaggtttaatctgaactcaatgacaggaaggagccagtctttcaagaatcaagagggggccgggtgtgggtgcttggctgggcatggtggcccatgcctgtaatcccagcactttgggaggccaaggcagtggatcacttgagcccaggagttcgagaccagcctggggaatccgcatctctaccaaaaatatamaaattagctaggtgtggtggcatgccccggcaatcccagctactcaggaggctgasgtgggakgatcactcaagctgaggctgcagtsagttgtgatcgtgccagtgcactccagcctgggtgacagagtgagaccctgtctccaaaaaaaaggagacgtgttc

SEQ ID NO: 26074 - DNA, 125 bp, Homo sapiens
atgacgagaaggacccagcctccaagcggccacaccctgtgtgtctctttgtcctgccggcactgaggactcatccatctgcacagctggggcccctgggaggagacgccatgatccccaccttg

SEQ ID NO: 26075 - DNA, 123 bp, Homo sapiens
atttaaaatgtacaattccatgttttaagtgtattcacaaggttgtgcaactgttaccacatctgtaatgttttcttccttcagaacagaaccctgtcccccttttcccctccacgaccccat

SEQ ID NO: 26076 - DNA, 297 bp, Homo sapiens
  misc_feature 23: y=c or t
  misc_feature 49: s=g or c
  misc_feature 220: m=a or c
  misc_feature 297: k=g or t
caggcaaagttcagtcagccaayattcagttagccaaagttaccaaatstgacttcatgcccacacaatgtaaatataatgtgtcaatgctgtgtgctgtaaggtgcttcttgcctaaaaaaggtgagacaaaaccttaggaaggctggcagtaaacctctggagtattttgccagattactgtgacagtggcagaatgattttgtgaaagccacatgcmgtctgaagtttggaaatctaggttcagacccacttattaattgtgtggtcttcggtcagataataacttctccaatk

SEQ ID NO: 26077 - DNA, 189 bp, Homo sapiens
tttcatttttggttgggaaaacaaacaaaaatctcttaagttagtcctttaatagtctttttagaaccaaagaaggaaagaccgcaaaaatgttgcatacgtgactctttattgtcagaatctgtaggaactggaggtctttgtaaagaaatagactagtaggattgtgagaatatatagtgagggaaa

SEQ ID NO: 26078 - DNA, 233 bp, Homo sapiens
ctttttctttgcattcacaacttggctaacaatttggcccaaaaggcctagctttgagcccatctcagcttttgacgtaccttcctcactaagcttaattatttctagcatttgatttaaagtgagaaaagtgcttctcttcctttcctttgaatacttagaggctgttttaggattattaattggcctaatttcaatattgttttgtctcagattaaaaaaaaaaggcccta

SEQ ID NO: 26079 - DNA, 221 bp, Homo sapiens
ctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgt

SEQ ID NO: 26080 - DNA, 187 bp, Homo sapiens
catttgtattgggaacattcaatatcctcctcctagctgtttgaaagtgtataatacattattgttatctttaattcatacagtggtgtagaacactagaaagagttcctcctgtctggctgtaattttgtatcctttaacacatctctccctattcctcccttcctcctacgcttcctacccgcga

SEQ ID NO: 26081 - DNA, 166 bp, Homo sapiens
aaaaattagcttggcatggtggtgtgcgcctgtagtctcagctactagggaggctgaggcaggagaatcgcttgaacccgggaggcagaggttgcagtgagctgacattgccccactgcactccagcctggccacagaacaagactccgtttcaaaaaaaaaaaaa

SEQ ID NO: 26082 - DNA, 148 bp, Homo sapiens
atactgaagccagagctcaccaagattctgacatcaagcatgaaagtgactaattctttcatttcccagcactttgacaaaggggactctcttaaaactcctcatcggacgttagtggaagtcgactcatgtatctaaacatgtagcc

SEQ ID NO: 26083 - DNA, 161 bp, Homo sapiens
  misc_feature 108: m=a or c
actgcactccagcctgggcgacagagccggaccccgtatcaagaaagaaagagaaaagaaaaagaaccaaagaaaaagaaaagtcaccatcgcacggttaagtctgcmttgctacagctaaacagtgacttcctaggaccaagaaatcgcagccagggcct

SEQ ID NO: 26084 - DNA, 409 bp, Homo sapiens
aaaataaaactttaacggcgggctctgccttgatcttccttccttccgcctccagggacccaggctgcgcacgcttgacctctcctgaacctaacatggtccccaccgccagctgctcagccctcagaatgcccatctcccagcgcccaaccccttcctcccgaggacacaggagccgggaccccaggcaccttttccctcccacagacccaagagcctgggccttccccgctcaaggcccaagagacctctgtgaggcacctgaatctagaccttcagacacttctgggaagaacctggattctgggtcccagcagaccctgttaggataggaagcctgcagtgaccagtcttgtctccttgctcaagcttctgtcactctgttgctctctctctctgaaccccggac

SEQ ID NO: 26085 - DNA, 108 bp, Homo sapiens
caggagaatcgctcgaacccaggtggcagaaattgcagtgagctgagattgcgccattgtattccagcctgggcaacaagagcaaaactatgtctcaaaaaaaaaaaa

SEQ ID NO: 26086 - DNA, 167 bp, Homo sapiens
cgaaacactttaatgatggcacagtgaaatgtgaaggttgagaatgtagagagaaatttctatgtaatttgggacttccaatggctaatagaccccaaaatatgtaatacaatgttcagtgaatctagaggtacccaattcattgattctttttttttttttttttt

SEQ ID NO: 26087 - DNA, 173 bp, Homo sapiens
taggaggtcagtacaagatacgggtcataaagaccctgctgataaaacagcatgcaataaagaagctggccaaaacccgcccaaaccaagatggtgataaaagtgacctctggtcatcctcactgttcattatatgcaaattataatgcattagcatgctaaaagacactcac

SEQ ID NO: 26088 - DNA, 252 bp, Homo sapiens
tgtttttggaaaaagtagatttttaaaccgagtttggaaatggtaagtatgcagaggtgggtgggggcaatctcaaaaacgtgcaaaaatgaggaaaacaaaaatgaggaaatgtgtgcgtgtgtttaatgcaaaactttaaaaagaaaaacaactgttatgtgactgttaacttgctctgcattttatgtgccacaggtatgaaaggtgacattgcaaaatactccgctcttctcgcagtgtagaggggcg

SEQ ID NO: 26089 - DNA, 118 bp, Homo sapiens
  misc_feature 96: k=g or t
  misc_feature 97: r=a or g
tgtggttttgattggcatttccctgatcattactgatgttgagcattttttcatttttttgtaggccatttgtatatcttcttttgagaaatctckrttcatattctttgcccaccac

SEQ ID NO: 26090 - DNA, 197 bp, Homo sapiens
cagcagtatttttgacatttttctttagaaaaaggaagagctaaaggaattttataagttttgttacatgaaaggttgaaatattgagtggttgaaagtgaactgctgtttgcctgattggtaaaccaacacactacaattgattaatcaaaaggtttctcctgtaatattttatccctggacttgtcaagtgaatt

SEQ ID NO: 26091 - DNA, 151 bp, Homo sapiens
acaagtacatgcattgctaaatgggatgaaggaaaggcgggcccccgtctcgtgcccctttgtctcccaatcataatctagcaaatgtcaggatacggagctcacactccggaaacatttgttcagatgcagagaagttttagggaaaagg

SEQ ID NO: 26092 - DNA, 407 bp, Homo sapiens
  misc_feature 325: k=g or t
  misc_feature 326: r=a or g
  misc_feature 336: m=a or c
  misc_feature 385: m=a or c
  misc_feature 386: k=g or t
  misc_feature 387: n=a, g, c or t
taaaacaacttttggccaggccaatgtcctggagtatttcccaaatacatttttctagtagtttcataatttcagatcttacatttaagtttctaatccattttgatttgatttttgtatcaaaaatcaaagagataaggaagaaatatctgagagatagtcttattcttctgcatgtggttatccagttttcccagcaccatttattgaagagactatccttttaccatgatgtgttcttgattgctttgtcaaaaattacttggttgtaaatgtgtggatttatatctgggttctctattctgttccatttgtccatgtgtckrttttcttgcmagtattatggtcatttggttactatagctttgtagtatattttgaagtmknatagtgtgatgcccctagca

SEQ ID NO: 26093 - DNA, 213 bp, Homo sapiens
aaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaact

SEQ ID NO: 26094 - DNA, 336 bp, Homo sapiens
agaagatgtagaaactgatacccgaattgctgcctaaatacttgctttggcattgaaagtgttctttattttatcttggtgcctgacacactaatctgtcctgtgctgcttcaaggaagcatttgccaattttaagaacatagggcatcttgaagacttaccatgccagctttgatcactgaagtaagtggacggataggcagttagcaacaattaagttattcttttactctgttgcctttgggaatcagaagtgaatggttttatcttaagtaccaatggcttacataagattctagcctcttgagggctggagtcttttgaatttggcaacgt

SEQ ID NO: 26095 - DNA, 475 bp, Homo sapiens
  misc_feature 349: r=a or g
  misc_feature 454: n=a, g, c or t
  misc_feature 455: w=a or t
  misc_feature 474: m=a or c
  misc_feature 475: n=a, g, c or t
catttgtgtgacgtgaggaggggcactgaagtgggtgatctttaaggccagatgtctctgtaaaagccttgactatcggaagcactgggctagggcagtgtggtacccagggggatgaggtgcatcagagcagcacctgctgaggccaagaacggaggtggctgctgccggcctccgggaggtccccttagggaagcatttcttcaggggtggcccagggacctccggcatcagggcctgcatggggattctgtgccagcccagccctgctaagtcccagccttgggaacctgaggagggtatctgcctatttttcttttaaacatgtttcttaggttattcactagartttgagaaccactgctttgtggctttgaaatgttcatttgaatttttctatgattactaagatttttgcccttaagctctgtatataaacaacatactgtataanwtaaactgggaatggcgtgmn

SEQ ID NO: 26096 - DNA, 197 bp, Homo sapiens
  misc_feature 129: r=a or g
  misc_feature 131: d=a or g or t
gatctcgctctgtcacccaggctggagtgaaatggcacaatcttggctcactgtaacctccgcccccaggttcgactgattctcgtgcctcagcctcctcagtagctgggattacaggatggagagtaradgaggtaaaggaggactctgatgcctcagccatgcgcctgtgtgccgattcccattaagcctgcacc

SEQ ID NO: 26097 - DNA, 189 bp, Homo sapiens
atacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgcc

SEQ ID NO: 26098 - DNA, 235 bp, Homo sapiens
catttaacatggtttattgagatcttatgtgtcaggcacagtgacatattaatatccatattttgcaggtaaaaaaacaaattcagaagacttaaaaaacttgcctttgatcacatagctaatcacatagctaataagtgaaagagccaaattaaaaagaatttatttaacttttaagttcaggggaacttgtatcatggcggtttcttgtacagataattttgtcacccaggta

SEQ ID NO: 26099 - DNA, 339 bp, Homo sapiens
tgggaaagtaatagtacctgcctgactgattattaggcataaggaataatagaattatgaatagtgaggtaagacataaatggcttctgtagtacttgacacatggtattctctaagcaattgataataaatagtaaaaggtagttcttattgctgcagtaatcgtaaatgaaaattaatgcctgaagttcagtggtagcaaagggactggaaagaaaatatcaaatgaacaaagggtagataagtagaccccataagtgcttagtgactgatgtggtgtgggtattgcagtaaggaggctcaccaagatgacgagcctggccaagcatagagggcctc

SEQ ID NO: 26100 - DNA, 248 bp, Homo sapiens
gttccaggcaatatcactggagtatttattactctgaggaaatgcctttgataaggacagggttggtagcttcaatacctccctcattccccaatcatttgcaaaatccagtcacttttgcttctgaataactctcaaatctatccccttctttgctaagattcaagccagcagcccccacctagactaaagcactagcctctgcagcatctctgggatccctgcattttcctcattcagcagccagg

SEQ ID NO: 26101 - DNA, 307 bp, Homo sapiens
  misc_feature 285: n=a, g, c or t
agaagaaaagcagcaacactgatacttgtgtgcacctgatttggccaataggatcaacagtgaaaagacagaagaggcaataccagcagtccccattacagtctccacctccccgtcttcctctgggtgccaaatgatgggaagatgagcttcatctgaccatttcttctccctgtctcctgttccccttcccagttaaacaggttagattgaaggcccttgctgtatttctgtagagctaagcagcccttagaggaaaacagttcaactctgactttcctagtngtttttttattgagagccactc

SEQ ID NO: 26102 - DNA, 120 bp, Homo sapiens
ttccctttaacagccttattgatgtataattgaccgacaataaactgcatatattgaagttgcacactttgataagtttggaggtaaatgcatacatactcatgaaaccactgccaccag

SEQ ID NO: 26103 - DNA, 238 bp, Homo sapiens
atagggttatgggaagaattaaacaatatgtgtaaagcacttactagcacactgcctaacacaataagttagaaatataatttgtgtagaactctgacaacatacatttaaacagatgttagtaattctggtataaggttttgtcatagccaaatggaaatgtaggaaacatttataatgttcttaaaagatagaaaattcacctccattttctttgtacttgaagatgacaccacgg

SEQ ID NO: 26104 - DNA, 177 bp, Homo sapiens
cattttaaccattttaaagtattcaattcagtggtatgaattatattcacaatgttgtatagccatcacctgtgtctacttccaaaactttttcattatcccaaacagaaactctgaaaccatcaagcaattactccccatttcccctctcccagcccttggtaacgtcgactctcc

SEQ ID NO: 26105 - DNA, 117 bp, Homo sapiens
taaagaatgccctttttaaaaatctcttcatgcgtattaaatgctgtctatattgcaaatggagggacattgacaggtgtgtgtgtgtgtgtgtgtgtgtgtgtgtgtgtacacagt

SEQ ID NO: 26106 - DNA, 243 bp, Homo sapiens
cccgttttatgtgccaatcacatctacaaagggccattctgtttgtggcacagcatttcaagaaagattggcagatttgttaactggaccagagaaaggtgaccaagatgtatgagtcttagaaaccatggctcaggaggattggatgaaggatttggtagtatttgactggaaaataggaaggagagtactggaaaataggaaggagagtacctgggtacatgacaactatctcccgtagaa

SEQ ID NO: 26107 - DNA, 149 bp, Homo sapiens
agatgctgccagggtccctgaagagggaagacacgcggaaacaggcttgcacccagacacgacaccatgcatctcctcggcccctggctcctgctcctggcaccctgaaaccctctacgcctgggagggggcctgcgtctggatgcccc

SEQ ID NO: 26108 - DNA, 420 bp, Homo sapiens
  misc_feature 140: s=g or c
  misc_feature 144: m=a or c
  misc_feature 249: s=g or c
ttaccaactatgaagcaaacactactgtttctcatattttttcattaaaatgtatttatgtatctatcaaaaaaataactcagcattgatagaagtaactatagaacaagagctggcaaataacagcatgtggggcgaasgagmacccctccccactgttttttaatagaccattttttacagcagttttaatttcatagcaaaaccacgcagaaagctctaagagtttccatatactgtctgtctacstccacttcctcagcctctggtgttatcaatattttgcaccaaagtggtacatttattacaacctataaaccttcattggtacaccattatcccccaaagtccatagtttacattagggttcactcttggtggtgtatattctatggagttggacaaatatgtagtgatgtg

SEQ ID NO: 26109 - DNA, 139 bp, Homo sapiens
aatccattttccacaccgcttccccgggagcccgttaaaatacaccgggaccgcggcgggtgcaagcctcctgtatctccacatagcaggctaaggggaattgggtagggaataaaggctgcaggggacaccggctagc

SEQ ID NO: 26110 - DNA, 367 bp, Homo sapiens
  misc_feature 341: n=a, g, c or t
agcaaatcaagaagatttttttagatcatataagaaaaggtagtaatcaaaaagtaaaacccagttgctgaatttaggttagttaatataaggcatgattatgtaaaactgactgtaaaattgagatccagtttttaaaaatccaagttatttgtaggcaaatgttaaacaattaaaaaaaattttttttcaatttttttaaattttattttattattattatactttaagttttagggtacatgtgcacaatgtgcaggttagttacatatgtatacatgtgccatgctggtgtgctgcacccattaactcgtcatttagcattaggtatatctcctaangctatccctcccccctccccccccat

SEQ ID NO: 26111 - DNA, 382 bp, Homo sapiens
  misc_feature 137: v=a or c or g
  misc_feature 138: n=a, g, c or t
  misc_feature 364: n=a, g, c or t
aatgcataagtgagagcatgtgctggtgtgtgtataggtgtgtgtatgtgtgtttgcaagtgtgttggtgtgcgcataggtgtgtatgtgtgcatgtgtgttgtgtctgtataggtgtgtttgtgggtgtgcatgtvngttgctgtgtgtgtgggtgtgtgagtgcacgtgttggtttatgataggcgtgtttgtgcgtgtattggtgtgtataggtgtgagcgtgtgtgtatgtgggtgtgtatatgtaggtgtgtgtataaatgtacgtgtgtgaatgtatatgtgtgtagtttcatatgagtgtgcacatgtgtgtttaaaatatggctaacggtaaggaaataggaagaaataaaattanttttccaagtaagggcag

SEQ ID NO: 26112 - DNA, 391 bp, Homo sapiens
  misc_feature 51: s=g or c
ctttcaaggaatttcaaagatatggggtaatggctggagggagacgcgaastgagaggagatatttttaaggtgggagaaataatggtttgtttgattacaggtaggaagaatgatcctgtacagtggaaaattgatgtaggagaaaggagaatcataaagctatgttcttgagcaagaggggatggatttatttagcaagcggagggattggccttacgagtatggacagttcgcccaaaacagcaggtgggaaggcattatatctgggcgcatttgctgagagatgggtaaatgtggtgatggaagtctatcaaaatttgcctctgactgtttcagtttttccattgtagtaggaagcaaggtcattcttcagctgtgagtgaagatga

SEQ ID NO: 26113 - DNA, 416 bp, Homo sapiens
  misc_feature 336: d=a or g or t
ctgcccactgtagttggacaaaaccacattcaggtctatgtgtcagctttgtccctcagccctgtgatttgcttttggtggctcagggccagctctccaagggcaagctccatgaaggcagacagtgcgtctccattttgatgaaggcttgcagtcaaggtcctcagtgtgtgttagagaggcatagagctctgcaagggtaagttcatgtctataacaataattgacctccctagtggaaagacaggattttcccaaggaaaatagtttgcggtgtcatatttgtggtctctctagagagacaattccgtaagtggttcctaagccttggaaaadtctcttttacaatagtacccacaaataatgttcaaagagctatttttgaggaaaggattcctcacatttttgcaggtgca

SEQ ID NO: 26114 - DNA, 271 bp, Homo sapiens
cttttctcttccttttcttgtctagtcagttggccagaagcaatcttctaatttagccctggctctcttctgaattgtctttctatttcccaccatctgtaagcaactgggctggcatgtagtagatggggtctcactcagtctgtcccccaggctggagtgcaatggcatggtcacagctcactgcagcctcaaactcctgagctcaagtgattctcctgactcagtctcccaagtagctagaaatacaggcacaaaccaccacaccttg

SEQ ID NO: 26115 - DNA, 152 bp, Homo sapiens
aaaaactcctgaactcaagcgatctgcccacctcggccacccaaagagccaggattacaggtatgagacactgtgtggtcccctcaacttatttttttaacatttttttttccaatgaagttgcttgtctctttcacttttgtccaatttgt

SEQ ID NO: 26116 - DNA, 150 bp, Homo sapiens
  misc_feature 96: r=a or g
tctatttatctaatctatcatctatctagctatctttctattttatctatctatctgtctgtctgttttatctatctagctattttatctattttrtctatctatctatctatctatctatctattctatctatctatctatctatctat

SEQ ID NO: 26117 - DNA, 263 bp, Homo sapiens
  misc_feature 80: k=g or t
  misc_feature 138: s=g or c
cttagtgatgtgctagacacagaaaacagccataaaccattttatcaagccttcacgacctggcctattttatttatttktctttttgagatgggagtttaactctcacccaggctggagtgcagtggcacaatcttsgctcactgcagcctccacctctcaggttcaagcaattttcctgcctcagcctcctaagtaactgggagtacaggcacacgccaccacacctggctaatttttgtatttttagtagagacagggct

SEQ ID NO: 26118 - DNA, 186 bp, Homo sapiens
aatcacagtacatttccttccacatgggtatagagcactttaatgttagaatagagcactgagaacctttcaggtacctgtgggacacgagtcttgcgagtgacactcaatgccagggagtctccccagttatccattctaccaggaggaatttaggggaactggcttcagagtaaagggaaaggg

SEQ ID NO: 26119 - DNA, 339 bp, Homo sapiens
  misc_feature 277: w=a or t
  misc_feature 327: m=a or c
atcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatawtttaaatatttatagatttttaaaagatttcttcaaccttcttttctcamcctgcccccggg

SEQ ID NO: 26120 - DNA, 365 bp, Homo sapiens
  misc_feature 15: n=a, g, c or t
  misc_feature 335: m=a or c
  misc_feature 336: w=a or t
atgattgtgccacgngcactcctacctgggcaacagggtgagaccctgtctcctaaataaataaataaatctcatgttgaaatgtaattcctaatgttggaggtgggacctggtgagaggggtttgggtcatgggggaggatccctcatggcttgctgccatcttcctgatattgagtttgttttcacgaggtctggttgttgtaaagtgtggcaccttgcccgctactcactcttgctctgctttcaccaaacatcatgtgatatgtttgttcccgctttgccttccaccatgagtaaaagctccctgagcctacccagaagctgagcagatgmwgacaccatgcttcctacacagcctgctaa

SEQ ID NO: 26121 - DNA, 114 bp, Homo sapiens
agtgatcctcttgttgtcactgggattacacacacaagccactgccttactgtgtacttttctaaagtatagacatacctcagagattttgtatgttccattccagaccacccg

SEQ ID NO: 26122 - DNA, 210 bp, Homo sapiens
atagtacttaggaaactgctttatctattattacagtattatttaaagaaagcgcatagggtaagttctgggaaagagcagagtttccatgccctttcactctgaagtcaggatttcaccctctgggcacatcaatgtgttaaccaacaggaattttctctgagctttgaagtccagagtttttttgagtttcattatatagggacgccg

SEQ ID NO: 26123 - DNA, 95 bp, Homo sapiens
gttaggtctttatattttaaagtgtaataccagttttgttattttagtagcagaaatgggatgattgttaaagttccccaaaaatgttggcgagc

SEQ ID NO: 26124 - DNA, 96 bp, Homo sapiens
cttgggtcgtggatatgaattgttactaatctttgtgactatttaatcttcaaatattgtgcttaaccccagcaatccgcacgtatccagcacccc

SEQ ID NO: 26125 - DNA, 276 bp, Homo sapiens
agaaaatatttatacaaatctagatggtatacctacaacacacctaggctatatggtatggctattataatcttatgggaccactgttgtacatgcagtttgtgcttgatcaaaatgtcattaatgcagcacatgactgtaattatagattcatgaagttgcaaaacagtgtacaaagtggtcctgtgaagttgttgctcagtttctccttgtagtatcaccttgcataactatagtatggtataatgagcagcaaattaacattgatacagtcca

SEQ ID NO: 26126 - DNA, 423 bp, Homo sapiens
  misc_feature 6: r=a or g
  misc_feature 7: n=a, g, c or t
  misc_feature 8: n=a, g, c or t
  misc_feature 153: r=a or g
  misc_feature 411: r=a or g
tttgarnntatgatgataatgatgtcatccttctggtttaaatattttgtagcacttgtggtagattgaatgctggtgtcggtagtaaagtcatgctgcagttatagtctgaaccagctgtactgttttgggtagtaacttagacagtagagracaccacttttctaggcagggctcctcacctctcctagggggccatttcactgcatcttggagtgaatatacagagaggaagtagctagatcctaatttctacaagttatatcagttggggaacagttgtggttgtcaacctgtgttagggctgtattggttttgctttcagttgtgctataaagtggaaaaaattgaattgtttatttatctcttattgtgaaactttcctgtggcccatagaagtggcatagcaarctgaacatagct

SEQ ID NO: 26127 - DNA, 165 bp, Homo sapiens
caggaatttttaggctgggcatggtggctcagactgtaatcccagcactttgggaggctgatgtgggtggatcacttgaggccaggagtttgaaactggcctggccaacatggtgaaaccccgtcgctattaaatatacaaaaattagttgggcatggtggcgat

SEQ ID NO: 26128 - DNA, 359 bp, Homo sapiens
  misc_feature 327: m=a or c
tattcagctacacttaattttaaaaagtgagtctatttagagaaaatatgaagtaaagagtagcacaggtgcgtggtaggcagagatggtaaaaatcgttaagatgggatgcaaatgactgagttttgggaaacaccacagtaaataatatttagatttgcaggtaatttttcaaataatccagctcagccctggttgccaggccaccctcatcccagctgggccaggtgttctctgtaatgtgcccatccagcccttggcctaggtgaccagggagccatgttgtctctgcccagtctctgcttccgcggtcagcccagtggtcamtgggctcctttaggaagaccaagcgtaggggg

SEQ ID NO: 26129 - DNA, 250 bp, Homo sapiens
ttcattttttgagatggagtcttgctctattgcctaagcttgagtgcagtggcgcgatcttggctcactgcaacctccacctccctggttcaggcgattctcctgcctcagcctcccaaagtgctgggattacaggcatgcaacaccacacccagcctgaaacccagatttttaatatgaaatcaaagtcttcagaccttgtaggtgtcataaaaagcacgctgaggaccactagtttgcaactgccaat

SEQ ID NO: 26130 - DNA, 270 bp, Homo sapiens
taagaattttatagttttagcacttatggtttagtccgtgattcattttgagtgaattttttgtgtatggtgtaagctaagggcccaacaacattcttttgcatgtgggtatctcgtatttctgacaccatttgttgaaaagattgttcttttcccattgaatggtcttgtaacctgtattgaaaatcattttaccattatgccagaatttatttttgggctctttaatctgtttcattggttttaatcagcttttattccagcaccact

SEQ ID NO: 26131 - DNA, 246 bp, Homo sapiens
cttttctttttcgctctttaccgctttctcattccgactgccactctttgttctttcctctccgcgtccccccgaccctgtgtgtcgtggttcgtgccggtcccagttgagtcttgagtcccgggaagagaccctgcgcggactggggagccgttgaattttgctgtcagactcccagtttcctcttcttcagtgcctcttcatgcctcccccggctctgtttttatcttccctttaccctcgccc

SEQ ID NO: 26132 - DNA, 438 bp, Homo sapiens
ttacaggtcctaatcaaacaggaaattcaaaggaagagtggttatgccattcaggctgatgaagagcagttgcgagttcagctggatacgattcagggtgaactaaatgcacctactcagttcaagggccgactaaatgaattgatgtctcaaatcaggatgcagaatcattttggagcagtcagatctgaagaaaggtattacatagatgcagatctgttacgagaaatcaagcagcatttgaaacaacaacaggaaggccttagccatttgattagcatcattaaagacgatctagaagatataaagctggtcgaacatggattgaatgaaaccatccacatcagaggtggtgtctttagttgacagttcacaaacttgtgtaaaggtttgtgaaatgcatcttcttactgcatcagaccttccttaagaatgaaa

SEQ ID NO: 26133 - DNA, 136 bp, Homo sapiens
cacccttaatgtcgccagctgttcagaatttatttgctgagtctgaaagtgtttagggttttaggggataccttgtaaacacttaaaaatgcatcaaatgcctgtgttgcaatcaaagattcttccagctatccaa

SEQ ID NO: 26134 - DNA, 157 bp, Homo sapiens
  misc_feature 100: s=g or c
  misc_feature 149: s=g or c
aacttctgtctcctctgtgagctgcttcctccccttcctttcttccttcccccaggaaggagtcccatagttgtttgcacccatccattacagcgtggastgcaccttattacagttattggtgtgcaagcctttctcccctactagascctaagct

SEQ ID NO: 26135 - DNA, 383 bp, Homo sapiens
  misc_feature 130: s=g or c
  misc_feature 131: k=g or t
tcatattctctatagtcagtttcactgccatatagattttctttctagtgtatgactccctgcacaaaattccacaatagtacttcattattttctaagtgaataaaattattagccatgaacggaaggskatctgacatatggccatagcatcctttttcagtcttgctcctaggattcccctgcctgtccactttgctctagtgatactgaaccaatggccactccctgattatgcctcctgcttctctccttcgttgccttattctgtcttaccggctttcctttcttcttctctttttaactacttaatcctacagactatgcaagactgaactaaaatactcttatacctttaggcacaagagatgaactgccctgtt

SEQ ID NO: 26136 - DNA, 204 bp, Homo sapiens
  misc_feature 129: r=a or g
ctttagtttgatttgtcaataatatacattatggattaccttaccctattcttttaattatatgttgttatatattgtatactaaaacagcagtaaagcatcttcactgattttcttttggatttgagrataagctctgaccaaatggcagctagccccttttctttagccagaattacatccccattttccattacctcatcg

SEQ ID NO: 26137 - DNA, 390 bp, Homo sapiens
ctggatttaatgactaggaaactgtgaaatttatatgatttgggggcacgtgggggcttttctaatgccagttccaaggataagtggcatggaggttatttgattaattggacaagcataaactctagctcagcttcctgcctgtcatctgaacacagaacattgaagattaggcgacttagcactccagaattaaaatcatgatatttcttttcctattaacagactattttgcttagcattacactgtcttttaggcaagcattcactgggcccctgcatatgtaatctttacttatgagtgaggaattttccaaggtatatgttgaaaacactgtgctccctgaagtccagctatggttgaagccatgcctttgcaatgagacccag

SEQ ID NO: 26138 - DNA, 394 bp, Homo sapiens
  misc_feature 145: r=a or g
  misc_feature 163: k=g or t
  misc_feature 338: m=a or c
  misc_feature 339: m=a or c
atttaaaaatgtgttcacatatccctttctctaacagtttaacctagacaaacatctgtatcagtatttttttattcccctgattgattacatttggtttctttattctgaaaggaaaataacaaaaacttcagaaattcctaargggtgtaataaagaagtkgggttttgaggtttcctttcctggaattattttacagttctttggtgggtctcgccagctattaattgataatgaacatttttcactatttttttttctatctgaagcttagagatctagagctttggatctttcgggtatatgtcaatggaggtataattttataatactttgmmttgacatgaagtgggttcatgggggaaaaccatgagctgtgaacattggtagcag

SEQ ID NO: 26139 - DNA, 369 bp, Homo sapiens
  misc_feature 361: n=a, g, c or t
ggggagagaatgaaatttttttgtaagtgatagaatttcagatactaaaactactaatcttacctttgagtcatgaaaataatggatattgtattaaataagtttaaggtacctccttagatatacaaaggaactaccaactttgaatgcttttggctgaattttaacatttttattgatgagccttagaagaaatacttgaacacatatattgatatttagttgccagctagtttagaaaaagctacagtgaaatgccagagtaacttctgactttaagttccaaagttccattggttagggagattgttttcataatttataatttccaggaaaaggggaaaatatatattgacagaanctctggtt

SEQ ID NO: 26140 - DNA, 307 bp, Homo sapiens
tagcatgaagttcaaaaccatcaaaaaatagtgatagcaaggacatgaggaggcacctggggtgctcgctgttttctattattcatctgtggaatggtcacatgggtatatatatttagtgaaaattttatcttgctatatactcaactatttgtacactttaatacatgtacgttttatacttcaaattaagcatttacttacaatgtcagagactttgatttttgtataacagaacaaaaagtatacagaatgaagtgtgtttctgttttttgttggaatttaaattcttattttgtctcttcgt

SEQ ID NO: 26141 - DNA, 199 bp, Homo sapiens
ttcatagtctcctgattcacttggttaaactgataagcattgccctacattctgtggcttctttgtttacttgttgtcctctgttgttacttgacccatcttagtaatcttcctttaattccttccagaaggggaaatgtggtggtaaaaaatgcaaattacaagagaaactggtattttttattctatgggtgttttt

SEQ ID NO: 26142 - DNA, 326 bp, Homo sapiens
ttagaaaaagtgccattcttaacctttcagaatcactcataagtaaatcctatagcagtctctgctaatgcaaatttcaatgtgtgcccgatataggtaacttttgtacactctgcaccgacataaagaaaagaacaaagatcttcaagttttgtcagtatttgcatttttggaagaagagcatgaaaataacatcaaaatgaaaaattaggccgggagcagtggctcacacctgtaatcccagcactttgggaggccgaggtgggcggatcatctgaggtcaggagttcaagaccagcctgggcaacatggtgaaaccctgtcct

SEQ ID NO: 26143 - DNA, 148 bp, Homo sapiens
caaattaatttctccccccaccccccaccaacaacaccccaacatgcaccttggcctggcggcttctgcaaaacaaactttacaaatgaaaatttcaaccaggaaaatgggcctggggccaagttccattcaaataagcaaatacccc

SEQ ID NO: 26144 - DNA, 477 bp, Homo sapiens
  misc_feature 428: n=a, g, c or t
  misc_feature 431: s=g or c
  misc_feature 439: h=a or c or t
ctgaatatctgcctaaataatttctatctccggtatcagtggccagtagcagtgggggtagccgcagctgtcaggaagcagtaatgatctttgcaagtatcaagagggagagtggcagatattggagactggagaaacgtcacaaatgcccccaggaggagaatcgtccatctgcacacttagcccttggcccacagtgggaaataaagggttaacaaatgttcctaggtgaacagtggattcctttcctagttcctctcacaaagggctaaggaaccctctgcactttcagatcccttgacgtccaccggggagctgcaggtgctttgcagtgctgagccaacagcactagcagttttgtgtgaatccccagctaaacccaaccagatgaggattataatctccattttatggtggaggaaacactnagscaatagghaatatgtcctagggtcacaataagtgacagagctggga

SEQ ID NO: 26145 - DNA, 311 bp, Homo sapiens
  misc_feature 130: w=a or t
tggggctgttctggctgggtatggtggctcacacctgtaatgtccgaactttgggaggccaaggctgggtggatcacttgaggtcaggatttcgagaccagcctggctgacgtagtgaagccccatctcwactaaaaataacagaaattggcggggtgtggtggtgcacacctgtaatcccagctacttgggaggctgagaaactgaggcacaagaatcactttgaacccgtgtggtggaggttgcagttagcccagatcatgccagcctgggtgacagaacaagactgcttcttaaaaaaaaaaaaaaaa

SEQ ID NO: 26146 - DNA, 302 bp, Homo sapiens
  misc_feature 53: h=a or c or t
  misc_feature 54: m=a or c
  misc_feature 55: r=a or g
catgttcaactggcacccagtgcttatggttgctggcatggtggtattctaghmraggtggtgagtaagaggtcaggaagggaggcgggatagggcccaggctggacaaagctgcactttccctctccaaaggctggcctttgtaaatgttgggcttggggctatgggggtagggtgggttgggctgtctctgggcctagctgtcatttgggggaggaaggggttaagatggggggcatctcagaagggtggcttcacaaatactctagggcaggagttggcaaactttctatagagggtcc

SEQ ID NO: 26147 - DNA, 393 bp, Homo sapiens
  misc_feature 366: k=g or t
aattagcaaagttagtcctggagcatttacacctttggtgaagttggaacgactttatctgtccaagaatcagctgaaggaattgccagaaaaaatgcccaaaactcttcaggagctgcgtgcccatgaagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatkcagctagcctgaaagactgaataattt

SEQ ID NO: 26148 - DNA, 161 bp, Homo sapiens
atatttttcctcctccctaaatgttattgcctttataggctttggaaatcagttttatggcctgcgtgtttgtccactgaaatgtggaatgctctggagggaaaataaaatgcagggatggttctggccctgaaaaggtcaggtggccgagggcaagcggc

SEQ ID NO: 26149 - DNA, 176 bp, Homo sapiens
catatgcttttatttttaaaaatgtggacactggaaaatttacatccatgacttgcattatattcctattggacagcatgagtctagaatgtgtagtctagaatatgcaattaacattggttccctcgggggagtagactgtgcctggggaattccgttgggttaagggagagcga

SEQ ID NO: 26150 - DNA, 428 bp, Homo sapiens
  misc_feature 305: n=a, g, c or t
  misc_feature 306: d=a or g or t
  misc_feature 307: d=a or g or t
  misc_feature 308: n=a, g, c or t
  misc_feature 389: n=a, g, c or t
  misc_feature 390: n=a, g, c or t
  misc_feature 392: n=a, g, c or t
caaatgtctcttctcccttaccttgttttggatcctcattccactctacaacttcctttgtcattagtgacatcaccgaggagacagaggtggaggtccctgagcttccatcagtccccctgctttgttctgccagccctgaatgttgcaaaccagaacacaaagctgcctgcagttcgtctgaagaggatgactgcgtctctttgtccaaggccagcagctttgcagacatgatgggtatcctgaaggactttcaccgaatgaaacagagtcaagatctgaaccggagtttattgaaggagganddnccctgctgtgcttatctctgaggtcctaaggaggaagtttgctctaaaggaagaagatatcagtagaaaaggaaattgacnngntcagctctgcaaactcagtctcatgctcctggaata

SEQ ID NO: 26151 - DNA, 147 bp, Homo sapiens
cctttacgtagtatttttatttaaaaaaattaaaacagcagcatataaatgcatgttggttgtcaaccagttaatgaagtgaataaaagggaggaggcggaagaactgcacggacctcttcgcccccgccttctcctgtgtggtgca

SEQ ID NO: 26152 - DNA, 143 bp, Homo sapiens
tcagcactgagcaggccacagagataaataagaaacaggaatcaccccaaacttgcattcttatgctggcattgccacttaacactgggtccttaactttggacaagtcacctatctatgatacggtatgatgtgagccaacc

SEQ ID NO: 26153 - DNA, 155 bp, Homo sapiens
attttcttagttctttactattattaagggcttatcccaaacaccattatttgagcagagtggtttctgataggaattccgtagctgcttttctgtggtaacatataaatgtcatgcccttgaaaaagatttccctcattcaaatggaagcactt

SEQ ID NO: 26154 - DNA, 302 bp, Homo sapiens
caagatttaaaactaaaaaattcctaaaagaaaacataggggaaaatctttatgacattggatttcacagtgatttcctgactgtgatactaaaagcacaggcaacaaaagcaacaataagacaaatggaactgcatcaaacttaaaatcttctacacctcaaagaaagaagccagcagagttgtattagtttttacactgctgataaagacatacccgagactgggcaatttacaaaagagagagatttattggacttacagttccatgtggctggggaggcctcacaatcatggctgaag

SEQ ID NO: 26155 - DNA, 242 bp, Homo sapiens
  misc_feature 61: n=a, g, c or t
  misc_feature 62: y=c or t
  misc_feature 71: s=g or c
aacagaccccacccggcacaacctgctcacatacacacacacaataacacacacccaatcnyacgcacccsactcagcataacctgctcacacaatcacacacacaatcacacacaccctacccagtacagcccactcagacacacatgttctcacacaatcactcatacacatacacaccacagcacagcccgctcacacacacacacacatgcaccccacccagcacagctcacccacgc

SEQ ID NO: 26156 - DNA, 70 bp, Homo sapiens
tgttttgtgccactgcgttgaagcctgggcaacagagggagagatcctgtctcaaaaaaaaaaaaaaaaa

SEQ ID NO: 26157 - DNA, 263 bp, Homo sapiens
taaactagtatactccacaaagatcgaatgcagttgacatctctggaataaagagcatgatttttaaagctgtgagatggaagaactttcagaacatggaaaaccccgtcacggtgataggtgaaggtatttggtgaagaaagatgggaataagattgtaatataggaaacagaaattaaatggaccgtagcctttttgagaaaagtagcaagaataagagaatgggcaggatgtgggcagggagtggttggaaagtttagaa

SEQ ID NO: 26158 - DNA, 230 bp, Homo sapiens
ttagcatctcaaaatcaggaacatactattgaattgcttaaatacaatccacagaattaaaaacaaaatcagatgccatccacagttatactaattatccattaaaagcttacacttaatacttgaaataacaatcaatatctagcagggaatactgaaagtgatttcagagtctcatcctgttgtactctgttgggaaggtttcttgagtagatgtgtgactggcccca

SEQ ID NO: 26159 - DNA, 100 bp, Homo sapiens
agacattctagaaatcatcaaaggaaactaccagttcattttccacagggagctttttctcctttcctgttaaaatgtcactttggcactaagaaaattt

SEQ ID NO: 26160 - DNA, 285 bp, Homo sapiens
attgccggagagtttctgcaatatgctactgcagtccatatgcttatcaattatgaggatttttggctttcggctctggaaaatatgagaaatatgggcaattactctctgaagaaagagatggggttccaccatgtagccccggctggtcttgagctcatgagctcaagcgattcacctgcctcagcctcccaaagtgctgggattacaagtgtgagccaccattcctgcctctatacctctaaaggtgttgaataatttgaatgggaatttgaaggtccatgg

SEQ ID NO: 26161 - DNA, 154 bp, Homo sapiens
aaggggatgcggaaacccctggctcggtggagcggagaggcaggcgggcaggagccgaggacggcatgtcccaggccccgggagcacagccgagcccacccaccgtgtaccacgaacggcagcgcctggagctgtgtgctgtccacgccctccg

SEQ ID NO: 26162 - DNA, 234 bp, Homo sapiens
  misc_feature 48: m=a or c
  misc_feature 161: w=a or t
  misc_feature 174: d=a or g or t
  misc_feature 183: w=a or t
attttatttggttgatttagtagtgtatttcttttgtatttatttgtmacttttttatataaagaaatctgtaaatctttgtgtctttttgagttatttgaaagggtttttttgcattttaaaagcataattaaaatgcaaattgttttccctagcttttwatttatttatgtdttaattttwatggtttttgaatgatagaagttttaaatttctttagtcagatccatcagc

SEQ ID NO: 26163 - DNA, 184 bp, Homo sapiens
  misc_feature 174: s=g or c
atagcggggtaaggtcttaacgtctgaggaagagatctgtggctgcgggagatctctgcggattggggctccagcctgactgacccgacagtgcgggtggcctagggggaggcgctcagagtaggaacccgggggtgcagacgggatctgccggatccccaggcgtgtgtgtgsgcgggcgaga

SEQ ID NO: 26164 - DNA, 110 bp, Homo sapiens
cttgtggaataaggaagagataagatcagaattattcttccttcctggaccagctagctctttgaaggaagcctcagcatctcacacacacacacacacacacacacacg

SEQ ID NO: 26165 - DNA, 123 bp, Homo sapiens
cccataaaactttaacacttttgctagaaacactattttttttttcacaacacattgaaagactattatccaggcagcctctctttcgcagggacgtagggagggaaaatcttttaagggact

SEQ ID NO: 26166 - DNA, 261 bp, Homo sapiens
  misc_feature 136: k=g or t
  misc_feature 157: r=a or g
  misc_feature 190: k=g or t
  misc_feature 192: k=g or t
  misc_feature 233: k=g or t
tccaatacaggcttttacgaattattgacatttaggtagtcagtggtgtgatttaagatgagatagtgccccaaatatttggctttatacctgataaaatgatgccctaattttcacctgattagaatatttagcktgttgtgtgcaatggcatgaraagcctaaaggattcaagataattcaaattcckaktgattcacgtgatattttcacactcagttctttcatctgtkgtttctgcaaacaccttcaaaacacttc

SEQ ID NO: 26167 - DNA, 238 bp, Homo sapiens
ccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacaat

SEQ ID NO: 26168 - DNA, 482 bp, Homo sapiens
  misc_feature 30: v=a or c or g
  misc_feature 139: s=g or c
  misc_feature 404: s=g or c
  misc_feature 450: k=g or t
  misc_feature 473: m=a or c
atatttgttgtaaagaggtttactattaavagaaaaagaatacacgtttctgatacttcggcgtgggttttggtttctttggtgccgcgaggatgggaaggaaggactggtgtggccccatcagggtgagaggcagtgsttcatctcagcagggaagaatggggggcggccttcagggcggggcacttccacatgtctcaggtggggttttcaggtgagaatttcttctaagtgttctgtcagaaggaggcagccccagcccacactaaggagggattgcccagctagaagcctcaggagggattctgggacacaaaaatagaaatgccacccaaggttgagttcaaaccagaatggtgttgggggtgggagttggcacggtgaggacctttgactgctgaaasccttcctcagcagagacttgcccgggcactatgttaggcacaggtkgattccaccctcgtgctcctcamagcatgctt

SEQ ID NO: 26169 - DNA, 310 bp, Homo sapiens
  misc_feature 138: w=a or t
taaatagatagaagacttacttaaggaagtaatagcaaaaaactttccaaacctgaagaaagataaaaatattcaggtaaaggaaaatcaaaactctacaatcagattcaatccaagtaagactaccccaagacatawtataatcaaactgtcaaaaatcagaggcagagagaggatcctgaaggcagcaaaagaaaagaagcaataacataacataaaaacgggctcaaatgtacctagaagtggacttctcagccgaaaccttatgggccagaaaagagtaggatcatatatttaaagtactgaaaaa

SEQ ID NO: 26170 - DNA, 392 bp, Homo sapiens
  misc_feature 113: r=a or g
  misc_feature 114: s=g or c
atatcatagtgtatcatatttgaatattatacaatttcaaatgtattgttaataaaaaatcacagtttgatttaattgaaaagtggctgagacataattttttattataagarsatattgtgagctgggtgtggtgatatatgcatgtggtcttagctactcaggaggctgaggcaggagaatccctcgagtccaggagtttgagtccagcctgggcaacatagtgagaccttgtctcttaaaaataaataaaaaaataaataaaaatttaaaataattaagaaatattgtggaaaaattgcatgtgaataaacacttctttttaaaggctctacttttcaagaatggattgacagtatatgtgtgtgtcagattatacgtgtgtgtgtgtg

SEQ ID NO: 26171 - DNA, 408 bp, Homo sapiens
  misc_feature 337: n=a, g, c or t
  misc_feature 338: d=a or g or t
  misc_feature 339: w=a or t
  misc_feature 340: y=c or t
tagaggaaaaggcatatttaatgtacacagaatgtggacttgctccacgtaaaatttctaaggcatatacaacgtttcttttgaagaaggcttatacacttgttgactgcctagagagtttcctgtataatcatcatttgaatatttattgatgattttagtcaccattatctgattcagtgaaacaactctttgggttgatttatttactagatttaaaaaattattttctatcacatataaatgggcttttacagccagatagtgacctcttgaatttattattttaaaatagtactgggaaatattacacatatccagatactttgactatgandwytttgtatttaaaatactcgtatcaataaaaatgttcagtaaaatagctattacttcatcccactatgt

SEQ ID NO: 26172 - DNA, 217 bp, Homo sapiens
cacagctcttgtcagaaagccctgagttccccctggataaagagttaattttaatccttccctataattatacttcaaaatatttgacatctgctattatgccttctttagatctttcttctgtggtgcagacatttctagtaagtgtttgactacttgtatggcattagctttcacagaaaattgtttcacttaaaactgtggattggcctagtac

SEQ ID NO: 26173 - DNA, 299 bp, Homo sapiens
ttttacgtttgctttctattaaagtgtattggtttatctctaattggcagtcttggaaagcttcattttgtagttcttccctgtgttaaatatttcgtgatctgtaaatggacactaaacgaaatgctacttgaagggacgcttgtgattatttaataaggtgaatagttcgcctttcgtttattgatttggttttctttattgtgaaatagtttaattttgtgcgtaatccacccttccttagccctcccacactggtaaagctggtaccctagtggcatggtctacataggcccccc

SEQ ID NO: 26174 - DNA, 359 bp, Homo sapiens
  misc_feature 61: m=a or c
  misc_feature 94: r=a or g
  misc_feature 139: w=a or t
  misc_feature 181: r=a or g
  misc_feature 311: n=a, g, c or t
  misc_feature 312: m=a or c
tacagagagaggggattcaatatgatggaagtaggttatcataaagactctagattttggmtggtggtacatgggtgcttattaaattattaarattaactttaaaaagtttctgtggcttggccatcaaattttgggwaattacagacacaacagtcaaacatgcagcaatcagggtcargttggcctttctgaatgaggatggagcagactgttacggcaggaggtgaatgatacatggcgtctctttctgctaggatagttgggtctgtgagtctatgacaccttacttgtctaccctgtgtacaganmtggtgatggtattgtcccactgtgtatacgtgggtagccgtcaccat

SEQ ID NO: 26175 - DNA, 148 bp, Homo sapiens
  misc_feature 18: r=a or g
  misc_feature 32: m=a or c
  misc_feature 33: m=a or c
  misc_feature 48: m=a or c
  misc_feature 86: k=g or t
  misc_feature 87: n=a, g, c or t
  misc_feature 88: n=a, g, c or t
  misc_feature 89: m=a or c
  misc_feature 104: m=a or c
  misc_feature 112: m=a or c
cagcccagcccctcccargacttcatgggcammttggccgatgtggamaatggaaacaccaatgccaatggaaacctggaagagcknnmccctgcccagcccamagccccamtccccgctgagcctgccccgtcatcagatgcccctt

SEQ ID NO: 26176 - DNA, 139 bp, Homo sapiens
  misc_feature 120: k=g or t
  misc_feature 121: y=c or t
  misc_feature 125: s=g or c
  misc_feature 137: m=a or c
acagaaaagagcattcatctctggcacaagtgatgcaatgcatttcttgggaagggggtgcagtgggcagatgtgctgccttgtctaaaacagattttactgctgtttatagttctctckycagstctaccacagcmac

SEQ ID NO: 26177 - DNA, 102 bp, Homo sapiens
ttatgttatatacactttaccactattaaaaaaattagttatgaattgaaggattacatttacctttttttttcttttttctttttttgagacaaggtctca

SEQ ID NO: 26178 - DNA, 164 bp, Homo sapiens
aatccttgagttaaggagatggcactgagagtcaggtgacaccaagggaactagacttcatagaacagagtacctgagtaaagagagctgcaaagagagagaaccccagatatctacagaatctaccccttgagtattctccagaatactaatcagcatgtacg

SEQ ID NO: 26179 - DNA, 240 bp, Homo sapiens
acttgtatttttgctgcttcgtcttgctgcctgctctctggccgcctcttcaggtggccacagtgtcgtgacatcatttgtttccctccagaggctctgagggagaacgggctccaggcctctcccagctggggctgccggcggccctggcgttcccggcttgtgcctgcgccgctccagtctctgcctccatcgtcacgtggccttctcccaggcctgtggtttctctcttcacatcag

SEQ ID NO: 26180 - DNA, 91 bp, Homo sapiens
  misc_feature 4: y=c or t
  misc_feature 9: s=g or c
  misc_feature 40: r=a or g
  misc_feature 42: r=a or g
  misc_feature 43: w=a or t
  misc_feature 59: m=a or c
ctgyttaasattcagctctgttaactcactcatctttttrtrwttttacactttgtcamgatttctttacatattcatcaatgtctgaaga

SEQ ID NO: 26181 - DNA, 346 bp, Homo sapiens
atatatttacttttgcaaagcagggaaatatgtgaataagaggcatgaatccacaattgctgaagcaaatcaatacatgtgaaggaaaagcaaaaccctatgtaggcctatgtagaaaccttatgcacagaactaaatgcttgttaagtaaaaattcctaatccttatcctcttatgccattttaaattaactctaaaattagtattggaaaaatctccctgatttgttcaaatggctgatgcttacatgtcattttggatccagagatgcaaaatataagagcttcatacataggttcaatacttttctaaactgaattgggtttttgaataaaataccagggtt

SEQ ID NO: 26182 - DNA, 354 bp, Homo sapiens
tgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttactattgtgaataatgccgcaataacatacgtgtgcatgtgtctttatagcagcatgatttatagtcctttgggtatatacccagtaatgggatggctgggtcaaatggtatttccagttctagatccctgaggaatcgccacactgatttccacaatggttgaactagtttacagtgtgcat

SEQ ID NO: 26183 - DNA, 239 bp, Homo sapiens
agggagcaatgatatcctggaagccaaatgcagaagtgtgtcatatcattgataggacagatatgtgaggactgagaatttaattgacccctggatttgacactgtggaagtctttggtgacttccagaacggttgtggtagagtgccaggagtaaaatgcttacagatttcagtgtatggaagggaatgaaaagagaggatttataggtggccattacaggcttgctttttttttttt

SEQ ID NO: 26184 - DNA, 463 bp, Homo sapiens
  misc_feature 395: k=g or t
  misc_feature 396: n=a, g, c or t
  misc_feature 397: b=c or g or t
agcgccggcgtgcagggggccttgggtgccaccgagtccgggaggaaatctaggccgccatccgtccggagactggcacctgtgaccaccacccaacatgtattgaacaagggcttggaggtcctttctctaaggccgcaccgataaacgattaccgactgttgacctcacggccccttcgcttccggccgcaccgcctcgctgcccacgcctgcgcactcaggcgccgcagattcatttggattcaaggttggctctcaacagtgccagctgcactgtcatcctaaagtacttctgtggaagagaacatggtggtgtcactgttgtaccagtgatgacacaaatcccagatctacctgacgggcctgcgagggttgaagattgtgaagcaataknbtaaggtaaacaacaccttgcaagacgggtctaagctcttcagtgtaatagaccctgtttctcagta

SEQ ID NO: 26185 - DNA, 143 bp, Homo sapiens
acaaagattatggcatttcaaaggagtttagaaaatacgtaggatttacgtgggtatacatgcgccatgttggtttgctgcacccattaactcatcatttacattgggtatttatcctggtgctatccctccccctgccccct

SEQ ID NO: 26186 - DNA, 332 bp, Homo sapiens
ataaatagtgactgaaccaatttatgcagtaaatagactaaagttcacagggcacggatgagtttatcaaacttcgttattttatcttgtcatttataacatccatataagcaactagccatataagcaaaattcatagaactactaatgacttaagtgtacatctgttcttgtctccatatattcatgtaagatgcacaacaaaagaaacatcagaagtttataaaaataaatctgactatatgcatcctcatttattccctttagaacctaggtaaaaaatgttgcgaaaacatgggtagtggcgcatacattttgttatccttgaaata

SEQ ID NO: 26187 - DNA, 247 bp, Homo sapiens
tagtagccccagtgtctcttgttatctttatgtccatgtgtacccgtagtttagctcccacttacaagtgagaacatgcggtatttggttttctgtttctttgttaattcacttacgatgatgtcctctagctgcatccatattgctgcaaaggacttgatttccttcttttttatggctacatagtattccatggtacatttgtaccacattttctttatccagtccaccattgatgggtgccaaa

SEQ ID NO: 26188 - DNA, 477 bp, Homo sapiens
  misc_feature 7: y=c or t
  misc_feature 201: s=g or c
  misc_feature 202: n=a, g, c or t
  misc_feature 412: n=a, g, c or t
  misc_feature 413: d=a or g or t
  misc_feature 426: r=a or g
  misc_feature 472: w=a or t
aactctytaaatatattgacatttcaacctaagaacaaccctttgaggtaggtactaagagatgagtaaactgaggcacaaatacatgaaataacttgccccagaaatatagccagtaggtggcagagctggaagttaaacccatatggtctggttccttagtccctagtgattagaacacactatactgcctcactgtcsntttctctgtcaaataatcgttgtccattttccctttggggtctttttttttcttttcaagataatactaagcaaggcagttacctttttttggaaggaagcagtaaggactctagactttcagcataattttcctttaacaatttacatgactggtaaaaattttatgtaagtagttctgtaaaaggaaaagcataaaaggaatgaaaandctcttggggagartttaattaacattttctcttgtggcttgttttctgtggttcttggwtgtct

SEQ ID NO: 26189 - DNA, 223 bp, Homo sapiens
  misc_feature 18: w=a or t
  misc_feature 20: w=a or t
gattcttcattttttgtwtwtttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctgt

SEQ ID NO: 26190 - DNA, 419 bp, Homo sapiens
  misc_feature 375: n=a, g, c or t
  misc_feature 376: k=g or t
  misc_feature 377: k=g or t
  misc_feature 378: s=g or c
cactttacggctgggctcacccttcaccccaagacagctttgatcactgggaagtttccacaaacacagaatgaatgaggaagaaggtgattatattttcggtgtgatccacgtggacgagaggtgttgcatgtttttacaaattgaagatctgtgacaaccctgggtcaagcaagtctatcagtgccattcttccaacataggtgtatatgctggagcagctgtacttaagtccagaaataagaagatatttgatctgaggactcaggagagagcatggctgctgcatagatggtgccttccatcgcttgacataaggaagcccagccaaagcctgtgtcttgggcagcctgggagctctcaggatggcttgankkstcccacatggcctgggcctgttctccttcccctccagctct

SEQ ID NO: 26191 - DNA, 407 bp, Homo sapiens
  misc_feature 339: m=a or c
  misc_feature 382: r=a or g
  misc_feature 390: s=g or c
ttcttgtagacaacagatcagtggttcttgtttttttttatttattcagccactgtatgtctgttgattgaagagtttagtccatttgcattcagtgttcctattgataagtaaggccttactcttgccattttgttacttgttttatggtcgttttgtgatcatcttttccttctttccttccttcctgtcttctttttagtgacggtgattttctgtggtgatatgatttagtttcttactttttattttttgtgtatttgttgtatgtttgtaggtttgcagttaccacaaggcttgcaaatactctcttgtaatctgttattttaacctggtaamagcactgtttgcataaacaaacaagcaagcaaaaagtaaacgrataaaggstccatgccttaaatata

SEQ ID NO: 26192 - DNA, 389 bp, Homo sapiens
  misc_feature 335: n=a, g, c or t
ctacagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgangccaaagccaataacacacagctaacacacagctcccataaccgctgattctca

SEQ ID NO: 26193 - DNA, 90 bp, Homo sapiens
  misc_feature 9: s=g or c
  misc_feature 43: s=g or c
ctgcctgtstggcctcccagagtgctgagattgtaggcgtgascaccgtgcctggccccaataattcttttttttttttttttttttttt

SEQ ID NO: 26194 - DNA, 199 bp, Homo sapiens
tacaaacaaccatcagagaatactgtaaacacctctatgcacataaactagaaaatctagaagaaatgagtaagttgctggatgcacacaccctcccaagactgaaccaggaagcagttaatccctaaatagaccaataacgagttctgaaattgaggcagtaataaaatagcctactaaccaaaaaagcccaggccaa

SEQ ID NO: 26195 - DNA, 162 bp, Homo sapiens
cacaccgccatgttctctaggtacattcaggataccaggtcaaatttcagcttcctgggtgccccatagtctctcctcccttcaagcttggctcatgttgttccatcttcctggcatgctctttcttctctttttccagtagataatgctactctcggcgcc

SEQ ID NO: 26196 - DNA, 213 bp, Homo sapiens
  misc_feature 132: m=a or c
  misc_feature 135: m=a or c
  misc_feature 212: r=a or g
cttatggctttgacacattgctaggtttttgtcatgaagtgggatttttgatttggagggaatgcttcttggcttctagctagagattacatacaggtctaaagctgcccagctgaagcatctggtcctcamtgmcgtctgctttgcagtatgtgacaatgctctagcgtaggctgactttgccttacctgcaggcagacttccaagaggarg

SEQ ID NO: 26197 - DNA, 203 bp, Homo sapiens
attattcttttattataaagcactaagttatgtcgtcttaaaccactttttgtttagaatactttctatgcttttgagtaaagatgaaattatatgtcttttttaattttttaaattgaatgatgttcaagggaaaagctacccagtttccatttgtgtgaaatttatgtatatttttggttttgtcttgtatatgagtaagg

SEQ ID NO: 26198 - DNA, 365 bp, Homo sapiens
  misc_feature 141: w=a or t
  misc_feature 142: r=a or g
  misc_feature 149: m=a or c
  misc_feature 152: r=a or g
  misc_feature 179: s=g or c
  misc_feature 274: r=a or g
  misc_feature 316: n=a, g, c or t
  misc_feature 318: k=g or t
aaataattttggattacccaaaaggccacagtcaggtagctctaagtctctgtatctatagggtttttgttctttaattatctcacagaaccccacggacatatcgtatgtgtacagtgggtatgccccgctcagtgtgcwrgctgggmccrgctgctttcccggcctggctggcggasatcgaggaggtcctccgcatcctcccagggccccactttgaggagcggcagccactgcccacagggactgcagaagaaacgtaagtcccagtccrgcatctacagataattatgtactgttagtgtggttttcaggnaktgtacagttgctttgtaaaatagtaaagcacttaggagtcagaatag

SEQ ID NO: 26199 - DNA, 331 bp, Homo sapiens
ttttaaaaggctgtttctcttccaatctcatgcgaatttttttcctccttgaaaattcaagcaaccagttgctctcttcacatccagcctttctcatcactgtacttttctgaccatccaggcatttcccttgttcactgagtactggcttgttggtgtcgccctccccatttcctgctatcttgaatgacttgaacatgtttaggggtgattcattcaacaatctaatttcaaggccacctgcctttctcagctcccaagatttgctgtgcccttcactgtggcagtagtctgccttgggccagaccctgcacattgtcatcaggtggac

SEQ ID NO: 26200 - DNA, 157 bp, Homo sapiens
cctcaggttgtattacaggctatgccagctactgatcatttgtttttgtttaccttgtgtttttgtttctcctggctagtgggtgggcttcatctgctgatgtgagtactattctaggtactgggcctagtgaaggagaagacaaacaccccagtat

SEQ ID NO: 26201 - DNA, 293 bp, Homo sapiens
cctttatacttaagccagcttgaattgggtttttcttatgtacagtcgagagtcatgatgaatacagtgtttctaattaacagtgttagttaaactaagtatacagcactggtgatttctgtgtgtcagtgtcatttcagcctctttgttgtcttaagaggcccacttagtggtttgactgtcccttgagagaatagaaggtgagcttggagagttttcagagacagtgacttgatttaaagaaagtaggatcatagtagtaatactcctcacatccacgtatcccccgataa

SEQ ID NO: 26202 - DNA, 336 bp, Homo sapiens
tgcaacaccttaagtggacaggactgggaggtcttggtggttggagccaacgtgggttccctgcggctccttagtcacctctgatagcagattgagggaggaaaacaggtaaggcatgaggaaatggccaggttgggttaacccactggtttcaaccagttcaggaatgaggttatttggccatgactggctgatcttgagctcaaggatctgcttcaaatgcacacaggcctagttgaagtttaaaccccagcaaaacattcctccctgtaaatggaaaatcctacttctacccccaccctgccctgttttttgttttttttttccccaagatca

SEQ ID NO: 26203 - DNA, 270 bp, Homo sapiens
  misc_feature 7: y=c or t
gtatttyttgatagagacggggtttcaccatgttgctcaggctggttgcgaactcctgacctcgaatgatcccccaccttggcctcccaatgtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaat

SEQ ID NO: 26204 - DNA, 258 bp, Homo sapiens
aaactgaacagaatgccaccagcttgggcttattctgcatgcataattatgaacattttcccatctcttgtgaaaattctcacattcatagaaagatagatgcaccagtaaaataaatacctgtaaataacgataataatttcataatatatgcttcacctagatttaccagttactaatattttgctacagttttattttctcacacacttttgttgagcatctgaaaaccatatacatgatgacagttcacccggg

SEQ ID NO: 26205 - DNA, 341 bp, Homo sapiens
taccttttaaaatctcttattctcacttcagtgtgttttgaaaaggtcaggagatagttacgcatgtggtcaatccaccattttttaaccccaggcaaataaatcttgttctaaaataggcattaactgaacgtctggatgctcttcttctggaaaaagcagagactgagcaacagtgtctttctctgaaaaaggaaaatataaaaatgaagcaagaggttgaggtaagtcaatattttagtgttcttttcttttttattaacatatagtgtagtcattaattttagaggtaagactttaaaaagcatctaatctgattaatattttataatataaacaaa

SEQ ID NO: 26206 - DNA, 213 bp, Homo sapiens
agagatggttcgttttccacttacggctaatcagctagctaacgctcgctcctccttttcaagatgagaaaaatatctgcttgtctccaaatttgaatattttacaatttaaaatggaaactgtgggtgacagaacacgttgaggatccgactcagcacctcatccacgtgggcccagagcgggacggtccgtgtccgcagcggtctcctgga

SEQ ID NO: 26207 - DNA, 159 bp, Homo sapiens
ttgttccagttctcagtaactatctcaccttcacgtcaaacttcctcaactgggacttcactgtccatatcactgtcatcgtattggttacagccatttgaatagtctctaggaaattccaaacttttcctcacttttcttcttcttcaaaaccctcca

SEQ ID NO: 26208 - DNA, 370 bp, Homo sapiens
ttcagactaaaattttaaaaatccagtataaaactttttggatcacctaactccttaattcttgctagagttctgcacagtgggtatccttctagccttagtgtaactcttggcattatatagcttgttttccttatccaaatgacattaagtcctttgagtcacattggaggttctgctctcagacctgagcccttgacttctagttgtgctaaacttgtcctaccagtgatgcagctagtagtacaaacaaaagcaatcacagatttcagtcgtaaaaacaagaacagctgaaatacaagctgtccatttacttaaaaccttttataggctttactagacataaagttcattaactttttttggcagc

SEQ ID NO: 26209 - DNA, 139 bp, Homo sapiens
agtttcccttctttctctcttaatcagaagagaggggaaccatgctcagatcaaataggaatgtctgtttacacttttgtaatcagtcactttattatgttaattctagttctacctatgttgtaattttaatagaatt

SEQ ID NO: 26210 - DNA, 186 bp, Homo sapiens
tcgtctgttctcgcattgctataaagaaatgcctgagactgagtaatctatatagaaaagaggtttaattggctcacagctccgcaggctgcataggaagcatagtggcttctagggaggcctcgggaaacttcaattatggcagaaggcaagagggaagcaggcacatcttacatggctggacaa

SEQ ID NO: 26211 - DNA, 143 bp, Homo sapiens
agttttgctcttgttgtccaggctggagcgcagtgatgcaatctcggctcactgcatcctccgcctcccgggtgcaagctgttttcctgtctcagcctcccaagtagatcagattgcaggcatgtgccaccacacccgggcta

SEQ ID NO: 26212 - DNA, 227 bp, Homo sapiens
agtaccaagtcccttgtctatgttcttgtctttcagaataatttttatataaatatatatatagtgaagaagttttttttaatttttggatgggatattcgcaaatatctgtattatacactaagctattacaatggtacttaaaataatgtaaatttgaagtcattgttataaaataataaagtggagattacttaagtatttaaattatgaaagaataatgcagc

SEQ ID NO: 26213 - DNA, 175 bp, Homo sapiens
  misc_feature 13: r=a or g
  misc_feature 175: n=a, g, c or t
caacatgtttgarattgcctccttcacctatcattacctactcaccaccacttgacctcagtgctgactcaatgctcgttagttgatggtgctgtacctgtcatcattgatctgtgcaaggccccttctcatttcattcactaattcatgtatttctttgtatccccccgaaggn

SEQ ID NO: 26214 - DNA, 196 bp, Homo sapiens
  misc_feature 117: s=g or c
  misc_feature 126: k=g or t
  misc_feature 138: s=g or c
  misc_feature 147: m=a or c
  misc_feature 189: s=g or c
ctcttttgtttttctccatgaaatgtttgcgcttctaaaatactgggtcctttgtccttcatctctcactgaagcgaaagctccagagtagctcccttgacgagtaccggaagcgasagtgtcgakaccacctcagastaaacctgmaagtttctgaccaggacgagaagcaccgtggctgagtctgtsagccaac

SEQ ID NO: 26215 - DNA, 278 bp, Homo sapiens
  misc_feature 95: s=g or c
  misc_feature 144: m=a or c
  misc_feature 145: m=a or c
  misc_feature 147: w=a or t
  misc_feature 155: r=a or g
  misc_feature 174: y=c or t
  misc_feature 275: n=a, g, c or t
  misc_feature 276: k=g or t
  misc_feature 278: k=g or t
cagattttgtactgctagtgtgtagaaacacgactgatttttgtgtgttgattttgtattctgcagccttgctaaatttgtttattagctttaasaggctatttttggtattctttagggctttctacacttatatcacttgcmmawtagagatrgttttacttcttcctttcyaatttggatttattttatttctttttcttgcctgatgggtctggctagaactgccaatactatgttgaatagaagtggcaaacacaggcatccatggcacnkak

SEQ ID NO: 26216 - DNA, 310 bp, Homo sapiens
tactacaatttatttgaccattctcctatcaatggacactttagttgttttagtacacctccctgtcccgtcacaaatcatactttgtaatgtttctggtggatatttcttgtaaccttcacaagtttatctgtagagtaaatttctagtttcaggattactggattggaagatgcatgcatttaaaagtgtgattgctgttgtcaggttgtcctccaaaagtgtcccctcagtttgtacctgtatccataggtttggagagtgtctgtttctccataccgtctcatctgaaatgaaaatttttacatgt

SEQ ID NO: 26217 - DNA, 113 bp, Homo sapiens
ggggtacaaaaattggccgggcatggtggtgtgagcctgtagtcccagctgctcaggaggctgggacaggagaattgcttggattcaggaggtgggggttttagtgggccgtg

SEQ ID NO: 26218 - DNA, 351 bp, Homo sapiens
tcataccttgtggtatttttattccagctttaccagtgaggaaaccgacactgtgaggttagtaatcatcagagctcaggtttgcatcctgaaagaccacagagctgccaggtgcggtggcaaaacccatctctgctgaagatacaaagattagccgggcgtgggcgcgcacctgtggtcctcagcctcccgggaagctgggattacaggcatgtgccaccatgcccggctgatttttgtgtttttagtagagacagggttttgctatgttggccaggctggttttggaactcctgacctcaagtgatccacccgccttggcctcccaaagcgctgggattacaggcatga

SEQ ID NO: 26219 - DNA, 119 bp, Homo sapiens
caaaaattagccgggtgtggtggtgcacacttataatcccagctactcaggaggctgagacaggagaattgcttgaacctgggaggcagaggtcacagtgagccaagatcacgccatcg

SEQ ID NO: 26220 - DNA, 175 bp, Homo sapiens
  misc_feature 98: r=a or g
  misc_feature 99: s=g or c
aaaatacaaagaaaatcagctgggcgtggtggcgggcgcctgtggtcccagctatttgggaggctgaggcgggagagtggcgtgaacctggaggcggrsttgcagtgagccgagatcgtgccactgcactccagcctgggcgacagagcgagactccatctcaaaaaaaaaaaaa

SEQ ID NO: 26221 - DNA, 371 bp, Homo sapiens
  misc_feature 62: m=a or c
  misc_feature 348: r=a or g
ctgcccttttctctggtagctcgtcctgcagacacaggggcttctccttccctggccactcmtccacgtccactgtccccagtctttcccaacactgtcctggggaacctgccaaatcacagctcttgatttccttatgaggcacaaaatacttgctccttaatcttttgttgacttaagtttttatccattgatatattttcccagcaagtgaagacaacttagttataataaacattcacctccagggtcttggagtttgcagccccctctcattctctcacaaagccaacatttccttcacctcctgatgtgtccctggccctgaaagcaccctggggatactgrggcacagcacctatgacctggcg

SEQ ID NO: 26222 - DNA, 147 bp, Homo sapiens
  misc_feature 132: r=a or g
  misc_feature 133: w=a or t
agggaactacaatgtgaagaagtccttcacatcccttgtaagttgtattcctaggtattttatttctctttgtagcaattgtgaatgggagttcactcatgatttgctctttgtttttctgtttttggtgtrwaggaatgcttggga

SEQ ID NO: 26223 - DNA, 146 bp, Homo sapiens
  misc_feature 39: r=a or g
  misc_feature 53: s=g or c
  misc_feature 54: s=g or c
ttaaatgaaataatacgtgtaaattaattaacataaggrttgtggaggatgassgagaggatattaaacagtccctatccttaatttccttacccttactctctccctggctttgatcactcactcttaatttcttccttcctgtc

SEQ ID NO: 26224 - DNA, 159 bp, Homo sapiens
  misc_feature 26: k=g or t
tttatatatatgtttatacatttgtktttccttgtgaaatttttagttgtggtggaatttttctggtggaggggggcagacattaagcatataaacacaaataaatacatagttacaaaatctggaaagtactatggaggaaaattacagaccaccccc

SEQ ID NO: 26225 - DNA, 317 bp, Homo sapiens
ggaaaagaacctccagctatttggaaagtacaaaaagctttattacagaaatttgttcctgaaattcgagatggtcaaagagaatttgctgctacaaatagttatcttggatattttggagatgcaaagagtaaatacaaaagaatatatgtgaagttcattgaaaatgcaaacaagaaggaatatgtcagagtgtgttctaaaaagccaagaaataaaccttcacaaactatcagaactgttcaagctaagccaagtagtagcagtaaaacttctgatcctctagcatcaaaaactacaactacaaaagccccctc

SEQ ID NO: 26226 - DNA, 270 bp, Homo sapiens
gtattttttgatagagacggggtttcaccatgttgctcaggctggttgcgaactcctgacctcgaatgatcccccaccttggcctcccaatgtgctgggattacaggcatgagccgccacgcccggctaatttttggtatttgtagtagaaacggggtttcaccatgttagccaggctgggtgcgaactcctgacctcaggtagtccacccgccttggcctcccaaagtgctgggattacaggcgtgagccaccgcagtccggccctaat

SEQ ID NO: 26227 - DNA, 468 bp, Homo sapiens
tctataacccatggttcccagaagaaggcttgccaaacctagagctctgggaacaagtggggagaaatcttaacatcatgcacaagggcaacgggtcccagtaacatctttaacgttatgggccttagtcagggctgctttgtccccactctacacagaagagcctaaaaagggaagggaggaagaaccatcatctaccttaccacctcctccttctccctcagccccgccgttaccgagtaaaggtgccacagaggagacaaatattttccctgagccctctctcccaatatattggaaaaaatacaagggatacactactgttatgggaccctgtcttagtcaagtggaattagaagggagctcttgacctgcccagtgatgcaagatcaacaagacaatcagtaagaaacgtacaaacattaagaagagcctattcagaaaagacagtcttccagttaccttata

SEQ ID NO: 26228 - DNA, 433 bp, Homo sapiens
  misc_feature 139: r=a or g
  misc_feature 356: r=a or g
  misc_feature 357: n=a, g, c or t
ctaataactgtggaaagcttaccctggtttacatggggaaaaggattgttcactgtgctgaaaagaaaactggtctttggaaatggatcttgtttcggtagttgttgtgagtccttgggcagaatggttaactaccttragcctcagttataaaactatgaaagacgtttacttcctggggttgttttgatgatttagtgaaataaagatacagaaatttccagcacatagtagattgttaagtctgtttgtattacatttctcctcataaagtttcttttttcttttctttttcttttttaaacatttttgtttgagacaggatcatgctctgttgcccagactggagtgcagtrncatgattgtagcacctggcctcaagtgattctcctgcttcagcctcctgagtagttgggactacaggtgtgtgtca

SEQ ID NO: 26229 - DNA, 178 bp, Homo sapiens
aacactgaaagacatgggctccttctcagatcttagagaacaaaagaaagaactaaatggagatgtgggaatcacaaggccatagtttagggtctcgcagtgccattggcaacaaagcctgagagcctaggcgatagaggcagaacacccagaggagaagccccttccccttgcactg

SEQ ID NO: 26230 - DNA, 346 bp, Homo sapiens
  misc_feature 226: r=a or g
attctgctggtttctgctgagcccagttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagccattattatggrgttgtagacctggtgtggggagtatggggatcaacctcagaagcctccagagagagattggtggactctaggagtgtcgatctcagactgaccatcgctggggccacatccaagcagcag

SEQ ID NO: 26231 - DNA, 117 bp, Homo sapiens
ccaccctgcctctgcctcctggcaaccatcattctactttctgtccctatgattttgactactctatgtgccacatttaagtggaatcatatagtatttgtcctttgtgactggcac

SEQ ID NO: 26232 - DNA, 118 bp, Homo sapiens
tttataatacatggtttctcatggagcttgcagaataagtgacagaggctgacaaatatttccattgaattgtgtgctttggtaaaataaagaagcattactcattccaagcaggggg

SEQ ID NO: 26233 - DNA, 150 bp, Homo sapiens
  misc_feature 110: r=a or g
aaaaacacccataagtaagcaaatctcctcaaagatgtttattgcagccccatttgtagttgcaaaaatttagaaacaaagtgaatggcagtaataggggaatggctgartaaattgtggtccatccaccccagggaagcttatgtggca

SEQ ID NO: 26234 - DNA, 384 bp, Homo sapiens
  misc_feature 105: m=a or c
  misc_feature 114: s=g or c
  misc_feature 278: w=a or t
  misc_feature 362: r=a or g
  misc_feature 366: r=a or g
cattcagattcattcatgatgtaatataccacctataagctgatttcgacacttaagatcaacagcctatacttttctttcgaatgtcataccaattcagtttamctgcatgasaactctgttgaatatccaatatgtcaacttaaaagtgcaaaactgtgctcctgatgttcatgcctcaaaccagtctcttgtgtactgttgcctttttcagttaatgaaacaatttttgtgtctcttgggccaaagattttggctagccatccttgacttttacwcttctcacctttggcctattagaaaatcatgttggccaggtgtggtggctcaggcctgtaatcccagcactttgggaggctgarggargcgcatcgcttgagctca

SEQ ID NO: 26235 - DNA, 231 bp, Homo sapiens
  misc_feature 49: k=g or t
  misc_feature 68: s=g or c
cttaatgctcagtgatcctttcttgaattactaacttttattttgtgtkgatttttagctacctttasaaagcgttttgatttaaagcagtagataatttttatctgactgtaaaataagacatctagcattcagtcttgaagattcttagtttagaagcttaaaagtatgcaattctcagtaaattctgatgcttagtgtccaagggttttcctgctatcagggtcggcg

SEQ ID NO: 26236 - DNA, 395 bp, Homo sapiens
  misc_feature 381: m=a or c
cacttagtcaactcctgtcaaaatgaaggtgaactggcatggcccgatcactgtccataagggagaaagtggctcattcctggtagaagtatgggtggttatcatttcaaaattattgtgattctcacctccctccccacctcagtgttttgtctgtccgcgcccaagaaagataagcaagtatttcctgctggatgggggttggcaggaagctgttaaagatttatgccagagccttgcaggatggagcacctctgggacaactaagagccaaggcccaccaaggagttttccacccgtctctcatggtcacagcgctagtcattcatttttgagaagttgcttcttttacatcagaaaaccagtcaatcatatggagamttcttttgtgatga

SEQ ID NO: 26237 - DNA, 480 bp, Homo sapiens
  misc_feature 265: k=g or t
  misc_feature 423: r=a or g
tttaaagtttaaagtttcacccttatctcttatctaactaaaagggcctttggagaaattacttccatttggtaaataagaaaatacagtgttgtgtttatcatcttcatgtatcttttccttacttctgtttccttacttctaacgcagggagtatctgtcaactttacttgacctataaagtgctaccagcatttttaaagtaggaaggtaaatcccttagagtgggaatctgtggttccttttctgtttctttttgactgtkacagagttgttcacgcatccatttcaggtttctgattggtgtgttctgtaatagcaggtacagtaaaatcttactagttcagtataattgagaaaagatcagactgattttttttaatgaattggaaattttcactaagtgaagacgtaataattttragtacatataggacatattaggtaaaatgtgtgaactagatggcctctagactctcc

SEQ ID NO: 26238 - DNA, 195 bp, Homo sapiens
ttacaagaaattgaccatccatgagacagtataatcttatatcaaatactaatttttcacctgggccattttatttgatccttaagaccctgtatgataactggaatgcctgtagttccagctactcaggatgctggagtaagaggattacctgagaccaggggttcaaggccacagtaagctataatcacacca

SEQ ID NO: 26239 - DNA, 520 bp, Homo sapiens
  misc_feature 366: y=c or t
  misc_feature 479: k=g or t
  misc_feature 483: k=g or t
atttatagtcctttgggtatatacccagtaatgggatggctgggtcaattggtatttctagttctagatccctgaggaatcgccacactgacttccacaatggttgaactagtttacagtcccaccaacagtgtaaaagtgttcctatttctccatatcctctccagcacctgttgtttcctgcctttttaatgattgccattctaattggtgtgagatggtatctcattgtggttttgatttgcatttctccgatggccagtgatgagcatttttttcatgtgtcttttggctgcataaatgtcttcttttgagaagtgtctgttcatatcctttgcccagttttggatggggttctttgttttyttcttgtaaatttgtttgagttcattgtagattctcgatattagccctttgtcagataagtaggttgcgaaaattttcttccattttgtaggttgcctgttcactctgatggkagtktcttttggctgtgcagaagctctttagtttaattaga

SEQ ID NO: 26240 - DNA, 336 bp, Homo sapiens
ttcccagacacttcatttttagatcccctttaaattaggagggaaaaacaacataagcataagagcatccccagcagcgatgttcattcagtgcctctgaaggctggagggctgcttgttgctgggtgagactcggaggggaaccgactcagggtcaggaatgatgacatcccacggtgggtccacagtgaagaatcttccccgctccactgtgggacgccttaacagcccttacttccacttacgctttgcgttatctcctgaaaaataaaatggagaccacaaattccttcttggttagaggaatgacacaactcatttatgacatgaccccat

SEQ ID NO: 26241 - DNA, 166 bp, Homo sapiens
tattaatgtaataacttctgtgtatggtttatttccatgaaaaggaagtacaatcttgatgattttaaacctttccctgaccatgtatttttaaagtaatgtgtgagatctttgtaattctgtgtaacctacagtactctttacagggataattttcccttgaatt

SEQ ID NO: 26242 - DNA, 292 bp, Homo sapiens
ccctcctttagtaattagataattatgtataataagcacattaattatgtgcaacagctgccgttgagtgtgtgcatgtacaactgcttgaaaacagcttgtgagttcactattaggtccatgaaatttttctccttggcaggttttcactattaatttgcttgacaaaggatagatacattttccatgtgtggaggtaaaagcagtgcagtgagctaaaaagttagcaaaggtgaagtggtcctaatctgcggccctggtacacttagataggcatcattgcctttcctct

SEQ ID NO: 26243 - DNA, 155 bp, Homo sapiens
ataagacatttttttctgagtatgcagtgctaaactgtttcttttcttcaagcattttaacaaagatgtcactacggtgtcttctggcatgtatagcttctgaataataacagattgacaatgcagaagaaaagatcattaaacttgaagacaaa

SEQ ID NO: 26244 - DNA, 130 bp, Homo sapiens
  misc_feature 19: s=g or c
  misc_feature 20: s=g or c
  misc_feature 104: b=c or g or t
ttgaatacacctttgtgtssttcacacagcagtttacatccagtgctgttaccttcagatgtatttgaccaaccacaacctgtaggtaacaaaagaattgaatbccatatatctaccgacatgccagcta

SEQ ID NO: 26245 - DNA, 149 bp, Homo sapiens
ccaacatcatttacattacttgataaaaagtgggcaaaaggttaaagtattctgccacttttctgtttcatagctctcagctaagaacagtataggataccagtgggtccgaaacaggtcccatccacatgctccctccttttcccttc

SEQ ID NO: 26246 - DNA, 208 bp, Homo sapiens
  misc_feature 116: y=c or t
  misc_feature 119: w=a or t
catttttgatgggacatggtttttcattgcatgaaaattgatattttttgtgaaatttattataatgtatttaaccagtctcatgttagacatataagttgtttcatttttctgtygtwgatgagacagtgaattatcttgttcctaaagcttggtgcatttgtatggttatttctggggtggagattcctagaagtggagtgggata

SEQ ID NO: 26247 - DNA, 350 bp, Homo sapiens
  misc_feature 122: s=g or c
  misc_feature 304: s=g or c
  misc_feature 327: k=g or t
  misc_feature 334: s=g or c
gctctttggctctgaccatgccagcaggcttcacggttctcgttttccaaagaggaacacagattcagcgagcggctgctggcttctgacccattttgatgtcagggcttggcacgtaggasgtgttcaatgttgatcgatccaaggtcgtgcacatagggtctaagacggaagagaacttcctgcccctcttggagcttctattttagagggagacacggccagacaggtctcgaactcctggcctcaagtgatccgcacaccttggcctcccaaaatgctgggattccaggcgtgagccacsgcgcctggcctggtatgtaagtkttggtastcttattacaacccac

SEQ ID NO: 26248 - DNA, 183 bp, Homo sapiens
cagcctcccgagtagctgggattacaggcacccgccaccacctggctaagttttgtattttagtagagatggggtttcaccatgttggccaggctggtctcgaactcctgacctcaagtgatctgcccaacttggcctcccaaagtgctgggattacaggcgcgagctaccacacctgacacg

SEQ ID NO: 26249 - DNA, 450 bp, Homo sapiens
  misc_feature 169: m=a or c
  misc_feature 182: m=a or c
  misc_feature 183: s=g or c
  misc_feature 219: m=a or c
  misc_feature 344: r=a or g
  misc_feature 352: s=g or c
  misc_feature 353: v=a or c or g
  misc_feature 412: s=g or c
  misc_feature 413: m=a or c
  misc_feature 423: k=g or t
taactcgatgaccatgaagaagacttcctcatttcatcacatcctgcatgttgactaggatcacagctggcagctagtctccttccttccagttcagaatgaatggactaaacatttacttagtggagagttatgcaaaattttgatactatagaatgtgttcacctamcgggttgagccamsaagaggctcctaaatctaagtctgtatgttaaatamatagaagagacgatttagcatcttacaatatttctgtcggactcacttttggagttgacctttttgatgtggcgggtaggcctgtggaatttgtgagaaatccttggaaattctttgtgcttaaratgaatasvatcatattttgtggctccttgaggtgctggggttggggacctgggccagggaaaatcasmtgtgaaacckccactcagtctttactttcctttcttc

SEQ ID NO: 26250 - DNA, 227 bp, Homo sapiens
  misc_feature 145: s=g or c
  misc_feature 212: y=c or t
ttatgtgcacactcacacatgcacacacacacacacatacacactcttctctaaccagtggaagcaaagccacccttcgggaagaaaacgtcaccttgccatacattctgtttcaacagtgggtacacccctaacagagccagtsccaacaaaacattttgaatggacttaggacccatgaggttgtggctggcttaggcagcaacctccayattcccacaggcatt

SEQ ID NO: 26251 - DNA, 324 bp, Homo sapiens
  misc_feature 244: s=g or c
aggggttaaataatatctagtcctgcagtcaatatttgtccttatatactggtaggcgagtttcctgatatgcatggctgcattttctctgttcctgcctacctcttcaactttacctgctgctgttttctctttgctttctaggttccatctgcctctctgttttctaggttcctccgccacctgagttcaaacgattctcgtgccccagccacccaggtagctgggattacaggtgcatgcsaccacgcccagccagtttttgtatttttagtggagatggggttttgctctgttgccaggctgatctccaactcctggcct

SEQ ID NO: 26252 - DNA, 185 bp, Homo sapiens
tctggaaaaggcaaaactatagggacagaaaacaagtcaatgataggcagtgggcctgggggggaagtgattttttataaagaggcatgaggaaactttaggatgacataaatgttctatgtctttatatggtggtgggtacatgactgtatacttttgacagaggtatatctaaaaggggcacg

SEQ ID NO: 26253 - DNA, 204 bp, Homo sapiens
ttatctaatttgtaacatattcatgattataagaaattcatgattaacactgataggtgagatctggcctggtcacaaaatcattactgatgcattcacttaacagattttttttttaatgtctgtgggcacataactagaaaattggtcttctttctaaggggctgacatataaatgggggaaataataaccaggcaggcgtc

SEQ ID NO: 26254 - DNA, 264 bp, Homo sapiens
ttccttttagaagtcctgttcccagcaggcctccatggcatccaagatggcgggaagtgcaaatgttatatcttgacaatggtgatggatacatggctatatacattcgttgaaagtcagctgtccactaatgtgactgcattttatagtatgtaaattatacctcagtatagttgcttttaaagaagatgaagccagaggacaggaaattggtaaacatagtgctgtcggccatgtcccttcagccacagcactgccaacact

SEQ ID NO: 26255 - DNA, 361 bp, Homo sapiens
  misc_feature 12: y=c or t
  misc_feature 210: m=a or c
  misc_feature 320: m=a or c
  misc_feature 327: y=c or t
  misc_feature 354: r=a or g
ataatatgatgyaaaacataaaacagccactactgctcttaaaagactcattaaggaatgtttctctgtttcaataatgctctgtgccttcatgctctaggtcatcttcctctctactctctcacattttctcccattttttagttccaaagccacctgatttgcaatctcattacctaaactatcattactcaaatactattataatamtggcctcttattcctgaatatctgctacttgttaggcaccgttcttggtgctcttacatgattttatcttgatcacaagatcagtattgttatccctgcttaacagatgmggcagtyaagcaatcattcactcagggttgcatractagaa

SEQ ID NO: 26256 - DNA, 67 bp, Homo sapiens
taaaaggactagagtactgattcatgctacattgatgagactttattttttttatttatttattttt

SEQ ID NO: 26257 - DNA, 357 bp, Homo sapiens
  misc_feature 243: w=a or t
  misc_feature 313: r=a or g
catagcatgacataagacaacttgaaaagaatactggtttttgtaacaggttatatcatgggcagtagaacacttgaatactggatggctcctcccaagatgcttaggttagagaaatagagtagaatatagttactctgtatctgcaggggtaaagaaaggccaagataaatattttccctcacttagacacagcaataatataatttaaaccatttcacttctgatccttaagttgaagawaaagactgatcattttatcatttcatttattaaactgcaaaatatatttttaccaaaatttattattgaracaaatttcatggttatccttgacctattgtaattctcttttaa

SEQ ID NO: 26258 - DNA, 295 bp, Homo sapiens
cttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgagatgtataaaagagctcaaggaagaactcggattggaaaaaagaattttaagaaacgatggttctgcttaacaagcagagagctcacctaccacaaacagccaggcaaagatgca

SEQ ID NO: 26259 - DNA, 298 bp, Homo sapiens
taattgttgacattgtaacaggtaatgctattgcctgacttactgaagagctacagctgagtgaatgtacacggtggaaatcttgtggatttgagcttttactgggttagtgcagcttcttcggtaccccttgcagtttccctggctgacgaatcatcagggaattatgtttaacatctcaaagaaccagtagcaacttcatatttagagagatgcattaacaaattattggccacctttgtgtcagacactgttctaggtacttggaattcattggttgatagacaaattatgtggc

SEQ ID NO: 26260 - DNA, 354 bp, Homo sapiens
tgctcttgagaaatgtgcagttctaggtgtaaggtatttgtatagatagcatattctgtctctttcatcttcactctagaacagactggcactgttgacacttcaggctacataatcctttattttgagtggctctcctatgcattgtaggtttagcagcgtccctggcctgtacacgctagatgccaatagctccttaccacccagttgtgacaataaaaaatgtctccatgtattgtcatttgtcccctgggaggcaaaattgtacctcgttgagaaccactctcctagaatgtaagctccataaagacagagtttttaaaaactttgttttactcctgtatcttcagcccc

SEQ ID NO: 26261 - DNA, 457 bp, Homo sapiens
  misc_feature 408: m=a or c
  misc_feature 417: y=c or t
ctgaagtctctggcccacacttgatggccctaagttgcccacaggcatcttgtgccataaactgtcccttcagccccatgctatatgccattagagtgcaattgctggctgcatattggactctcctggaaacaggctggttgtcaccggccctcagcctgtgactctccataccagctgcccattatcccttgggtcttgaaatcacaccctaaaagttcaacatagccactgaggtttccttgctgtagcatagagccaaacctggcatatttcacctataggaaaaagtctcccaccaccaccctcagccccttgctaaataccatggtgctggtaaaagtcatcccccttcccagaccctttggatatctgtggaagcccttgcaatcaacagagtgaagagtmaagggagtytctccactttatagatggtatcactaccattgtatgtgat

SEQ ID NO: 26262 - DNA, 264 bp, Homo sapiens
agaatcaccaaactcatatttctgttcaggtctgaccatttttacaattttcatttgcctatgtaaatattacccacatattatagttcataatttgtgatatgtcagcagatttcattgaacttgagtcttaggtcacaatagaactaacaacatattggcttcattctagtccaatttgttttcttttatgcctacacaccaagggtgttcgcttgaaaacaagtcttccttcacctcctgctttttctcctcacctgcaaa

SEQ ID NO: 26263 - DNA, 114 bp, Homo sapiens
  misc_feature 62: m=a or c
  misc_feature 110: w=a or t
  misc_feature 113: s=g or c
acagtaataaaagaaagcctataagaatacctataagggtaggcacatcaccactgagagamaaaaaaaaatcaagggagtttatgttaaagtgagccctatttaagagwtasc

SEQ ID NO: 26264 - DNA, 163 bp, Homo sapiens
  misc_feature 25: s=g or c
  misc_feature 49: s=g or c
  misc_feature 84: s=g or c
ctccccactcctccctaagatctasaaaactccagtccaaatctctctsaacactatggaagggcaccttccaggtgcctgaasatatggcacagggttcaggcttgcctatcatcctcccggggccaccagcacaacatgatcccaccactccctacacaac

SEQ ID NO: 26265 - DNA, 300 bp, Homo sapiens
attccatggtgtatatttgccacattttcttaatctagtctatcattgatggacacttgagttggttccaagtctttgctatcgtgaatagtgccacagtaaacatacacgtgcatatgtccttatagcagcatgacttataatcctttgggtatatacccagtaattagatggctgggtcaaatggtatttctagttctagatccttgaggaattgccacactgtcttccacaatggttgaactagtttacactccaaccatgtaaaagtgttcctgtttctccacatcctctccagca

SEQ ID NO: 26266 - DNA, 160 bp, Homo sapiens
atttaaaatgtataagcaaaagtttgtactctgagcttgcaagcagaggcatttattaaaatttcttttttacttatttccttttgaatgtttttaaatgatatgaaaaagcttaagaatgtggagctatgtaaaataaaaaggaagtaaccccaacctt

SEQ ID NO: 26267 - DNA, 345 bp, Homo sapiens
  misc_feature 20: y=c or t
  misc_feature 21: y=c or t
  misc_feature 85: m=a or c
  misc_feature 86: m=a or c
  misc_feature 303: r=a or g
  misc_feature 309: r=a or g
  misc_feature 311: r=a or g
  misc_feature 316: m=a or c
  misc_feature 342: m=a or c
tatcttacaatctaggaagyygaaagatggggacatggcaactggcttcacagggccagtatcctggggaatacgaaaagaggammaaagagaccgtaacggggtagacaacaaaacaccgccatgccacatacttaacgttgaactagaggaaaactctattacaagcgatacttctaatctgcttgcggtaaagattcataactggaaaataagcatgtgacagttctgcatttgagtgtaaacttaactcattaatttaaattagagtgcttttttttaacaaaggggaaattctagtartaatartragtamtggctgttgtagagaatgtaaaaagmtgt

SEQ ID NO: 26268 - DNA, 360 bp, Homo sapiens
  misc_feature 312: m=a or c
aagcacataagtcaaaagctgcgtcagaaggttctaacttttgtcatcactattaccagcattgtcatcgttatcgttatcttcgtcatcatcattaccaccgttatacctgatactgccataacaatcagaacattatgtacaggcacggcatatcttcccaaagatcttggccactatggactacgatctttatttttcttggagtggcggcaatcttgggagtaaccattggtcttcttgttcattttctggcagttgagaagacttactattatcaaggtgattttcatatttctggagtcacatacmatgataattgtgaaaacgcagcttcacaagccagcacaaatctaagca

SEQ ID NO: 26269 - DNA, 411 bp, Homo sapiens
  misc_feature 26: y=c or t
  misc_feature 27: y=c or t
ccatttctcaataactgtttaaagayytgcacccagctgggactagtctcttgaatctcctctttctttttctccattgtcttatgaatctttattgcctgttattttggtaagacttttacatatggcagtgggtctgtgactactggctataactggatctggccaaaaaccaggcttggcccagcattaggatttgcgtttctgtttcgctattccaggtaacaataatcaagggattatatagtaactttatttattgtttatgtaacattttcttatgtatccagtgacccaggcacccaggagttggatccatcatttctcagtcccactggtaacttttatttctactaattgattgtaatacagctgtagttggagctattatttgtaaattccactggtaat

SEQ ID NO: 26270 - DNA, 159 bp, Homo sapiens
ttaagttctgggatacaagtgcagaacgtataggtttgttacataggtatatgtgtgccatggtgatttgctgcacctatcaacccgtcatctaggttttaagccccgcatgcataaactgtttgtcccaatgctctcccttcccttgtaccccacatc

SEQ ID NO: 26271 - DNA, 175 bp, Homo sapiens
agttttggtttcaactgatcttaaagttcaagctttaacaagattaaatttgaatgcaatgataacagaaagcaagagaagtgtgagaactctgaaagaagaagttcaaaagctggattatctttaccaacaaaaaattaaggaagcagaggaagaggatgaaaaatgtaccagt

SEQ ID NO: 26272 - DNA, 71 bp, Homo sapiens
  misc_feature 32: s=g or c
agtgtcagcctctcggcgggaggaggcggcgsggaggaggagcagggggagggctgtcaaattcgagagcc

SEQ ID NO: 26273 - DNA, 177 bp, Homo sapiens
  misc_feature 33: w=a or t
tatatcgcatcaattctaagactcatactcatwtttgacacttctgacatcttatatacagcagtgtcttaaatcattacaatacagtagttgggaaataaactgtgacagattgactctaacataccaaacttcacctaatgattagtggagctagtcatagattctttgcctctt

SEQ ID NO: 26274 - DNA, 126 bp, Homo sapiens
actctggccagtccactattaattattatacttgccttggcttttggatcatgtttgttaaatcttttaaccagatttatttcttcttgcctagagaccattatgataatgcagcagggccacctt

SEQ ID NO: 26275 - DNA, 233 bp, Homo sapiens
ttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatacct

SEQ ID NO: 26276 - DNA, 89 bp, Homo sapiens
ccttttccttttccggttgctgctataacaaattactgcaaacttagttgtttgaaataacattaagtttattatcttaacggttctga

SEQ ID NO: 26277 - DNA, 256 bp, Homo sapiens
tagctagattaacaaagaataaaatcagagaagatccaaataagtacaattcgagtttataaagatgacataacagctgatcccacagagatcctcatagaatactgtggacaattctgtgcacacaaactagaaaatctacaggaaattgtcaaatccctggaaacatacaacctccaaagattgaaccaagaagagagtgaacacttggaacagaccaataacaagttaggaaattgaatcattaagcgccatg

SEQ ID NO: 26278 - DNA, 318 bp, Homo sapiens
tctaccccaatccacagagcccaaatctctcagcattatccaccactgcttcttatcaccaaatccagtatctactcttccctctcaacctacttggcatccccacagccttggaaagtccagcactgcatttcttaattcgtaccttcctttccccctgagatgttcacattccatgctcatttctccttgtttctcctattctttttcctgggccatctaaacagcttaatagcttcaaatatcacacgtcctcaggtctcctaaaccttgatatcctgcccagctctttctcttagaaatccatatgtcactcct

SEQ ID NO: 26279 - DNA, 133 bp, Homo sapiens
cttccagctgatggaattttaggagatttgaatgaattaaagctgcatttgtctgaagaagccagtgaagttactgactagtttgtaaataattatgtgcatggtagggtaaaaagacacttaggcaactttt

SEQ ID NO: 26280 - DNA, 282 bp, Homo sapiens
atgtggtggaatgctagtttttaaagagttaaatttggctgggtgaggtggctcacacctgtaatcctagcactttggcaggccaaggtgggaagattacttgaggccaggagtttaagaccaacctggccaaacgtagcaagaccctgcctctatgaaaaaaaattatttactgaaagtctcttcacggagctttaatattgctaacatacattgggaaactaagaaatggatagcttaagcaatgcttagaaaattctttctgtctgaaacataagaatt

SEQ ID NO: 26281 - DNA, 172 bp, Homo sapiens
cagcctgggcaacacggcgaaaccccatctctactaaaaatacaaaaattaaccgtgcttttgagaagagagaaacatctttactctcaagataatgcttttaaattagcactttataccagggaacattacagtgttctcttcccacatagcctgctgtctgtcactgcca

SEQ ID NO: 26282 - DNA, 151 bp, Homo sapiens
tatatccttactcgttttttgcttgtttgttctgtcagttattgtgagcggtgggtattaggtgcagaaacaattaggatttttgtatcttgatgagtaagccactgtattttgttaaatattctttgttgtgaaatctactggctgaaga

SEQ ID NO: 26283 - DNA, 492 bp, Homo sapiens
  misc_feature 160: r=a or g
  misc_feature 370: n=a, g, c or t
aagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccagrggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggancaagtcttgcttttcgaacatggtataatagccttgtttgtgttagcaaagtggaatctatcagcattgttgaaatgcttaagactgctgctgataattttgtaatataagttttgaaatct

SEQ ID NO: 26284 - DNA, 194 bp, Homo sapiens
agaaccgtcagatagtctctgagatcttaggaaccctgttttgttgtatatcctctgccctgatatgaagaaaagatgattcttactgtgggctttagctttttgtttttctacaggggcacgctgtgtgacaaagtaacccagagttccccggaccagacggtggcgagtggcagtgaggtggtactgctccc

SEQ ID NO: 26285 - DNA, 248 bp, Homo sapiens
agaaggaagtcggcaggcgagactgcagagggagtagtgcgatcctgcgcgcgggggaactagctggagggcaaggcgggaacaccatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagacat

SEQ ID NO: 26286 - DNA, 171 bp, Homo sapiens
caaagacaactgcaagttataaatattttttttcaaataagtataatttcctactgcttccctactcttcacattcttttccccagttagcttacctagcttttagttcagattcttctcagaatcgtatggtcaaagtctggtgtttaatttcccttcatgtttcttctc

SEQ ID NO: 26287 - DNA, 293 bp, Homo sapiens
  misc_feature 227: v=a or c or g
ctatattcattctcagttgtaatggaaatccaaaataaaacaacataagacacattttttttactggtataaatagtatttttctaattgataatattcaatgtaaatgcaaagatggtacagtgtagagtttctgtttggataattgggtggtcattacttttatcttcttgattttatttttttaaatgtctttaatggtgattttttttacttttataattaavaaaaattaaaagtgacaacatatatgtatagtaattaagaaaaatatcttctcgaattggggcgct

SEQ ID NO: 26288 - DNA, 215 bp, Homo sapiens
ctcacctggccggttaacttcttgattgtaaaggcttaactgacaaagacactgtattccctttggggccctgaggctgcactcaaattggattatggtcagttgtctgatggagctttgtgttgtcaccacaacttgtgtttacacagccccttcagcctccctagggcatcattttcagggctttgctcacgtcttgacatctttccccacat

SEQ ID NO: 26289 - DNA, 462 bp, Homo sapiens
  misc_feature 14: m=a or c
  misc_feature 15: m=a or c
  misc_feature 98: m=a or c
  misc_feature 109: m=a or c
  misc_feature 357: w=a or t
  misc_feature 358: n=a, g, c or t
ttccagagaatttmmgctgcctgtgcactcatgaaaagggctttggctttaagggaagcagcttccaccgcatcatcccccagttcatgtgccagggmggtgatttcamaaaccacaaatggcactgggggcaagtccatctatgggaagaagttcgatgatgaaaactttatcctcaagcatacgggaccaggtaggagccagttggcatgtggtgacgagggaggctgggcaagggtgggatggccaggcaggatggaaggacaggttgtagttctggctggcggacactaagagtctggaggagacccagccaccagacataggagaaccatgcagccttgctagggtggagtwngcttgttgacattcaggtactgttcatcccccaaccgtgtccacaattcctattagccccgcttggattctgtggtctgctgttgcaggctcttatgctctcaa

SEQ ID NO: 26290 - DNA, 357 bp, Homo sapiens
  misc_feature 124: m=a or c
  misc_feature 128: m=a or c
  misc_feature 145: m=a or c
  misc_feature 159: m=a or c
ttctgaaaatcaagggaaggtcattttagacaaaggaaaagtattgagccaagacaaatatctggattgcatgatataatagagactgggttggctctgaagtcagactacctaagctgaattmtggmtcctcctattacctgcmatgtgaccttgggmaaacagtctgttgttagtttttttatctataaattgaagataatattttctttgcctcataggaaaactgcacatgtaagagaaaatgaaatgtcataaaccgagtgtacctgtgtaacttgcacttaaattaaaaacaaaaacagaacattatcagtatcccaggaggtttttacattctccattgtgttgtttcga

SEQ ID NO: 26291 - DNA, 190 bp, Homo sapiens
  misc_feature 121: s=g or c
  misc_feature 181: n=a, g, c or t
ttggctaatagtaaatgttttaaaataatttaaaagtttgtaaaaaataatccctctccactgattggtatgttttctaacttttgtggttacatatactgctgctataaagctttgtgtscgccactttttttttcagaataaaatctaaggtctatgttaaagagtataccagattaanacccgcttg

SEQ ID NO: 26292 - DNA, 256 bp, Homo sapiens
  misc_feature 109: v=a or c or g
  misc_feature 133: y=c or t
ttttatgttgacttgaagttgtgtcctttgagagactgtcatgccataaagacaaaaaattaattttaaagaataaaatcacagtgtcatcatagatatattacttttvagttatatatcacataatgatttycttgtcaatagatgttttagttaaattatgaggaatggctgctgagatttggagtgggacattattttttatctctatagttaatcattcctattgccttgaagtcagaataaaaaaaccccc

SEQ ID NO: 26293 - DNA, 325 bp, Homo sapiens
  misc_feature 125: r=a or g
  misc_feature 128: y=c or t
  misc_feature 134: y=c or t
  misc_feature 136: s=g or c
acctcctggatacaagcgattctgctgcctcagtctcccgagtagctgggattacaggttcccgccaccatgcccagctaatttttgtatttttagtagagacggggtttcaccatcttggtcargcytgggtytsgaactcctgacctcgtgatccacctgcctcggcatcacaaaatgctgggattacaggcatgagccaccgcgtccagcctagagttgggggtctttctatgttgcccaggctggtcttgaactccgggcctctagcaagcctctcatctcagcctcccaaggtctggaattacaggtgtgagccactgac

SEQ ID NO: 26294 - DNA, 264 bp, Homo sapiens
  misc_feature 195: w=a or t
  misc_feature 223: r=a or g
  misc_feature 229: r=a or g
aacctaaggatattaacatttattcaataacattatctaatatatagtccagataaaaattttctgtttagaaaatgtcacatctatacacatatatgtgcatgtatatagatatttatgcatacatagtgtgtgcatgtgtgtatgtatgtgtatatataacacacatgcacattacatatgcataaatgtttwaatttaataatatttatatgcatcaatrtcttaragatatatacatatcattagctggaagctgcctgg

SEQ ID NO: 26295 - DNA, 323 bp, Homo sapiens
atttacttctttgaggaccttaaaagacactacttacttaattgagactttgcactattagcttttttattgctatttaacaaattactgccaggcatggtggttcacacctgtaatcccagcactttgggaggccgaggtgggtggatcacctgaggtcaggagtttgagaccagcctgaccaagatgatgaaaccccgtctatactaaaaatacaaaaattagccgggtgtagtggtgcatgcctgtaatcccagctactccgtaggctggggcaggagaatcgcttgaatccgggaggtggagattgcagtgagccgtga

SEQ ID NO: 26296 - DNA, 200 bp, Homo sapiens
ctttccccgcccccctggatcagagctttgatctactttgaaggtttaatatataataatatttaggttgagtcactttggaagccaggattaaatcattttatgaaatatctgttgtaagtatctacaatttggtaccttttagagaaatttacggaataatagtaaattttgaagcaggatgccatcagtctccctgt

SEQ ID NO: 26297 - DNA, 262 bp, Homo sapiens
cccactcatcccatggcccatcacctgcctgcagccatggagagccatcaggacttccggagcatcaaagcaaagttccaggcctctcagccggagcccagcgacctgcccaaaaaacctccgaagcctgagtttggtaactgaagaagttttcccagcctgagctaagcgagcaccccaagaaggccccgctgcctgagtttggtgcagtgtccttgaagcccccgccgcctgaggtcactgacctccccaagaagccccc

SEQ ID NO: 26298 - DNA, 158 bp, Homo sapiens
aacaactgtatccagaattaaaatgttaaggaaattttgtaattattatgacacctttcctctttatagaaatgtactgtacatttggaatatgtagaaaatggggaaagcaatcaaaaagaaaaaattcagatttctccactcagagatgacactgc

SEQ ID NO: 26299 - DNA, 160 bp, Homo sapiens
cccacaattttcaaccaatcagtggtctccacactttggcccactccaaaacccttaaaaaccctacccccaaactcctctggggaaaagatttgagctttcttcatgtctcctcatttggtggccctaaggattaaaagttcttttttctgcccagccc

SEQ ID NO: 26300 - DNA, 426 bp, Homo sapiens
  misc_feature 121: r=a or g
  misc_feature 122: r=a or g
  misc_feature 128: y=c or t
  misc_feature 131: m=a or c
  misc_feature 147: w=a or t
  misc_feature 197: m=a or c
  misc_feature 345: w=a or t
  misc_feature 350: h=a or c or t
  misc_feature 351: b=c or g or t
  misc_feature 352: n=a, g, c or t
  misc_feature 387: m=a or c
  misc_feature 402: m=a or c
  misc_feature 407: m=a or c
gctaatgtccaaacgctggcctcagccatttcaccttgaagattgcagttggcttccaactggcctctaaactctaatctagcattttccagtccattgtgacaaagtctgccttccccarrctaatyccmagctgttggacctgcwgccttagaaccacagattgagacctccctgtcccctctgtcagaccagamcagggcaggcagtatatttgcatgacgcaggatgattgacactggtgatttcacccagctcccttcatagcaattttgacaactgcttcatctgagagacatttggaagcagcatagtttatggtgaagttctggagtctcgctcggwacaahbnagtttccaacatttactagctctgtgatactgggmagtcgttagaaagamtgccmgttctgggacatcaaaacc

SEQ ID NO: 26301 - DNA, 294 bp, Homo sapiens
tcaaactctcacctcctcccctgtgaaatcttttcttattctcccagcagttaccctttttattcccatagcacagccatgttatatctctatttatactttcattttgatactttgctatattttaattatggatttacatgcctgtctttcctttgaggtgttattaatcgtttttgtatgcccctgggcctagtcctagcatagtacctactacatagtaggtgctgtgcaacaaataatggttgttgactgcatgaatgaatggtgagtccagagtttggaatcttcttt

SEQ ID NO: 26302 - DNA, 395 bp, Homo sapiens
  misc_feature 132: y=c or t
  misc_feature 227: w=a or t
  misc_feature 233: w=a or t
acattgatatggttggttttaaatccaccttctttctattttgttccacctgttttttgttctcttttgaattaattaactttctttgaattaaataagttttattattccattttacctcctttgttggcytatttagctatacagttgacccttgaacattgcaggggttgcagcaccaaccccctgaacagttgaaaatctgtatataacttttgactccatawagatgwgaagatatatttactattcattaagtggaagtggatcatcataaaagtcttcattatagtcatattcccgttgagtaggctaggaaaaggagggactagtcttgctctcccaggagtggcagaggcagaagaaaatccacatgtaagtggacccgagcagca

SEQ ID NO: 26303 - DNA, 314 bp, Homo sapiens
caaatactctgcacaacaaatgaacaggcagttaaaattatgtgccaaggtactcttaatactcactaaaagtataaacaggctttaagctttctctatacttcattttcactttttgttatataacttaaaaagtcacactttgagcctggtgtggtgatgtggtgcctgttgtcccaatagctcaggaggctgaggctggaagatcacttaagcccagcagttcaaggcccctgggcaatatagtgaaaccatccttcttaaaaaaaccactttttaccgagacccacttttgtggagtcatatccccacta

SEQ ID NO: 26304 - DNA, 145 bp, Homo sapiens
aggcaggcaatccatgggaatgcacaggtcaccagtgtagggtgcagggtacccaggcttcgccttcaaggaggaggggagaataacatatctcaaactgaggtccctggacctcttgcatctgaatctgtcggggggaaggggt

SEQ ID NO: 26305 - DNA, 452 bp, Homo sapiens
  misc_feature 109: w=a or t
  misc_feature 317: y=c or t
  misc_feature 318: w=a or t
ttataaaggacaaatacaggatatgataagatcaagaaggcttccctaaggaaatgacttttacactaagacagtaagttatctgtactaatgatgggggacagaggcwgagataatctaaaaatggtgtctaatctaaaatttatttcctatttttgtattgcaatctctatgtattcatagtccatttaaacctcagccagttcccttcaccttgtaccttccccttttttgttcttcctagacatactgtcaagacagcaatctatgatatgctttgatattccaggaaagaaagtgtggttacagtattctcywtattagagtgttaaactctgggctaagataaaagaaaagccaggaagattatgaccaagtgactaaattaccatctcaaatgcatattatgtttgagaagttgggaggatctgaggttcagagaaaatgaactt

SEQ ID NO: 26306 - DNA, 301 bp, Homo sapiens
caagatttaaaactaaaaaattcctaaaagaaaacataggggaaaatctttatgacattggatttcacagtgatttcctgactgtgatactaaaagcacaggcaacaaaagcaacaatagacaaatggaactgcatcaaacttaaaatcttctacacctcaaagaaagaagccagcagagttgtattagtttttacactgctgataaagacatacccgagactgggcaatttacaaaagaaagagatttattggacttacagttccatgtggctggggaggcctcacaatcatggctgaag

SEQ ID NO: 26307 - DNA, 112 bp, Homo sapiens
atattagggttatatattctgggaatttagtatgtgtgtgtctgatagagagatggggttctctttttatacaggagagtgggagagttgaatttatatgtattagaggcaa

SEQ ID NO: 26308 - DNA, 227 bp, Homo sapiens
  misc_feature 57: m=a or c
cactattataaaatctaagatcagtgcttgagatattttgcagaccccgtacttgamggatcagctgacactacccagaccagtaatctggctcaaccagtcctgcgatcccacccaggaacagaagacagcaagaaaacctcacttcaacactcccgtcgatgactccatcgacctcaggaagctccaaccaatcagcactccccacttcctgagcccctacccgc

SEQ ID NO: 26309 - DNA, 430 bp, Homo sapiens
  misc_feature 4: y=c or t
  misc_feature 105: r=a or g
  misc_feature 106: s=g or c
  misc_feature 350: r=a or g
  misc_feature 351: w=a or t
  misc_feature 415: w=a or t
aggyctccacggctgtggagagatcctgccacgggccttgttcaccatgtcggtgctggatgcgctttgggaggatcgggatgtccgtttcgacctgtccgcgcrsaaatgaaaacaagacctggagaagtccttattgattgtttagattccattgaagacaccaaaggaaataatggagatagagaaattacgaggccaaactgaagctctctatatactaacaaaatgtaacagtactcgttttgaatttatatttacaaatttggttcctggaagccctagactttttacttctgtgatggcagtacacagagcttatgaaacttctaaaatgtatcgtgattttrwattaagaagtgcactaattcagaacaagcaactaagactgttgccacaagaacatgtatatgawaaataaatggagttt

SEQ ID NO: 26310 - DNA, 109 bp, Homo sapiens
aaaggaaaataaagttagttctttttgttgggaaagaagatttcatgttatctgtgtttgcaggctttctggctcatctgctggaggaatccttgctgcgggggtggcg

SEQ ID NO: 26311 - DNA, 409 bp, Homo sapiens
taatcatttgccatttcaaaacccattagcagtctgacaggtaaccattgtatttactgctttgcttgaccacacatgctttaaaacccttattttaaagtaagaaaagtccggctaaaattcatccttcgcttgaacactttcttaaaggactaaaacttaagatgtctgcccagtagttagtaatgactccaacaagtttcaaagttttgtttaggttggcttatttttatttttagtccttaatcataattaaaagatatggccatttctgatgaactgcactacttggaggtctacctgacagatgagtttgctaaaggaaggaaagtggcagatctctacgaacttgtacagtatgctggaaacattatcccaaggctgtaagtaattacaaatcagagaacta

SEQ ID NO: 26312 - DNA, 301 bp, Homo sapiens
  misc_feature 126: s=g or c
  misc_feature 128: h=a or c or t
atacttggcactctgccctttgcagagatgactaaaataagagagttgccttcaagaaattgctgcctgatcagaggaaagaaaatgaatgcacatgcaacagcttcaggtgaaaatacacagtcsthgttcattgccatgtcatagaccacaagtagaatgagtagaaatttagagactggagagctctggggtttgggtatctgtgttaggttcaggaatgttctgggtgatggggcaggacttttactcaacttgtagagtattagtatactgtgagaggtaatcattaatggcacag

SEQ ID NO: 26313 - DNA, 103 bp, Homo sapiens
  misc_feature 92: r=a or g
tatcttgaagtgtaacctcttgtttccagttttggtgttttcttaaaaaggagcattcttcggaaagttaaaatgtcacgtcttaatttcarttttcctaatc

SEQ ID NO: 26314 - DNA, 361 bp, Homo sapiens
atctccactgccttcaagtctgccaaacatcacctcttccgagaggcctatccaaatctcttctctagctaaaagcactcccaacctgcctttagtttctgtgttctttcttggcatttactatcaggtggttgtatgcatgcacacctacccccaatatggacgtgtctcaaaataatttgctaaatgaaagaagccagtcaaggaaagaggacctactgtgagattctgctgacatgaaatgatgccatttacacatagtttcattgtctcctccatttatttcattaattaatttattttttggagatggagttttgctctgttgcccaggctggagtgcagtggcacaatctcggct

SEQ ID NO: 26315 - DNA, 146 bp, Homo sapiens
ctaagtgctaggcagtacaatgacagatagatttttcttctgccctgatggggtttacaaaggtgataagtaaaatagttacagattatgctagtgccatgtaggatagcatactgttttagactttactgtggatagagatgggt

SEQ ID NO: 26316 - DNA, 193 bp, Homo sapiens
atcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggatg

SEQ ID NO: 26317 - DNA, 305 bp, Homo sapiens
atttttatatacagtaaaatgtatactttttaatctacagttacgagttttgacaaatgcatgaagtcatacaaccactagcatcacaataagtaggtagagtatttctatcactcccccaaagttccttaattctcctttatagtcacatcttcccaccacctcaaacacttggcaccactgatcaatttttttgtctgtatagttttgccttttccataatggcattatgtagttttttgagtttagcttcattcacttagcacagtgcatttcagattcaatcatgttgcttcatacaggtg

SEQ ID NO: 26318 - DNA, 424 bp, Homo sapiens
  misc_feature 347: m=a or c
  misc_feature 348: k=g or t
  misc_feature 349: r=a or g
  misc_feature 412: k=g or t
  misc_feature 414: h=a or c or t
  misc_feature 415: n=a, g, c or t
  misc_feature 416: b=c or g or t
ttattttttattgatacataatagatgtacatattttgggatacctgtatatgccccatacccagtttcccttattattttgagacagggtctcactctctctcaggctggagtgcagtggcccaatctcggcttactgctaccttggcctcccgtttcaagtagttctcccacctcagcctcccgggtagctgggaccacaggcatgcaccaccatgcccagctaatttttgtattttgggagagacgtgatgtcaccattttgcccaggctggtcttgaactcctgagctcaagccatctgcccacctcggccttccaaagtgctgggatttcaggcgtgagcamkracacctggttcagtttcccttattattaacatcttacattagaatggtacatttgccataatkahnbaagccatt

SEQ ID NO: 26319 - DNA, 229 bp, Homo sapiens
acaacgtaccagaatctctgggacacatttaaagcagtgtatagagggaaatttatagcactaaatgctcacaagagaaagcaggaaagatctaaaattgacaccctaacatcacagttaaaagaactagagaagcaagagcaaacaaattcaaaagctagcataaggcaagaaataactaagattagagcagaactaaaggaaatagagacacacaaaaccctccaaa

SEQ ID NO: 26320 - DNA, 390 bp, Homo sapiens
  misc_feature 388: v=a or c or g
  misc_feature 389: b=c or g or t
  misc_feature 390: d=a or g or t
cctttatgaagccatagagataggcctgagagctcttttgcatgtagagatgggcctgaggaacttaggtacctttttttaaaaaaataatggtagggtttcactgtgttgcccaggctggtctcgaactcttgagctcaagcggtctgcctgcctcggcctcccaaagtgctgggattatagggatgagccaccgcacccagccttaggtacccttttgatttggttccagagagggctcttttagttaggaaggccattaatgttagtgttacttcttggtaaattgatcactcctttgtttcactgagcatccaaatcatgctgacaaagttagtctttattcaaggataaaacctatgctggttttatcagttcccccctattvbd

SEQ ID NO: 26321 - DNA, 208 bp, Homo sapiens
  misc_feature 78: s=g or c
atcaatcatagctttatatgcagtcagtgaacaactagaaatatttaaattagcatttaaaaccgaaccaaaaccatsaaataattaacatgcgttctcaaaaatatatgcacatttgtatgctgcaaaatataacacatgttgagagataaaaagagctacataaatgtagactcagatctacatattcagcacaactccagcccat

SEQ ID NO: 26322 - DNA, 241 bp, Homo sapiens
ccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaagtaagtgccccattcagtcctcttcctaacgtggagcagtttggttcctctgatgccagggaa

SEQ ID NO: 26323 - DNA, 208 bp, Homo sapiens
  misc_feature 151: s=g or c
actctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcascttaagagctgtaacactcaccgcgaaggtctgcagcttcactcctgagccagccgc

SEQ ID NO: 26324 - DNA, 58 bp, Homo sapiens
  misc_feature 7: m=a or c
  misc_feature 12: y=c or t
  misc_feature 25: y=c or t
  misc_feature 52: w=a or t
atcggcmtctgygactggctgcgaycgagggcccgggcggccggccagccgwctcgcc

SEQ ID NO: 26325 - DNA, 167 bp, Homo sapiens
aattttattattttagttttttgtttttgagatgtagtctcaccctgtcgcccaggctggagtgcaatgccgtgatctccgctcactgccacctccgcctctctagttcaaagcgattttcctgcctcagcctcccgagtagctgggattccaggcgcccgccacct

SEQ ID NO: 26326 - DNA, 339 bp, Homo sapiens
  misc_feature 106: r=a or g
  misc_feature 289: k=g or t
  misc_feature 290: y=c or t
cactgactggctcaaacatctgggtacagggtatgttttggggtacagtaggacagggatgagacagcaactgctcctccctgaaatgcacaagcctggagctgarggatgcctgttcctgagtgtcacctggagtgtccaggtatctttttatatcaggaagtgcagtcagtgagtgctgtgggtcccacctgtgggccacctgccttgatgtcaggaacacctcagccttctagtctcggagacaaaccagccagtggcaggaaagtaaacaggatttcgatcagakyccatctgtcctcatcccgtgactaggaatggccaagtctcagcccagaa

SEQ ID NO: 26327 - DNA, 420 bp, Homo sapiens
  misc_feature 322: n=a, g, c or t
  misc_feature 323: n=a, g, c or t
  misc_feature 324: h=a or c or t
  misc_feature 331: r=a or g
  misc_feature 336: n=a, g, c or t
tgtatataatttttacttctgtatttttaaagaaatcctgtctaaagaaaaaactgttttgtattgccattttagagcacagtagaatatatatctgttgcagcactatccaaaatatttgctgtcgcagcaacatacccatatcaagtcgtaagagctcgtcttcaggatcaacacatgttttacagtggtgtaatagatgtaatcacaaagacatggaggtgagagcacgtgctatatcaaaaattgctttgacaaggtaccttgcatatcttagaccatcctgttgatactagttttatagcaaaggccagtttgtagnnhgtgaaarctttnttggtggtccctgctttcccagttattacgtatgtgaccatggccttaatctctctgagacttaatttcttcatttgtaaagta

SEQ ID NO: 26328 - DNA, 184 bp, Homo sapiens
aattatcttatgtcagttactaggatgacaatagtagctagtatttattgagtgattaattttgtgtatttaaccatacaaggtactattatagcataagaatctcctgccaccatcccatcaccaattgatcatttaatgatcacttcaactttatatgcattgtacccatttttggatagag

SEQ ID NO: 26329 - DNA, 287 bp, Homo sapiens
gcagacaaatccagtttgtcatcacggggtgtttcactgggggaactatggacagaagcatcgtcttggatggccacaagggtctcactctgtcacccagactggagtgcagtggtgcaatcttggctcacagcagcctcaacatcccaggctcaagtgatcctcctacctcagcctccctagtagctgggactacaggtatgcaccaccacacttggctaattttaaaaaattttttgtagaaatggatctcactatgttgctgaggctggttttgtttttttttt

SEQ ID NO: 26330 - DNA, 212 bp, Homo sapiens
tttgttagggcagtattgcaacagaattgccacacaaaaaccagcttaagaaatgtacagcacttcaatttttttagttgtctcccagagctccgtggaatttcctttctctgctttaacgtacttttaaaaggtaattttactaaaaaatgcatatggtaaaaagatgaaataatataaaagggcatgtgacaaaatgtttttcccaccct

SEQ ID NO: 26331 - DNA, 103 bp, Homo sapiens
  misc_feature 2: y=c or t
  misc_feature 9: y=c or t
  misc_feature 42: w=a or t
  misc_feature 53: w=a or t
tyaattctytgaaaaacctccacactgttttccatagcagcwgcaccgttttwattcctaacagcgtacaagggctccaacttcttcacatcctcaggagcat

SEQ ID NO: 26332 - DNA, 181 bp, Homo sapiens
gtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcactc

SEQ ID NO: 26333 - DNA, 338 bp, Homo sapiens
  misc_feature 209: k=g or t
taatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagkgcagtggtgcaatcttggctcactgcaaggtccgcctcctgggttcatgccattctcctgcctcagcctcctgagcagctaggactacaggcacgtgccactaggcccagctaattttttttttttttt

SEQ ID NO: 26334 - DNA, 398 bp, Homo sapiens
  misc_feature 110: w=a or t
  misc_feature 118: m=a or c
  misc_feature 347: w=a or t
  misc_feature 350: w=a or t
gtatgatgagggagtgttagaagagggtataaactttagttttgaatttaagtagcacttttctctcctaggatttgtgctaggattcatttttgacccactctgttttwttctaaamctctgcattaagctgtcttctttgtgtaacctccttccagtgacctcttgtgcctttctcccaaatcaagatggtttctttttaaaaatagtttaaattcattcttaagataaatgaaagtagagtctgaggatatatttaatcccttttaattttacctctgctctccttttcacccatccttcatcactatccacagttgaactaggcatcttattcctcttctatwatwtttcttagcccctttcctctctaattttttggattgtagctgacctgt

SEQ ID NO: 26335 - DNA, 300 bp, Homo sapiens
aggccagagtgacaaggcaggcagttgggatgagagggttgtctgaggtcaattgctggtagcagcagtgttatctggatactgaatcttgggtagcctctgctaagactagaccctcaagggcctgaagcctaaggtagtagtggccatggctgctgacaaaagtagcagagcctctttgctggaaagcttccccattctcaatttaaccctgtaagactcttgctcattaaaatctagtaatggcctcatagtctgtggttactaaataaaatagcactaggacttattggtacatga

SEQ ID NO: 26336 - DNA, 178 bp, Homo sapiens
atgttatttcacaataatttttggaaattttctgttttagtctatgtgagtcatgtaaaaattataaaaacttttaggaactcaagcagccttcaatcagtgaaagaactgtttagcatgataatacaaaaataaaacctatagtattttggcaccttataaagctcccctttcgcct

SEQ ID NO: 26337 - DNA, 148 bp, Homo sapiens
  misc_feature 18: k=g or t
  misc_feature 88: r=a or g
gtcggtgaagcggcagtkgcggcggcggcggcggctcggcaggcgggttcaggcttcgggggccagaaacaaaccggaagcagtagargtaacatttgcagatttcgatggggtcctctatcatatttcaaatcctaatggagacact

SEQ ID NO: 26338 - DNA, 209 bp, Homo sapiens
aatattgattggacaattggaggcatgagttctcagtgtatcttgtttttgtaccattgtcaatgtattcaagtcagtgtaatgaatgatgtggctagggacccatgttgagtcatttggaagaacattgcaggcaccttggttttagaaaaggctaattatcctggtgctctgtctaaaggttcagagcaattgaggagcctactgct

SEQ ID NO: 26339 - DNA, 248 bp, Homo sapiens
agcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcgggcgacccgaaccttctggtcaggcacctgccggctgagcttactgctgaggagaaagaggacttgctgaagtacttc

SEQ ID NO: 26340 - DNA, 273 bp, Homo sapiens
aaggacattcacaatgttgagcaaccatcactgctctgcatttccagaacttttttttactatcccagacagaaactctgtatcctttagaaaataaattcccattctctccttaccccagcccctggtaacctctagtctactttctgtctctatgaatttgcctattctaggtaccatgtataagtgaaaacatgcaatattcatctgtccttttgtgtgtctggcttgttttacttaatgttttcaaggttcatccatgttgcagcacac

SEQ ID NO: 26341 - DNA, 328 bp, Homo sapiens
tgctcactgcagcctccacccttcgagttcaggcgattctcctgcctcagcctcccgagtggctgggattacaggtgcctgcccccgtgcctggctaattttttgtatttttggtggagatggagtttcaccatcttggccgggctggtcttgcactcctgacatcatgatccacccgccttggcctcccaaagtgctgggattacaggcgtgagccaccatgcctgacccatcatagtagattcttaaggatgctttctacaaatgcattgtgctagttggatatcttttggcatgattgttacacgtttggcatggataacataca

SEQ ID NO: 26342 - DNA, 223 bp, Homo sapiens
ttatcccaaaaagaaatcccatacccattagcggtcactcccatttcttctcagtaccccttctctctgctgtagacaaccacgaatctttctctaaagttttgtctgttctagaccatcatatgaatggaatcatgcaaaatgtggtcttttgtgactggcttcttttgtttaacataatattctaaagtttcgttcatattgtggcatttatcagcaccca

SEQ ID NO: 26343 - DNA, 391 bp, Homo sapiens
  misc_feature 74: r=a or g
  misc_feature 275: b=c or g or t
  misc_feature 276: y=c or t
  misc_feature 285: w=a or t
  misc_feature 341: r=a or g
  misc_feature 342: m=a or c
  misc_feature 358: m=a or c
tgtttaattaatattactattctattgagatccttttattttaaattgtaaatactaaaattattattattaaraggtttaatttgttttgatagcactctgtttaagaaaggacaagctctaattactaattggtgttttgagaagcaaaaagcatctacattatcacaatatattacatattaagtaatttttatcttgaaaggagtatgaaccatgatgtgaaatgatgagtagtggaaatcactaatacttaagttcattatatgtatttbytgttttgtwttgttttgttttgagatgacatcttgctctgtcgcccaggatggagtgcagtggtrmggtctcggcttactgmaacctccacctcccgggtataaatgattctcct

SEQ ID NO: 26344 - DNA, 208 bp, Homo sapiens
gcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctgga

SEQ ID NO: 26345 - DNA, 152 bp, Homo sapiens
  misc_feature 129: y=c or t
  misc_feature 135: y=c or t
  misc_feature 140: m=a or c
  misc_feature 146: b=c or g or t
tacgtctttaatttctttcaacagtattttgtactgttcaagtcttgcacattcttggttaaataagtattatttttgatgcttctctaaggaattgtttttcttttccttttttttttgagacggagycttgcyctgtmacccgbactgga

SEQ ID NO: 26346 - DNA, 130 bp, Homo sapiens
tatgtccagtcatctcctttggctgaggaaacccttagtaattttgacccctgccaaccttccctcttcccctcctccctgtctgttccctggcagatcaggctcttcacgcctctttcacataccccaa

SEQ ID NO: 26347 - DNA, 427 bp, Homo sapiens
  misc_feature 369: n=a, g, c or t
ctctgtcaggcctttgacttcattcatcagactggatgcttattaaacatctactacatgcaaagttctgtaccagatgaagttgaaggcaggttacactgccccggtgtggcttataattgacctggaaatatttccagagttaggtaacagacagaataccttcctcattctcagctgttattttggaacagagaactttacaaaagctttgtctttgtaaataataaaatgttacacactgataaaaagtattccagaaaccaaacacataacaccattttttaattttagaaaactgccattgctcttacttagaatgccagtgttttctgaaggttcaaaacactgaagttacagacgattaanacattgcactgttacaactgctgctttccacatggttcttgttcatacagtttttaga

SEQ ID NO: 26348 - DNA, 381 bp, Homo sapiens
  misc_feature 39: r=a or g
tttatctaaggtaggtatcatccctattttatgtaaaargacatcgaggctgagtcaagcatgttgtccaatgttatatagtgaataagcagcagaatgtgaactacaacccaggtctcctgacacctcagccaggtctcctaacatttcaccagaaacctctggaaaactgaaataaatgtcccccagcccatttacaattgcccccctggtggtggaatccaagcccagcttcccttttgctgaatcctgctttctagaaataggctgccagtgaaagatgtgtgcaagtgtatatagaaatgcatacatatatgtgatagagtgggaaaatatcccagggagccatgattaccagagtactccaagaatgcagtattt

SEQ ID NO: 26349 - DNA, 181 bp, Homo sapiens
gaagttgttctgggcgagtcagtgagtgagtggtgagtgaatgtgaaggcctagggcattacacttatgtagacttgataaacactgtacacctagcctacactaaatttataaaaagtatttttttattcaataataaattaacgctagcttactgtaactttttaatttaacagacttg

SEQ ID NO: 26350 - DNA, 141 bp, Homo sapiens
aatgatcaatgatacacttgatgacatctttgacggttctgatgacgaagaagaaagccaggatattgtgaatcaagttcttgatgaaattggaattgaaatttctggaaagatggccaaagctccatcagccgctcgaag

SEQ ID NO: 26351 - DNA, 196 bp, Homo sapiens
atgtttgggatttggtagaaaggcaaaaagtaggatattttgacctgactggaaagatggttgtgtttttattgccaggtaataagtgtgatcattgttgaacttcagctccagtgtctctccagaataagacattggcattcaaatgtctatatcttgttacttacaaaataaaaaacagataattagtggctga

SEQ ID NO: 26352 - DNA, 302 bp, Homo sapiens
  misc_feature 2: y=c or t
aygaaaaattattgtgtctttgtcaaacaacaaaaacttgaacttagccctttttttgctgcagaaagtgtccttttagtggcttcttaaaattgagtggcattttataatgaacttaccaatataaaaacatgatttggttcctgagctgttgttgttggacttgtgttccaatgagtgactaggaaaaaataaattggcaaaaacctagagttttctgctatctttgctggaaatgagttgcaaaagtttttctcaagatgtagtgcgtaattgatcagagcaaaacatgcagagccgcg

SEQ ID NO: 26353 - DNA, 180 bp, Homo sapiens
aaatccagcaatacggctcccacagcacaagggggtggaggtttggccctaaagcttcaggacaccaaagaaattcagtcgaacagcccaccagttctctccatagggacctgggtcccgtgaatgctggttatctcacaccctgaggaataaagattggaatccgcactggatgctgga

SEQ ID NO: 26354 - DNA, 211 bp, Homo sapiens
actgagagggtctggctgcagacagtggcacaattacagcttactgcaacctctatttcctgggctcaagcaatcctcctgactcagcctcccaagtagctgggactacaggcattgtcaactgatcacaggtctttctcattccctgaacttcgcctcggaacttctctccgtaaaagatgttgcccacttgccatttctaggccagtag

SEQ ID NO: 26355 - DNA, 172 bp, Homo sapiens
ccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaccc

SEQ ID NO: 26356 - DNA, 265 bp, Homo sapiens
gtatttttagtagagttggggtttcactgtctttgccagtatggtctctcgatctcctgacctcatgatcccccctcctcggcctcccaaagtgctgggattacaagctggagccaccgtgcccggctacctctgtaaattttttatgcaaaattgtaggtgtttgggaaaagattcgattttcagagaaccttatctccaaaatgggtctaatctacttctctaggagcacaaaatgggcttacgtagctgcaaggcagggaca

SEQ ID NO: 26357 - DNA, 317 bp, Homo sapiens
tgaaataaatgcttgcataaaatactatgtgtatatctgtgtgtgctttctcccagcttcccctggaaattagtttactagaatatccttattgctaacacatttccacgttctcctgactctcttgggatcatctgaactatggggctaacttactctcactctactacaaaaatttaactaacaggaataatcgtaaagcaaacattttaagtgtatcctgaataaaaaattgtctccatgcttctccattctgctttctcatcttctaacaaaaactaccagaagagactaaggactaaattttgggacagctt

SEQ ID NO: 26358 - DNA, 94 bp, Homo sapiens
  misc_feature 83: r=a or g
ggggatgtggcccgtggcctagctcgtcaagttgccgtggcgcggagaactctgcaaaacaagaggctgaggattgcgttagrgataaaccagt

SEQ ID NO: 26359 - DNA, 215 bp, Homo sapiens
tcttctgtagagtcttttcttatttaccatcatcttaaaaattgacagtcatgctgataaaaacactttgattgatttcccaataccttctaagcaaaaattgtcagtactttgcctgtctttaagaggcctttactaactggcctctccttattagctttatttgccccaaatctgaactcaccttgtatttttagcaaatactcagcaccccc

SEQ ID NO: 26360 - DNA, 468 bp, Homo sapiens
  misc_feature 7: y=c or t
  misc_feature 8: y=c or t
  misc_feature 138: h=a or c or t
  misc_feature 378: v=a or c or g
aagcagyygggcgctccccggccacaggcctgttgttctcggaagggagaaagctggacatttccccacgtaactcccagctctgggcctagagtgcgtgcatggcgaagtccccggagaactctaccctggaggaghttctggggcagtatcaacggagtctccggggttgttcttgcagaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggavtatgaagtatctccgtcaagaagaagaaaaatgtcccccttgaggtcattagaacatgaggaaaccaatatgcctactatgcacgacgct

SEQ ID NO: 26361 - DNA, 161 bp, Homo sapiens
  misc_feature 11: w=a or t
catttgttaawagtagatttagtggcatttttagatgcctatttttaagcctaataaaagtatgtccgaactaacttagaagtttctgttaacaggccataaatattaaacgacagaaatggcattttatggtaggttagttttaaagcttcccgacccca

SEQ ID NO: 26362 - DNA, 307 bp, Homo sapiens
  misc_feature 1: w=a or t
  misc_feature 292: r=a or g
waacaaaatttttaaaaatattttttgggaaaagaaggctcaaatacagagtctttagatggggtagtaagcagttttgggtgaggaaaactgttcacatttaaccccccacctcccccaaaaccctacagatagataagagttaaatataaaaaaatcaaaacaaaaaataggatttgctgattcctctgggagatggaaactttccaaagtggaagcagttggaaaaataaagagagaaaaatggacagattccactagaaatacgtgcagtgaaaacagggaaagcagrcaaaaaggggggctc

SEQ ID NO: 26363 - DNA, 158 bp, Homo sapiens
  misc_feature 24: n=a, g, c or t
gcacacacattctcctgagggccngtgcctggaaacaaaggccacccccgccggccggaaacttctaggctggcaatggagatgggacatctggtgaccccctctgtatcttcctctcccttggggtcctccaggaagggctgcgtgatcaatgaccc

SEQ ID NO: 26364 - DNA, 159 bp, Homo sapiens
caaaggaatataaatcagccttaaaaaggaaggaaatcctgtcacattgctacaatatgtcctataggacattatgctaagtgaaataagccagtcacaaaaagacaaataccgcatgattccacttacatgaggcaggtaaagtaggcaaattcacag

SEQ ID NO: 26365 - DNA, 227 bp, Homo sapiens
cttcatgacttgggtaatgcttaatttcttgtcttgcatattctgaacaatgttgaagaaacctgtttctcctctccttttctccaatggctcagcaatcatttgggcctgacttttatatactcaagttattagaatctcttgagttgggagctaaatgttaggacccatttcttccaccttatttgtggagtgcttctttttatgtctcccattctgagttaacg

SEQ ID NO: 26366 - DNA, 247 bp, Homo sapiens
taaaggggagacctggccagaggaatcatcaacagtggatttgtgatgactggagttcatttccttctttctcaactgtcctggaaggaaatggactagtgccttacctctgactcttccgcagcacacacccaccaccagagacagtaactgagatctgcagtagcacagaaacttacaggttagaaaaattagacacctaaggatttcatgactccagacctgtttccttagcataataccacac

SEQ ID NO: 26367 - DNA, 283 bp, Homo sapiens
tacattatttccagtctacttcagctcctcctgccttcaatctaaaggagttgcttgcacaccttgagtaaatgtgtgtaatttctgaactgcccattttaagatttgattccaaacctatcccattcttttacttgaagcatatgcctctcaattatagctaacatcctggttctttgcccaagcctctgaggcacagttatgtaatccccattcttataaagaggcttgtagaggttaatttgcaacttcattgtagagagagagagtaatcagcccctcg

SEQ ID NO: 26368 - DNA, 128 bp, Homo sapiens
tatcacataatagtaattccaatttactaatgatcctataacgagtgaacatctgctggttattttttatatttctaaatgcaaaaagctcattttgttacctttctcatgaaatcatagtctgtgcg

SEQ ID NO: 26369 - DNA, 203 bp, Homo sapiens
aacagagcctgcctgttggtctctacccacaggggatcccctgctgctccaccatcagatttgggacaccaccccccccggccccaccagagggcatcagctatgcctagaaggggaccacaacagactcgacaggatccaccggttgggcccaaggcaggaggaagggcggcgccccaaactcccaggacgcctgcagcccc

SEQ ID NO: 26370 - DNA, 134 bp, Homo sapiens
attgcaaatattttctgttattttgttttcaggctgcctttttactctgttaatagtgtattttgatgcaggaaaatttttaattttcatgaagtccgatttgtctgttttttcttttgttgcctgtgcctatg

SEQ ID NO: 26371 - DNA, 90 bp, Homo sapiens
ctgccatgtaactggaggatgtgctatgagtttgcaaacagctggactgtcaggctgctttttttccagatgttcctcctctacctcccc

SEQ ID NO: 26372 - DNA, 130 bp, Homo sapiens
ttatttttatttgtttgtttgtgagacagagtctcgctctgtcgccaggctggagtgcagtggcgcgatctcggttcactgcaatctccgcctcccgggttcaagcgattcccctgccttagcctccaag

SEQ ID NO: 26373 - DNA, 153 bp, Homo sapiens
aaaagagtggcttaattgactcacagttctgcaggctgtacaggaaacatggctggggagccctcagggaacttacagcgggagaacgggaagcaggcacatcttaggaggaagactgcataagaggaaatgctacatacttttttttttttt

SEQ ID NO: 26374 - DNA, 219 bp, Homo sapiens
cagaataattctttcatacatcataattaaagtaacttagttcttgaaatgctttaccattaatattgtataatttcataatacaaccacactgatctagacacttatttgttgtaggaaacttaagattggtcttttaagtgctagagctctaattttgatgaacgttatatcttgaatgtactacgtaactcccacctatgttaaacccgacagtta

SEQ ID NO: 26375 - DNA, 236 bp, Homo sapiens
  misc_feature 14: w=a or t
  misc_feature 36: w=a or t
  misc_feature 155: w=a or t
caaaaaaggcagtwaccattaaaccatctccctggwgcttatgctcttaattgccacctctaacagcaccaaatcaaaatctctccactttcagctgtcttttggaggacgtacgtaataaggttttaatttagtaaaccaatcctatgcatggwttcagcactagccaaacctcaccaactcctagttctagaaaaacaggcacttggcagccttgtgatgtcatacagagaagt

SEQ ID NO: 26376 - DNA, 242 bp, Homo sapiens
  misc_feature 120: w=a or t
  misc_feature 123: m=a or c
  misc_feature 124: m=a or c
  misc_feature 133: w=a or t
  misc_feature 140: r=a or g
  misc_feature 222: w=a or t
  misc_feature 223: w=a or t
atgaatgaatagcacaactccatctcaaaaatgaatgaatgaatgaaagaagcagtggtccttcatttgccaggatttatttggggtgggttgattctcttgtagggaatctgagtggawaammttgttatawaagagcrggcaaggcccggacctactgggaacaagagatggaagagctgacttgaccgcgaggggagatgctttttgggctggagggcwwgtgacatgaataggattat

SEQ ID NO: 26377 - DNA, 368 bp, Homo sapiens
  misc_feature 66: s=g or c
  misc_feature 152: s=g or c
  misc_feature 300: m=a or c
  misc_feature 301: k=g or t
  misc_feature 333: r=a or g
  misc_feature 340: k=g or t
  misc_feature 341: r=a or g
  misc_feature 342: r=a or g
  misc_feature 346: w=a or t
  misc_feature 363: s=g or c
cactctttgcaataaatcttgctgctgctcactctttgggtccacactgcctttatgagctgtaasactcactgggaatgtctgcagcttcactcctgaagccagcgagaccacgaacccaccaggaggaacaaacaactccagacgcgcascttaagagctgtaacactcaccgcgaaggtctgcagcttcactcctgagccagccagaccacgaacccaccagaaggaagaaactccaaacacatccgaacatcagaaggagcaaactcctgacacgccacctttaagaaccgtgacmktcaacgctaagggtcgcggcttcattctggargtcagtkrrgacwaggaacccaccaattcsgacac

SEQ ID NO: 26378 - DNA, 154 bp, Homo sapiens
tctaggaaactatgattctggttgttcaggattgttattattatagttgtgtaaaattattttattttgtgtgtattgtgcacagcttggggggggcgggaaatgcactaattgtgctcttccttataaatggtacatattactgacacagacg

SEQ ID NO: 26379 - DNA, 122 bp, Homo sapiens
ttgagcatctctcatgtgcttgttggtcatttgtatatcttccttagagaaatgtctactctattcagatcttttgccattttaaattgggttatttatttatcattgagtagtaagagttt

SEQ ID NO: 26380 - DNA, 282 bp, Homo sapiens
ctaaaaaccttcttggtgacttctcgggcctttggacaactttggtcgtcttagacaagttgatgggtttctgagaggctcttttaatacttgcgaggagataccgacagacaaggggaggggatccagcgatgggatcagtcagatgcctgcctggccgctccccgtgaggggacttgggctcctcttagcattggcaggccggtataaacttccggctcagatcgagctatgcctgatgctgccttaagccttatgaggtcgccatggaaccgcagaata

SEQ ID NO: 26381 - DNA, 118 bp, Homo sapiens
gaaccacaccagatgctgctggcacgtctgcacgaggactgagaactgacgagtgggtttggcgatgagaacgccggaggggccttggcaagcagttttagcgcagtgagggcggaac

SEQ ID NO: 26382 - DNA, 128 bp, Homo sapiens
taggagataattttgtaaattttgatgctattattttaactctattagcttaagtaatgtcataatagaaaacacaagcatttgaccaaatgagatccattcagcgactaacctggcaaggcactcgg

SEQ ID NO: 26383 - DNA, 143 bp, Homo sapiens
  misc_feature 109: r=a or g
  misc_feature 112: w=a or t
aatattttttggactattattagcaaagccgtagtgagcattcttacatgtttctttttgtagacacttgcacacatttctaggagaggaattgctagtgtgtagggarggwatgcacatgatcagtgatagtagacattgcc

SEQ ID NO: 26384 - DNA, 136 bp, Homo sapiens
tatgtcaatgtcgcttttattcttccctttacctcccagcccgccgacttcctggtcgtcgcacgtcctcacgtatgactacactacccagaagtctcctcttcacgtcccagcgcgggtgggcgccgacggccat

SEQ ID NO: 26385 - DNA, 301 bp, Homo sapiens
  misc_feature 124: k=g or t
taatcttactcttcaaagctcaactcaatatcacatccttaaggaaaattctttggggagttctcctgttttatgtgctaatcttttcttagaccattatttcatagcaattataatgcttggkttatttttatttgtgtaattggttgactgtcaatcacagtagaccctaaaatccatgaataaatgagccatgttttatttttcacagcattatatctcaatatcttacttagcatattgtatgtagtcaataaaaagattgaattaataagaaaaaagatccataaactgatgccag

SEQ ID NO: 26386 - DNA, 154 bp, Homo sapiens
tatgagctaaaatgtacaaaagagtccacatgcaggcataaatagtgtttggatttgaggacaagtcatcttttccttttcatttaatccttggtttctagagacattctgacttttgatgttgctggaagatttcaaaaaattactgggccga

SEQ ID NO: 26387 - DNA, 238 bp, Homo sapiens
gcaccatttgttgaaaggggtgtcctttatgtttttgtttgctttgtcgaggatcagttggctgtaagtatttgggtttatttctgagttctctgttccattgatctatgtgcctatatttataccagtaccatgctgttttggtgactgtggccttatagtatagtttgaaatcaggtagtgtgatgcctccagatttgttctttttccttagtcttgctttggctatgcgggcttt

SEQ ID NO: 26388 - DNA, 197 bp, Homo sapiens
  misc_feature 22: r=a or g
agaaataaaaaaggcaattgaragctttagcgataaactagatgataaagcagaagaaagaatttcagaactcgggctgggtgcagtggttcatggctgtaattccagcattttgggaggctgaaacaagcagatcgcttgagtccaggagttagatgggcaacatagtgaagccctgactttacaaaaaaaaaaaa

SEQ ID NO: 26389 - DNA, 302 bp, Homo sapiens
tggtttaatgctctgcagtcatcattttgaaattgttaataatttttaacaaagagccctgcatttccattttgtgcttgccccacaaattatgtagcttgtcctgccagggagttcaggctgagtttgggacggcttcatccccaacactggccttgcagcctccactgtccccatcctaatccacagcctcccactaaatgccagcctgctggtgtcatcctcctgcatggaggccccctccccacagtgcctggagttacagcattgccctgccaagccagcagctactacccgccatc

SEQ ID NO: 26390 - DNA, 172 bp, Homo sapiens
gattactgttcggaagaagaggatatcacatagcaccaattttaccactcaaaccaggagctactactgtgtaaataggttacaccccagttgaaatctttgcaaaggtcggttctattcagcgaacagcactatagcaaaagaagatcgttccatattgtacgccccagta

SEQ ID NO: 26391 - DNA, 97 bp, Homo sapiens
catttccagaaaaaagaaatctcgtgggagctactgagttctcttttccttctaggcagataaggtcatggggaggaggactgcacacaccccctac

SEQ ID NO: 26392 - DNA, 142 bp, Homo sapiens
  misc_feature 116: m=a or c
  misc_feature 123: r=a or g
accagatcccagaggctgaacagctcgactttctctgcacagcaggtccagcatcctttgaaacatgagttcttaccagcagaagcagacctttaccccaccacctcagcttcaamagcagcrggtgaaacaacccagcgca

SEQ ID NO: 26393 - DNA, 131 bp, Homo sapiens
tacatagggcttttcatagtctgtttcagaaagctgaacacagatattttcaatgtgtatcatacagtggaataaaggaataggagaaacatcaatttttgcttttaaaattcctaacatagctggagcga

SEQ ID NO: 26394 - DNA, 76 bp, Homo sapiens
  misc_feature 3: r=a or g
aaratattttcatttaaagctcaaccattaattggaacatggtgaaacattgtacacattgtaaaagtagggtagg

SEQ ID NO: 26395 - DNA, 144 bp, Homo sapiens
tcaaacaattaaaatattttcatttcaattttttgaattttaaaaatttcaaaagtgcttttatttacagactaatgtggccaagaagtatgataagggtgattgataaaagacattcaagcatgaaaccattatattaggaca

SEQ ID NO: 26396 - DNA, 145 bp, Homo sapiens
gcttcaggaatctcacaatcatggcggaagggtaagaggcatgtctcacgtggtggcaggcaagagagagtgagtaatagcagggaaaactgccccataaaaccatcagatatggtgagaagtcactcactatcaggagaacagc

SEQ ID NO: 26397 - DNA, 175 bp, Homo sapiens
ttgacagcgggtttcctgcccacatcggaattgggagacggtgaacggtatgtccttcatctctctgacctctgagaaagagaagcagcgatcctttctggctcgcctctgcattggttgctgagggtctgctgagaggtgaggagcggcgctgcagcgtgtagtgaatgagctg

SEQ ID NO: 26398 - DNA, 118 bp, Homo sapiens
tttaattaatttgttttgagagacgggatctcattctgttccccaggctggagtgcagtggtgagatcatagttcactgcggcctcaacctcctggcctcaagcaatcctcccactct

SEQ ID NO: 26399 - DNA, 169 bp, Homo sapiens
  misc_feature 2: w=a or t
gwttccactttagggcttttccttggaattttctctgactcatacagtttggttcctcagttcctctgagattttttactcagaagctacccccttagtgatgtgtcttcccttatttagcgctttaagctccccttctcctaaatactctttagcacttatcaccaac

SEQ ID NO: 26400 - DNA, 235 bp, Homo sapiens
accctcaaagcacaaggtctcttcagtcagcttgtggtgaatgctgtcaggcctgggtctctcccttcagggcagcaggctcctctctggcctggggcaggtcccgaaatgctgtccagaagccaaggcctgaaattggggaccctaggggccctcttggtactgttgtcaagctggtgaccaagctgcaagataaaatcccctttactcttctctctcctttccttgagcagag

SEQ ID NO: 26401 - DNA, 131 bp, Homo sapiens
ttcagaaatagttattatgtgttcctctaaagaccttactatttcctaggtaaaatttacaattctgtagtcctacctcttgtcatgctagcaaactacttttatatactccagttgaatataaatggcca

SEQ ID NO: 26402 - DNA, 151 bp, Homo sapiens
  misc_feature 146: k=g or t
aattgctgatctttttcccaactgttgacagggatcactgattttaaacaaaaatcttctaagagctatgaaatgttcttctaagtatagctttggcatttcccatagttttaatatgtaacgtgtcattaggtacaatatatttkctaat

SEQ ID NO: 26403 - DNA, 171 bp, Homo sapiens
ttgatccccaccttctgcggtaacatttttttatatttgtccccactgtcatggaacagcatagtaagaagcctttgcattggatgttgttgtatttttctcttggttgttgagaacaagggactaatgaaagaaagaaggtaatggaagaataaaccaaactggcaagtt

SEQ ID NO: 26404 - DNA, 241 bp, Homo sapiens
aagcaagagaggggtgttcaggatgataaagtcctggttgatgaaggcagatgcctgcagctcttccctggggcagggctggcttccatagggtgcttgtttgggccctttggaagggggtgtgcggatgtgcagggctgcttgtatcattagaatggctgttagaatttcattctttctttcttaccatgctctgtctctctgcctttgtacatgtgcgtttgcatttctctccctcctc

SEQ ID NO: 26405 - DNA, 265 bp, Homo sapiens
  misc_feature 111: s=g or c
agtatacccaagtagaatttttaaccctagtttatacttcccatcagtgagtagactctggctttcatgtgctctgtgcatccctaaagatgccctaccattatcaatgtsttcaagtgttgttgaactggtttttgagatccagcaatgtttatattacctcagcgtcatctgtagagtgggattcataggaataagccagcataccagcagatggtgctagtctcttaacttttcagaaaccaaaacctatatcttacttcca

SEQ ID NO: 26406 - DNA, 200 bp, Homo sapiens
ctggtcattgtaccaaacaattttatcaacaatacatatttaagattcagcctctattcaactagcattttgcaaggactgtggaggagaacagggccagaacagaaaagggttcggacaataaatgcaattggaggaggaaaaaataataaccacataaaccatttttcggtttctatagttactttaaaacccgatga

SEQ ID NO: 26407 - DNA, 277 bp, Homo sapiens
actgggcatgcagactagattaaaagaaacccccatgagtttccaccaattatgttagaaaggtatctcatagtaggtatcaactgtgtgaaatttatgttagatttctgatgagagatcaattatttttttttaaagtgttcatcccacaattgggcacaatggctcatgcctgtaatcccagtgcttgtaatcccagcactttgggaggccaaggcaggaggatcacttgagtccaggagtttgagatcagcctgggcaacaaatcaagaccccc

SEQ ID NO: 26408 - DNA, 145 bp, Homo sapiens
tcctacttctgttctggtgacaaccacagatgtgttgggcacaacaagcccagagtctgtaaccagttcacctccaaatttgagcagcatcactcatgagagaccggccacttacaaagacactgcacacacagaagccgccact

SEQ ID NO: 26409 - DNA, 133 bp, Homo sapiens
agggcatggctcacaaaaggttaatggatgggggttacctagccctggctaattccccttccattcccaactctctctctctttttgaagaaaaatgctaagggcagccctgcctgccctccccatcccccgt

SEQ ID NO: 26410 - DNA, 275 bp, Homo sapiens
agagaataaaatacctaggaatccaacttacaagggatgtgaaggacctcttcaaggagaactacaaaccactgctcaaggaaataaaagaggatacaaacaaatggaagaacattccatgctcatgagtaggaagaatcaatatcgtgaaaatggccatgctgcccaaggtaatttatagattcagtgccatccccatcaagctaccaatgactttcttcacagaattggaaaaaactactttaaagttcatatggaaccaaaaaagagccagt

SEQ ID NO: 26411 - DNA, 234 bp, Homo sapiens
tcgcttgagcacaggagtttgagactagcctggacaatatagtaagacctcatccctacaaaaatatcaattacctgggcatggtgtcacatgccagctgctctggaggataaggtgggaggatcacttgaaccctggaggttgaggctgcagtgagccagtgcactccagtctgggtgacagagcaagaccctgtctcagaaaaaaagtaatttgggtctccttcaaccccca

SEQ ID NO: 26412 - DNA, 173 bp, Homo sapiens
ataaactttgtcggtgatgcttaaagaaaaagataagaacagaatacaaaaggagagaacagtttcacacgggctaggtggttaagacataccaacatactccaaaaatatggcagttgaccttgacaaagacttgaagtttgttgtggcaatgggtgtggggtggaggggcg

SEQ ID NO: 26413 - DNA, 183 bp, Homo sapiens
gtttatttttttaaagacctgtcagcaggaaatactccttgccttttaagaacaactttattgaggtataatttacataccataagatcacccattttaactgtataatgcaatgattgttagtaagtttaccgagttgtacagctatgaccacaatctagccacagaacgtttctgtcaccc

SEQ ID NO: 26414 - DNA, 110 bp, Homo sapiens
cacaacctctgaatgggaatggcatgggtaatgatgcttgagaacataccaagccccactggcatcgcccttgtctaagtcattgactgtaggtcatcatcgcaccctgc

SEQ ID NO: 26415 - DNA, 150 bp, Homo sapiens
aatgcacagatagaatagtagcagtgacaatgatgctagaggtcacctaccccactgtcctcttgtccttctcccccaaccctcccctgctcccaggcaagaagccctctagcctctgcttgatcactttcagcactcaacatctccagg

SEQ ID NO: 26416 - DNA, 321 bp, Homo sapiens
  misc_feature 104: r=a or g
  misc_feature 106: r=a or g
  misc_feature 122: r=a or g
  misc_feature 129: v=a or c or g
  misc_feature 130: b=c or g or t
  misc_feature 131: k=g or t
  misc_feature 133: d=a or g or t
  misc_feature 140: r=a or g
  misc_feature 150: n=a, g, c or t
  misc_feature 156: w=a or t
  misc_feature 157: w=a or t
  misc_feature 164: w=a or t
  misc_feature 172: w=a or t
  misc_feature 184: w=a or t
  misc_feature 186: w=a or t
tttaatgtaacagtatgaaaagttcactgatacactttcagtttccacattgtaattgacttttatgaatcttacaagttgtacagttttgatgtagtatcagrtrattatattcacaattrtctaaavbkgdtgttaargggctcctancccttwwcaactawctatcttwgtgggtttggawtwtcttctctatgtacttcaaccaaaattgcaacagatgaatgcagaaataggagaatctggttgtctcgtgttacaagtcaaacacatttccacatgtataacattctaaaacaatgacactcgtctcactaattt

SEQ ID NO: 26417 - DNA, 184 bp, Homo sapiens
cccttttccctttctgccctctgccatgtgaggtcacagtgttcctccctcctgaggatgcagtgttcatgaaagcaaacactgggccctcaccaggcaacaaacctgctggtgccttcatcttggacttcccagccttcggaactatggagcccgcactctccagttcatcaccaccccagca

SEQ ID NO: 26418 - DNA, 130 bp, Homo sapiens
  misc_feature 27: w=a or t
aaaaaagatttttaaagcttttatgtwataccatggagccatagaaaggctatggattgtttaagaactattttaaagtgttccagacccaaaaaggaaaaataaaaaaaaaggaatatttgtacccaac

SEQ ID NO: 26419 - DNA, 390 bp, Homo sapiens
  misc_feature 12: y=c or t
atctttaatatycccttttctgatttaagttaagaatagttacttggcaaattataaaacaagagtatagaaatggctctcttattttggccgggtgcagtggctcatgcctgtaatcctatcactttgggagcccgaggtgggcggatcacttgagcccaggaattcgagactaacctggtcagcatggcgaggccctgtctctactaaaagtacaaaaattagctggttgaggctgaggcaggagaatcgcttgaacccgggaggctgaggtttcagtgagccaaagtcacgccactgcactgcactccagcctgggcgatagagtgagactccatgttaaaaaacaaacagacaaaaagaaatggatctctctcttttttttttttt

SEQ ID NO: 26420 - DNA, 267 bp, Homo sapiens
  misc_feature 79: k=g or t
  misc_feature 141: n=a, g, c or t
tgtgtcttagttttttttaacatggatgtaattccatgtaaacaggtatggaagtaggagtttaggctggacttggtgkattaattgactttcttgggttcttgggagtcaacattactaaagcagtgtgaatccctgttngcttcagggcgagatgtgtgacagaggtggcatcaagctcacagtcccaaccctccaacgatgggcgaagatctcaggaatggcatcggtcacaggaaatcgatagtggctggctgctagcatggc

SEQ ID NO: 26421 - DNA, 103 bp, Homo sapiens
tcaataaaggacagagagaagtagaggaatctgaaaaagtaggaaggggatcgctctttctaacctccaggtcagtaagtattcatgaagttctcgccgcttc

SEQ ID NO: 26422 - DNA, 267 bp, Homo sapiens
  misc_feature 80: y=c or t
tatagcttactgcagccttgaactcccgggctcagatgattttcttgccttagcctccatagctgggactaccggcatgyaccatgcctggctaattttttgaatttttttttgtggagacagggtctggctgtgttgtccaggctgggctcaaactcctgggctcaggtgatcctcttgccagattcccaaagtgttgggacaggtgtgagccactgtgcctggccagtttacaaaattttaagtcttatttctagagacttatct

SEQ ID NO: 26423 - DNA, 105 bp, Homo sapiens
tcactattaccaattctgcaacactttcttcactcccaagagaaaccccatactcattagtcattctcccagccataggaaagggcaaccagcccatcacatttg

SEQ ID NO: 26424 - DNA, 264 bp, Homo sapiens
  misc_feature 75: y=c or t
  misc_feature 76: m=a or c
  misc_feature 179: w=a or t
  misc_feature 245: r=a or g
  misc_feature 246: s=g or c
cagcatatgtgataatatcaaacagattcagatggtgaaagtaaaatttcttaatgagaaataacataatttgaymtcatttggatatgttattaagttgttgtaagatatgaagacgtagctgttactactgccaatagtataaactttggattcagacctagctgtgtttgaatatwctctcccacatcccacgaggtgggcaagctattcacatcattgtcactaccgtcactactatcccrsccacccttgcttcatttt

SEQ ID NO: 26425 - DNA, 262 bp, Homo sapiens
  misc_feature 42: y=c or t
  misc_feature 75: y=c or t
  misc_feature 76: k=g or t
  misc_feature 178: w=a or t
ttctctggaagtatagactcatgccctttttactttgctgtytgtctgcatatctattggtttttacattcttaykccttaaatttttctatcaggtaagttcttagactgaaagtggcttaagcttttgtcagtaatatttgtttgggtcttcattatgtgaagagtttttggcacwgagatgtatagaggagctgttgtgtgtattagtgtgtatcacgttgtattaaaattaactgtttacatatttcctcctcctatt

SEQ ID NO: 26426 - DNA, 231 bp, Homo sapiens
tcaaatgtcttacatgataataccccaatttccagtctttaattgattgtatacctcacgtaagtgtctgtcatcacttgatacctgtatctggcactaaaacaaatgtagccggctctaatgaaatttgaagtttggataggagacattgtaaaactcaagaatgggaaaaaaaaattttaacagaagtatgtatgaaggaaatattttaagtataatctacccaaagaa

SEQ ID NO: 26427 - DNA, 139 bp, Homo sapiens
gggtttttcacatatgtaggtattcattttgagtaggttgaagaagaaaaaaaatatttaaatgaattgaattcctgatgggatagtatcaataagtatttaaaagccagtattctaaaaataataaagggtagggagc

SEQ ID NO: 26428 - DNA, 371 bp, Homo sapiens
  misc_feature 14: k=g or t
  misc_feature 15: y=c or t
ttaagtgtagactkyccctatttaaggagctgagctaggattcatgtcatggttatttaagtataaggagtgagtccaatttttgtttctttttggtcagaagagttagttcctgttcaaacccttgaattaaacaaattcttccgcagtttcctagtgtgtgtaactggatatgagcctattgtctctcagtggtactgctttgagaagagatcccttaggacagtgatccttccattgtgggccccacatcatcatcagcagcatctgggtggggtcctcaggactgaattttactgtttgcagagtcttcagttttgaaattcgataagccctccagtaatctgattcattaaagctcgagaaccaca

SEQ ID NO: 26429 - DNA, 425 bp, Homo sapiens
  misc_feature 359: r=a or g
  misc_feature 405: k=g or t
tatatcttagggttagctaaatgtatgctactatttcaatatggagcttaaagagaataaatattctcccaaaatacaaaagagtcctgtggttatagtaatccagctttaagctttggtgggttgttgctattaatgtagcaaatccaggcactaaaagtggtcacttggaaatatttatttccattaaaaatatccaacatcaagggtgtgtgtctggatatgtaagtgtttgttgttacagtagcagatttgtaatgtccagtactttttttatttgcttcttgtgtactaactgcaagattgtggttaaggaatacagtgtctatatttcttaattgtataacttcttcattgaratacgtgttttatcttaaattcaaaagaaaactccttttttttgckttgtaggaattgctggttac

SEQ ID NO: 26430 - DNA, 422 bp, Homo sapiens
  misc_feature 392: k=g or t
  misc_feature 422: r=a or g
tataatatgagctcccatttactgatgatttgtggtgctaggcactatgataagcattttactaaactttgatctctcttacccttacctcagccttgagagaacagtaatgtaagttccatttatggatgaggatttgttttttttaacagctataaaacttgagattcagttgaaggtacccaggaagaagcagagccaggcccatggaactggaatgcccaggctttttttttacagtgccagcctgtttccacagtaaatatgggacaaggagctatgaatcaatgtcataaccgtatcaaaaacatgtgaggaccagggattgtgacataagagctaacatttcttgagcacttaccaagtgctaggcactgttctaagtgctttckatatattatcaaatcctcagagtaggccar

SEQ ID NO: 26431 - DNA, 329 bp, Homo sapiens
cccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggcgt

SEQ ID NO: 26432 - DNA, 220 bp, Homo sapiens
aatgtgtctagagggtttatgacgtgctctctccatgtaagtactaacactctgggtgactgtgtaagaggtggtgtttgtttgggttttagctcttcataaaccaaccacaggaagatgtggtgacttgatacgagcaaatgcttgtgcggaatactttttcaaaccattccttgggtgtattagaacctaaccataaacaatatgaaaagccccgaga

SEQ ID NO: 26433 - DNA, 434 bp, Homo sapiens
  misc_feature 223: k=g or t
  misc_feature 302: m=a or c
cactctccccatttgtaaagtagagataatgatgtcttatgaagtaggcaagacagatttttatgaggatcataaaaatctcagtaagatgtgattaaagatctatttatgctaacaaaaggtgacatcattttaacaaaaggtactgagacttatttgaatcttgtcctgtggcaaagatgaaaaattcaagtgatatttatttatttatttattttcgagkcaggatctcaccctgtcagccaggctggagtgcagtggcacaatcatggctcactgcagctttgacctcacagactcamatgatcctcctgcctccatctcccaagtagctgggactacaggtgtgagacgccactccaggctaactttgaaaaaatttttgtagaaatggggtcctactatgttttttgggctggtctccaactcctgga

SEQ ID NO: 26434 - DNA, 417 bp, Homo sapiens
  misc_feature 217: s=g or c
  misc_feature 218: r=a or g
  misc_feature 229: v=a or c or g
atacgttttaatatatccacatatagaaacagtgtgtcattaaaaattgaggtagatacatatgttaatatgtgctgtatttttaagtgaaaaaaagtaagatgcacagcagtgtggttcttgttgcatttggcatatgtatgttgtacaaacatgcacctgaatgtgcacacatgttatgtctgcctcctccatttcctttggttgtttcctgaasraatcataagavatgaaatactggtcattggtcactggctaccttttgggaataaaaatgaggagatccttgtctttgacttttgacaacttgaccatgtgccttggagaggatctttttaggttgaatctatttgggagtatttgaacaccctggacctagatgcctatctctttcccaagacttgggaattttgggct

SEQ ID NO: 26435 - DNA, 146 bp, Homo sapiens
cagatagtgacaacccagagaaatcaacaagactgtgatggggaaagcccaggggggttttggaggaggcgcctggcccagcatgagaagaggattagggagttcttcctgtaggagacgacatctgaactgagagctgtgggagg

SEQ ID NO: 26436 - DNA, 413 bp, Homo sapiens
  misc_feature 362: r=a or g
tgaaataataatactaacaacagcattctcttacctaatcacagtagtattatctcatctaacaataaataatactttaatatcatctaataccctgatcatattcaaatttctcccatatatcaagaaaaagaatgcctttttataattgttttgtttgataaggattccattaaggtcgactcagtgtatttgtttgttaagtctctattaaatgagaacattttctgcccccaccctttttgttgttgttgtgccattgacttgctagagaaaatggatcatgtttcctgatgaatggatttggctgattacttccttaggttatgttcctctgtctctgatatatgctatagattgaragatataaaggcttgattaaattcaggtttaattttttttttcctttgcaa

SEQ ID NO: 26437 - DNA, 209 bp, Homo sapiens
tgtcaggtttgtcaaagatcagatagttgtagataatgtggcattatttctgagggctctgttctgttccattggtctatatctctgttttggtaccagtactatgctgttttggttactgtagccttgtagtatagtttgaagtcaggtagcgtgatgcctccagctttgttcttttggcttaggattgacttggcaatgtgggctca

SEQ ID NO: 26438 - DNA, 192 bp, Homo sapiens
  misc_feature 79: k=g or t
ccacatcagccttctgagtagctggcactacagatgtgtaccaccaggtctggctaattttttaaaattttttgtagakagtgggtctcactacattgcccagggcttgtctcgaactccaggcttcaaccagtcctcccgcctcagcctctcaaagttctgggattacaggcaggagccactgcgcccaca

SEQ ID NO: 26439 - DNA, 364 bp, Homo sapiens
  misc_feature 20: r=a or g
  misc_feature 21: r=a or g
  misc_feature 342: s=g or c
gcagttcggcggcagtgccrratccaaagtctcctcatcttcgggcacgacgcctttcagctctgcagcagctttgcctccagggtcatacgcatccttagagtccagacacatgagggaagacatggagtacataggcctggactcaggtcggatccgcacaagacggcaaagctctgggagtgccaccaacgtcgcctctacacctgataaccggggccgcagtcgcgctaaagtggtttcacagtcccagcctggcagccggtcaagttccccaggaaaattgttgggaagtggttatggtggacttactgggggctcctcacgaggcccacctgtgasaccgtcttcagaaaagtgaagc

SEQ ID NO: 26440 - DNA, 309 bp, Homo sapiens
  misc_feature 183: k=g or t
atagggctgcaacctgcccatctcacaaccaccaacatttgcctttttctgaataaacatatgtgctctgggggtttttatgtcagtatttagtctgcatacttccctaggagtcctgggcatggggtggatcctggaacagatcagaaatgccttttcagcagtgtctgtggaatgtgtgtktctttccttctctactagggctccacttccctatatctgtctcttcacttccttactttcaggaactcaccagctaggcagaagctgcttcctgcatagcccactttctatttgaagcccactgac

SEQ ID NO: 26441 - DNA, 386 bp, Homo sapiens
gtcaagcactccacagttatttccccaattccccaacgcacaccctcaaaatctgtctccctttaagataataccatgatgtcaatatcataacactcatatttcgaaaggttagtgctgtttaagacgaaatgtgaattagttgtcaagactttgtttgatgcctaatatgggatcatcaacagaaggtggatggtgtgcatcacaatttgtgcatatcgcactaagttgaaatccaatatgatcaacggaagactccaaccacctgaaatttcattcgtgagtcattttgtgcatatccctccaagcctttattttatcctaggttgatcttcctcttgattaaatcttctttgacaatttagtactcgagtccatgacgacag

SEQ ID NO: 26442 - DNA, 242 bp, Homo sapiens
caaaaaaatgagctgggcatggtggtgcacgcctgtaatcccagttacttgggaggctgaggcaggagaatcacttgaacccgggaggcagaggatacagtgagccaagatggcgtcactgtactccagcctgggtgacagagcgagactctgtctcaaaaaacaaacaaacaaaaaaaacttgtattagaaattttaaatgattaatgtcagaactcaaagtttaaaatttacatgtgcca

SEQ ID NO: 26443 - DNA, 404 bp, Homo sapiens
  misc_feature 183: r=a or g
  misc_feature 368: r=a or g
attttttgaattggactggacgcggtggctcatgcctgtaattaatcccagcaactttgggaggccaaggcggatggctttagaccagcctgggtaacatggcaagaccccatctctaaaaacaaaaaaaggaagaaaaaagcaagctatttaaaaaatgtaaaagtatacttgaggattaaractgaaacagatttttccagctgacttgccaaatatgctcaggtacgtgctgatttgcctcattaacaacctagagactgaagtggcaagaagaatcgaatatactctgttctaacctttctgatgtttgcttgttaagtgggaaacttaaaaatttctactgtccactatagtagtactttgaraaataagttttctcccagcacaaaacccatgtcagc

SEQ ID NO: 26444 - DNA, 177 bp, Homo sapiens
atttttggagtctgatttgggggcggtgtggttgtctcagtggcgtatgacccactttgtgtaatacttaattgcctgtgtttttacaacacaagtcagaagttctggcgatagtggactatcacccaaaaaagattttctgagacatctcatcagagttgctcgagtaccgcgctt

SEQ ID NO: 26445 - DNA, 266 bp, Homo sapiens
  misc_feature 78: k=g or t
acactctttcttagtgttctgcaaatgcaccatgcaagctcccacctcagggtcttcacatttgttatcctttctgtkaggaacacttgactcaggttctccatagttgggtccttcatctctctcttcactcaaatgtcatatcagaaagccttccctgaccacactcttgaagattacagtcatttcctcttctaatgctcaccatcgtgtttcctacttagtttttctccatccaggcctccggatcactctccatcctactt

SEQ ID NO: 26446 - DNA, 423 bp, Homo sapiens
gattggttgttcttaaaatcactgtccacagagcaagtgtgctcatatgggctccacctgcaaaggtgctggttaccatttgtcttctctcaaacaaaattcaagtctgggttaacttcccacagatggttttgaccaaaaactcactctcaataagcaattgagaactgtcgtatcttaactccagttagcatttattaagtttgtcctttttgtgtgcttgcaaggctgcctggaacccccatcagtactgcaagattttacttttctttctttaaaataaactccatgatagattaaataggatctgttgctgcatcccctctggataaatacatgttgcatgggaaattggtcaactctttaagcaggctgatggcagtcagctgctgaacctgggaggctgcgtgcttctgatttcct

SEQ ID NO: 26447 - DNA, 120 bp, Homo sapiens
  misc_feature 20: y=c or t
  misc_feature 85: m=a or c
  misc_feature 115: w=a or t
  misc_feature 116: k=g or t
tcttttctttcttcatgatyagacataaacttagcatcttaatggaagaaaaatgaggggaacttcaattatgatttattaaagmcaatttctattacaccctcctttatgacawktgac

SEQ ID NO: 26448 - DNA, 292 bp, Homo sapiens
ttaaagacttaaatgtgagacccagaactgtaaaactactgggaagaaacataggggaaacactctagcatattggtctaggcaaagattttatggctaagaccctaaaagcacaggctgcaaaaccaaaaatagacaaatgggattatgttaagctaaaaagcttctgcacagcaaatgaaacaacaaagtgaagagagaacccgttgaatgggagaaaatatttgcaaaatatctgtctggtgacaagggactaatatccataatacacaattccaacaactcaacagcc

SEQ ID NO: 26449 - DNA, 473 bp, Homo sapiens
  misc_feature 331: d=a or g or t
  misc_feature 450: s=g or c
tttaaataaacgaagggtaaagttttctttaatcagttttgataattgaatcagtaattcgaatagattttttcttggtagagttggtatctacgcatttgtggtcccttgcccagtgttaagcttttgtagttactgtttgcatcactggtgctttgggggttttctgttaaattgacagctcttactataagagacaaagtcgaaaaaaaaaatcttaataaaaattgacagatatcattatttgtgacagatacagtaaatttgaaaattgccttcacataactttataattagaggactgagattttacattaggaatccaattaadaaaaattagccggacataatggcctgtgcgtgtagtcctggctagtcaatgggctgaggcaggaggatcatctgggcccgggagttggagactgtagtgagctatgatcacaccactgsactccctgggcaacagattgaga

SEQ ID NO: 26450 - DNA, 423 bp, Homo sapiens
  misc_feature 264: r=a or g
  misc_feature 265: s=g or c
  misc_feature 322: r=a or g
tagttacaaatgtttatacttcaaagttgtctctcaggtatttgacaatcctctccctcactagcctcattcatcttggaaatagaaggagattcctagatatcattgaacattttgaggtaaaatgaatcataaaagagcatatatatcaaatatattttctatggcaatactgaagcccagataggttaagtgttctgctcagagtcttttatctgtttaatggcaaaccttaaactagacccaggcctcccgagtccagtrsccttttcattatactgttggtaagactgtgactttaggcactgaatggcataatgaratcacacagttttgcatgccttatagaaggagggcactctgaacattgtcagttgagtaataactgcctatattttcagggacgtaacaaatcctggaaga

SEQ ID NO: 26451 - DNA, 389 bp, Homo sapiens
caaaaattcctttgtcctatgaacaccaaaaatttgagacaggtctcagttaatttagaaagtttattttgccaagattgaggacacacctgtgacacagccttaggaagttctgatgacatgtgcccaaggtggtcggggcacagcttggttttatacattttagggagacacgagacatcaatcaatatgtaagaaatacattagttccatccagaaaggtggagacagctcaaagcaaggcccccccattggggacttccaggtcacatgtaggtgagagagggatggttgcattctttggagtttctgataagtttttccagaagaggcaatcagaatatgcatctatctctgtgagctgagagatgactttgaatagaatggga

SEQ ID NO: 26452 - DNA, 422 bp, Homo sapiens
  misc_feature 389: r=a or g
  misc_feature 390: w=a or t
  misc_feature 416: m=a or c
cataaaaatgaaaatacatgtttattatttagaaatggttagtgactggtattgaagtattattcacacttatgtttgtaataatttatttaaagaatgccaacagtttagcacacttttgtaatctctagaacagttctatacattaaaaataaacattaaaaataaagcagttcctttaaacaacttactatgaaactataattgttaatgaaataagatattcctatgtatacattagtatgatttaagggtatgaaaaacagtgctaaaatgtggagttaattggaatgtgtgcagctgcatactcactttctgtgtttttatatttccttacctagttttaaaaatcatcacttttcggcacttcagctagacttatttcaatrwtatagattatgattaatgaaggagcmgtcaga

SEQ ID NO: 26453 - DNA, 452 bp, Homo sapiens
  misc_feature 21: r=a or g
  misc_feature 273: r=a or g
  misc_feature 274: k=g or t
  misc_feature 275: s=g or c
  misc_feature 373: r=a or g
  misc_feature 396: b=c or g or t
  misc_feature 397: k=g or t
  misc_feature 400: s=g or c
  misc_feature 401: k=g or t
aaaagaagatatgttttaagrctgtacggagtctgggcaaaaaaagtgagaccctgcctctacaaaaagtggaaaaaatgtgatggcacatgcctgtaatcctagctactcgggaggctgagctggaaggattgcttgagcccaggaggttgaggctgcagtgagctatgatcacgccactggattccagcctggatgacagagaaagatcctgtctcagaaaaatttaaacaagagacctctcagccacacatggacagataaaagactatrksaggagttctctagtttcctcggataaaaatgaagataataagagttccagcccacaagcctcccctggtagacaacaatgttttcataactgcaagcracaaggtagtcctagccctctgbkctskagttaaggcgttacgcactgcccaggagagggaaattctctctgtagctgt

SEQ ID NO: 26454 - DNA, 402 bp, Homo sapiens
  misc_feature 12: y=c or t
  misc_feature 47: y=c or t
  misc_feature 112: w=a or t
  misc_feature 114: w=a or t
  misc_feature 120: w=a or t
  misc_feature 124: r=a or g
  misc_feature 202: m=a or c
aatccttataayagctcacttgctgtgaatagttgtctgcttttttyggtttgcttagctttaacaggggttgacaaactatggccgtgggacaagtctacctttctctgtwtwtttgtwtgtrtgtttgtttctttttcaatggcttccaggctaagaatggttttacatttttaaatggttggatcaaaaacaaattcamagcagaacatgtaagaggccatttgtagccacaaaacctacatagtttactctctgaccctttatagaaaaagttgactaacaaggtttgtgtgaaccaggatggtttcattattttcattattaagtcttgtcttttgtagtctctgaattgttaggcatgttacatgttgatatagacatgctctgaaataaaggccc

SEQ ID NO: 26455 - DNA, 251 bp, Homo sapiens
  misc_feature 13: w=a or t
  misc_feature 20: s=g or c
  misc_feature 47: k=g or t
aaaaggtgtatgwaacagasttgctgtagttaatgcaggcccagcakctttactcttcccactgcctccttgttgcaaacagagataaactttgtgcagccctagtaacctctaaggtgttgccaagggatttgaacacgactggtgcaggttcatttctgtagcctcttaagtttcaggattttttgctagctattgacaggtagttaacaaaaatctataaaacctgtatactaaatatacaagcagac

SEQ ID NO: 26456 - DNA, 118 bp, Homo sapiens
  misc_feature 46: k=g or t
tacagttttcttttgttctgaaagcagtcagaacatagccatagtkacagaatgtgggttttaaaaagcaatctagaccagtgtccctttcttagcatcctactttgacaaccaggcg

SEQ ID NO: 26457 - DNA, 450 bp, Homo sapiens
  misc_feature 335: k=g or t
  misc_feature 336: k=g or t
  misc_feature 393: r=a or g
caggttggtctgcagcctgggcaaggggaacagctcctggcctctgagcccagctggtggaccactggaaaatatggaatatttcagtacgatggtcccctttgacttgatttaggagctctcagttgcatagaaagatctggtgagcaccttttcatccccagaaaaggagcacgtgaattgagtcgcctggcggctctgtacgcgctcagggaagcttagcttcttggtgcccatctacgtgcactggatgatttttcttttgaacattttgccccactacactgttttggggatagctgggttaagcaagttaaagatatttacatttatakkggaattttagcaactttttttcaggttaaatatataatttcaagtgcttttaatgarcttatttttaattggctagggagcaaaaaataagtgagttctgcttttagttagtta

SEQ ID NO: 26458 - DNA, 407 bp, Homo sapiens
  misc_feature 13: n=a, g, c or t
  misc_feature 47: y=c or t
  misc_feature 120: m=a or c
  misc_feature 177: k=g or t
  misc_feature 178: k=g or t
  misc_feature 206: k=g or t
  misc_feature 207: k=g or t
  misc_feature 211: y=c or t
  misc_feature 226: y=c or t
  misc_feature 278: k=g or t
  misc_feature 279: w=a or t
  misc_feature 288: s=g or c
  misc_feature 312: r=a or g
  misc_feature 313: s=g or c
taatcccacctcnaatagtagttctacaaatcctgcagcaagtagtyctgcatctggttcctctgtgccaccggtctcatcgtctgcctctgctcctggtattagccagataagcactamctcttcttcaggattcagtggtagtgttggagggcagaaccccagcactgggggcakktctgcggatagaacgcaagggaacatakkctgyggtggagacactgaycctgggcagagctcttctcagccctcacaggatggacaagagagtgttacakwaagggagasaataggaattcccacggagcctgrstctgcagacagccatgcccaccctccagctgttgtcatttacatggtggacccgttcacgtatgctgcagaggaggactccacttctgggaagc

SEQ ID NO: 26459 - DNA, 273 bp, Homo sapiens
  misc_feature 12: y=c or t
  misc_feature 13: y=c or t
  misc_feature 69: s=g or c
tagcccagaacyytctccgaagcagaagagaaaggcaaatatctctttaaggtactttgcttctccgasctggagctttgtttaaactctccagccgggaagttgcaagaagctcgtttgctttttagtagctttagccagaggttaaggcactgtccacagattgctctcaggagtagaggagtccttagtggctatctctgctcacaccagaagcttcctttctctctgtcctcttcccttcctgcctgcccggcatcacttctgtcttgc

SEQ ID NO: 26460 - DNA, 354 bp, Homo sapiens
  misc_feature 344: m=a or c
  misc_feature 345: s=g or c
acctgtttattaaaatatatttttacaaatatatttctaattagtttcttggcaatcttatgctacctattttatgcaatttaaagcattattctgaggaatccatggcccataagaggttaagaaatcttgctccaaagcaagcggtgacagactaacttccttagatacacattaacactgtttccccacccgatgccacttcaccaatctaatgcttctttagaggaactaaccacctgccgggcttgcaaaatctaatctaacgcttgcactgagttcagtgaaaatatattgggcccaaccaactctatttagaaacgaaacacatccaccatctagamstaagggaga

SEQ ID NO: 26461 - DNA, 121 bp, Homo sapiens
  misc_feature 3: s=g or c
  misc_feature 13: y=c or t
  misc_feature 14: h=a or c or t
aasgattttatgyhtacttgaatgttctttgaatgttcagatgcatatcctaactggatgcttctcaaggccttactgcatatttgtgttgcatatttatgttagttgcaccagggccacc

SEQ ID NO: 26462 - DNA, 237 bp, Homo sapiens
  misc_feature 10: s=g or c
  misc_feature 12: s=g or c
  misc_feature 13: y=c or t
  misc_feature 29: r=a or g
  misc_feature 41: s=g or c
  misc_feature 121: k=g or t
  misc_feature 122: m=a or c
  misc_feature 177: s=g or c
  misc_feature 178: r=a or g
  misc_feature 186: r=a or g
  misc_feature 187: s=g or c
tttgagacasasycttgctctgtcgccargctggaatgcastggcgtgagcagtcttggctcactgcaacctccgactccctggttcaggctgttctcctgccccagcctcccgagtagckmggattacaggcacgtgccaccatgaccagctaatttttgtatttttaatacagasrgggtttcrscatgttggccaggatggtcttgatctcctgaccttgtgatccgcccactg

SEQ ID NO: 26463 - DNA, 318 bp, Homo sapiens
  misc_feature 46: s=g or c
cccttttatcatatacttttctactttactttatttgtaatttatsagaaaaactgaaatctttccattgctcatcacatgtgaaagaattggccaaggcaggaaaggacatccacaactcgccttgttctctgtgtctcctcttttcccattcttctggagtaagtccagaatccatctagtatttttcagtgaggtcattgttggcatttaagatcaggtaatttttgagactacactgcaggagaaatgcccccaggcctagtgccacctggagggatggtactgcccgtagtctctcccactctccccgactac

SEQ ID NO: 26464 - DNA, 186 bp, Homo sapiens
  misc_feature 13: s=g or c
  misc_feature 109: s=g or c
ttttagtagagasagggtttcaccatcttggccaggctggtcttgaactcctgaccccgtgatccacccgcctcagcctcccagcgtgctaggattataggcgtgagcsactgtgcccggccagatattttctacttacagtgggtttaacctgacgtagcacatcataagccagggagcatactg

SEQ ID NO: 26465 - DNA, 295 bp, Homo sapiens
  misc_feature 93: r=a or g
  misc_feature 97: k=g or t
  misc_feature 100: k=g or t
  misc_feature 109: k=g or t
  misc_feature 133: k=g or t
aaaagaagagccctgtgtgtctggtaaatatagaccaaaaagtcatatagtcctgaaagacagattcaccagggattccatctgttgatctgrtgakggkttttcactkgagagtttctcagggtgtcctggktctttgtaagccacttttgctgctgcacagttatgcacaattcgggctgccattaaagcaaagagtagctcctttcctgttcctctggccggaaagaccatttctgaaatttgctgcctgaaccaattgcccagaagctggagctgcccttggaccaatgct

SEQ ID NO: 26466 - DNA, 341 bp, Homo sapiens
  misc_feature 2: b=c or g or t
  misc_feature 49: k=g or t
  misc_feature 95: y=c or t
  misc_feature 103: s=g or c
  misc_feature 128: m=a or c
abccagaccagtggacattggttctggaggattcggtgatgtcgagcakaaagaccatgggtttgaggtggcctccacttcccctgaagacgagycccttggsagtaaccccgagccagatgccaccmagttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgcta

SEQ ID NO: 26467 - DNA, 135 bp, Homo sapiens
  misc_feature 11: k=g or t
  misc_feature 91: k=g or t
  misc_feature 93: r=a or g
  misc_feature 95: r=a or g
  misc_feature 96: w=a or t
  misc_feature 108: s=g or c
  misc_feature 109: s=g or c
  misc_feature 120: s=g or c
acagaatcaakacataccataaagtggtgtacagtataactatagtggggttattcatatcactacagaagtaatattaagatatacctgkcrtrwccttgcccctgsstcattttctastccatgctcccccct

SEQ ID NO: 26468 - DNA, 299 bp, Homo sapiens
  misc_feature 88: r=a or g
  misc_feature 130: r=a or g
  misc_feature 131: k=g or t
  misc_feature 135: k=g or t
  misc_feature 138: k=g or t
  misc_feature 151: r=a or g
  misc_feature 261: k=g or t
  misc_feature 263: n=a, g, c or t
  misc_feature 264: n=a, g, c or t
  misc_feature 268: k=g or t
cttgaagaaatgttgacacctgaagaaaaagctttactctatgaagcaattggctatagtgaaacagcagttgatccaactttactaraaacatttgaagccttgaagttttttgtccacttgaaaagtrkgtckatkgttctaagaggaraatcatcaaaaacctgagctggtagatattgtaatagaagaatttagcaccttaattgtgcaaagaccaggagcacaagcaataaaatttgaaactaaaatagattcatktnntatkactggcttaccagataattcagaaaaacccc

SEQ ID NO: 26469 - DNA, 107 bp, Homo sapiens
attaaaattaaccaggcatggtgggtcatgcatgtagtcctagctacttgggaggctgaggcgggaggatcatttgagcccaggagtttaaggctgcagtgagctat

SEQ ID NO: 26470 - DNA, 98 bp, Homo sapiens
tgtgaagaaaaatagagaataaatggttactgttttagagcgatatcctctgggaggaggtagtatttgagaagagacttaaatggactgggccgaat

SEQ ID NO: 26471 - DNA, 297 bp, Homo sapiens
  misc_feature 77: r=a or g
  misc_feature 78: r=a or g
  misc_feature 82: d=a or g or t
  misc_feature 85: w=a or t
  misc_feature 99: k=g or t
  misc_feature 100: r=a or g
  misc_feature 105: k=g or t
  misc_feature 108: k=g or t
  misc_feature 109: k=g or t
  misc_feature 111: k=g or t
  misc_feature 203: r=a or g
  misc_feature 252: w=a or t
  misc_feature 277: w=a or t
taccgtgtagatggtgttctcagcaggtgagagtcagactgcagaagcaggccagctcctctgtaagacccacatgrrgatdacwgttgccactgccakrttaakgtkkakgttctcacacagagtcgccaccttcctctctctactccccatcctgttccgccttctgaatcgcagcatcaattgttgacttaagcaggcaraaactcaaactacatttgaataaagaatttgtcagtatctgcatttgtwttagtcttctgtatcaagagaggawcccaagccccttatccagct

SEQ ID NO: 26472 - DNA, 240 bp, Homo sapiens
  misc_feature 99: r=a or g
  misc_feature 106: k=g or t
  misc_feature 111: n=a, g, c or t
  misc_feature 115: r=a or g
  misc_feature 116: b=c or g or t
  misc_feature 117: b=c or g or t
ctttgatcagtactcctcctgtttcatcacagccaaaggttagtactccagtagttaagcaaggaccagtgtcacagtcagccacacagcagcctgtarctgcctkacaangcarbbaaggtcatgaacctgtctctcctcgaagtcttcagcgctcaagtagccagagaagtccatcacctggtcccaatcatacttctaatagtagtaatgcatcaaatgcaacagttgtaccacttt

SEQ ID NO: 26473 - DNA, 56 bp, Homo sapiens
  misc_feature 15: r=a or g
  misc_feature 16: n=a, g, c or t
atgtgtgcaaaaggrnatctatataagggaagcagggctggactgtagttacagga

SEQ ID NO: 26474 - DNA, 157 bp, Homo sapiens
aattatgtgttctttcattatgtttttagtggttacccaggataacaatgtgcattctgaaattgttacagtctaccttaccttctagaaaagataaataaaataattgaaattattcgtcactttccagaaactgcaaataccttataacacccgt

SEQ ID NO: 26475 - DNA, 284 bp, Homo sapiens
  misc_feature 268: h=a or c or t
ttttggtgaggagtatcttaagatgatgtgtaccagacactgcccctcaaagtccagttgtatcagtctctttcaagtctgatctttttctcagctttgtgtcagggtcttataaatgcctttaggggaaaatttgtggtggtgatggggttcatcttgcttatatcccttctctgagggatcacagtcctatgctgtcatccagtttccgaaaaaatttgtttcatatattttgtccaggtttctagttgtttatggctcgtgggchtagtttggtgagcggt

SEQ ID NO: 26476 - DNA, 390 bp, Homo sapiens
  misc_feature 306: n=a, g, c or t
  misc_feature 307: n=a, g, c or t
  misc_feature 317: w=a or t
  misc_feature 367: r=a or g
cagtaccatacctaagattatcattaataattagtctggtggtagagacagctggtaggatgccagaacattaacctgaacagtaaaagattcattctgttttaaaaacaaaaagcagggcattgtcccccctcagatactgaagtctagaaactgaggccttgcccacacagagccaaaacatcacttcaaagaccttgtcttatcaaagataaaagtattcagccagcttaaaacattttcaagtaaaggtgaggtatacagacaaagagagattgattctaagcgttgctacttatcatgcanntgcttagacwttgcaaaacatacagctcaagactcacccgcttttaggtactacaagaaracattaaaccagtcagtcggtgt

SEQ ID NO: 26477 - DNA, 323 bp, Homo sapiens
tgccaagcagatccgtcattaaagcaggaaaaccaaatgctgattgggataacttaacctggctctattggcagaatgtgtttgagtggagattgcttagtagttgaagaaaagcctatatttcttcaaaaatcatcaaagtagagaaaagggttgcttaacctaagattaaggtgcaaaaagaaatatttattacccctaatgttttaagcgcactgctcattaacagactgtgtcgagcctagaaaagtaggggaaataattttcggatcccaaaagctttattgaattgagagaagagctctacatgaatcagaggggac

SEQ ID NO: 26478 - DNA, 318 bp, Homo sapiens
ctgcataatagtacttcagtcatttgagttgataacctctcagtttttctctagaggtccagtccttttttggggcatcttcaggaacacttaatagctctactgatcctcaaacttgctcttccttcaccctctcctttccaaactctgaagaatatatttttacaggaaatataacacctcctttaggtttaaatcagttgaacagagtcagcaaatcttttgcctttaatctatcccagtccatgttgcaaactgctaattaatgtgtaatgtcatcagcacgaggagcaggtttatctgattctctccatgcat

SEQ ID NO: 26479 - DNA, 411 bp, Homo sapiens
  misc_feature 107: w=a or t
  misc_feature 108: m=a or c
gtttcataagttacaatgctgctttttataaaaaggcctgatagaaaaagtttgcatgggtgtgtttgtacgtatgtatgtatgtatatgtgtgcatgtgtgtgtawmtctccagactctcccacaaaataattagatcccattatcaaagttggtgaactgctggataaaccctgcgagtgaaattctttataagcagcaagagaaaatcaattattacttttgttagatgctgtgtattttgattaatgaagttctgctgctgatatcgacctttctttaaatgcaggtgaagatgcttttgatgccctccctccatctctcccacctcccccacctcctgcaagcatagtctcattgaacattcaaaacctcctggctccagtagcggccatcctcaggacaggatct

SEQ ID NO: 26480 - DNA, 301 bp, Homo sapiens
  misc_feature 170: s=g or c
gtggaacctttgttctttcactctttgcaataaatcttgctgctgctcactctttgggtccacactgcctttatgagctgtaacactcactgggaatgtctgcagcttcactcctgaagccagcgagaccacgaacccaccaggaggaacaaacaactccagacgcgcascttaagagctgtaacactcaccgcgaaggtctgcagcttcactcctgagccagccagaccacgaacccaccagaaggaagaaactccaaacacatccgaacatcagaaggagcaaactcctgacacgccat

SEQ ID NO: 26481 - DNA, 378 bp, Homo sapiens
  misc_feature 319: m=a or c
  misc_feature 320: y=c or t
  misc_feature 323: w=a or t
  misc_feature 324: b=c or g or t
  misc_feature 348: y=c or t
atcagctagttcatgcttgcgttgaaagagtggtcgtttgcgctgggtcatcactgtgtagtattggggatacttaggtgagaaaaaaacttaacgctagagacgttcacgcactagtggagaagccaggattgttgccctagagttacagtagataaaagtacctcagagaactgcgggggctcccaacctggacgcttgcaccggagtattaaatccagctagagaatggcatgtgcaaagatacagagcttttagaagttgcctgcattccttggccccttcctcacatcattccaaccaacttccatccttacamycgwbtactttcctgtaatagctacagtyaaatgggcagctgaagatgatgatgatgat

SEQ ID NO: 26482 - DNA, 250 bp, Homo sapiens
  misc_feature 25: k=g or t
  misc_feature 26: k=g or t
  misc_feature 93: r=a or g
  misc_feature 109: k=g or t
aattaaaaatgcacatttctgtctkkacaagtactgccttattactaacttaaagggtggtacttaatttacagtcttagtagcaggatagaraaatacatttgtatckatagccctgctaatgttaaatattgtgaatattttcagtttttctaatgagatagaaggaaaatggtactttaatttatattttactgattactaatgaacatatttcacaaaagatgtgttagggtttttcactggaaat

SEQ ID NO: 26483 - DNA, 155 bp, Homo sapiens
  misc_feature 43: k=g or t
  misc_feature 59: v=a or c or g
  misc_feature 60: k=g or t
  misc_feature 132: d=a or g or t
  misc_feature 136: s=g or c
  misc_feature 137: k=g or t
  misc_feature 147: k=g or t
atttttaactttatttttaaaggtcatcattcaagtttttctkgtatttaggcaattcvkatttatgagacaatgtattaaacacacacacatacacacacacacacacacacacacacacacacactcatdcatskaattggtgtkaaccctga

SEQ ID NO: 26484 - DNA, 119 bp, Homo sapiens
ttttcttaaccacctgacatatctttatttactgcctacaaacctgtatagatccctttctatagtataagcactaagtttagtgcaggaactttgttttactttgctactcaacctct

SEQ ID NO: 26485 - DNA, 69 bp, Homo sapiens
  misc_feature 10: m=a or c
  misc_feature 58: k=g or t
agctctgggmaaggagccccagccctgagattcccaggtgtttccattcggtgatcakcactgaacaca

SEQ ID NO: 26486 - DNA, 336 bp, Homo sapiens
  misc_feature 74: w=a or t
  misc_feature 81: m=a or c
  misc_feature 92: w=a or t
  misc_feature 94: r=a or g
  misc_feature 96: k=g or t
  misc_feature 289: m=a or c
ctggctgtggtttgtgggggaagcctcctttctcttctcacttttttctgctgagaacattgggcacattgagwctagcamgcccatcttgwarakggggaaagggagatacagaaccagtgaccaacttggtaagaggtgcagccatgcagtgctggaaccccttgccccatctgtcctcttggcccactttcatctgcttccagcttgatgtctggcagggcaggggcccactgacttccccgcatccacccactgcctggccccatagctaccttctagtcctggmtaagccccgtgagacatcttaagtttgtcttcagtgactctcaacca

SEQ ID NO: 26487 - DNA, 88 bp, Homo sapiens
  misc_feature 2: k=g or t
  misc_feature 19: s=g or c
  misc_feature 25: s=g or c
  misc_feature 39: k=g or t
  misc_feature 42: k=g or t
  misc_feature 50: m=a or c
  misc_feature 72: y=c or t
akttccagtggctcatttsgatgasaactaccctctatkttkaatattamaactacatccaactcatcattyagcctttggttgtaca

SEQ ID NO: 26488 - DNA, 109 bp, Homo sapiens
agcaatactcacccagacagaagagaccacggtaaagatcagctgacggcctctgtgggaacaaagacagggaaaggggaaatgagttcaccagaaaccaacaggcaac

SEQ ID NO: 26489 - DNA, 116 bp, Homo sapiens
  misc_feature 112: k=g or t
  misc_feature 113: w=a or t
acaacagactagtttttagagtaatggctctttcacaaataattgataggaagcctgctttactacatactagtatattagtaatagagtagtttcttaacattgcgggaakwgca

SEQ ID NO: 26490 - DNA, 139 bp, Homo sapiens
  misc_feature 80: w=a or t
  misc_feature 81: w=a or t
  misc_feature 89: w=a or t
  misc_feature 92: r=a or g
  misc_feature 93: w=a or t
  misc_feature 94: r=a or g
  misc_feature 100: k=g or t
agactcaaacacgatattacccaagttcctgagactagagaagtgtataagtctgaggacagattagaaagacttcaggwwattctaawggrwratttckgtacctggagagagagtttaggcaaataacaatcagcct

SEQ ID NO: 26491 - DNA, 103 bp, Homo sapiens
  misc_feature 94: r=a or g
acggctgaaaagatggtcagaaggggaaaggaggaagtgagaagaaagaaacagggaaatgacagagtgttgctcagttacccaggcctgggartgcaatggc

SEQ ID NO: 26492 - DNA, 52 bp, Homo sapiens
  misc_feature 12: b=c or g or t
tgtatttttggbagagacggggtttcgccatgttggccaggatggtctcgat

SEQ ID NO: 26493 - DNA, 52 bp, Homo sapiens
aaggaggcagaaagccaagcactgcatttttaggccaatcacatttacatga

SEQ ID NO: 26494 - DNA, 198 bp, Homo sapiens
tctgtctggttagtggtgacaggaagtggcaatagcaccaggtgctggggaatggcctgtgcgtggcactcgctggaacagggtatgctgggctaggagtctgggggcaacgtctcagtccacaagacgtcacacttggaggacatagggacttggtggctgcagtttttcacatttgggagaatggaacacgggagc

SEQ ID NO: 26495 - DNA, 213 bp, Homo sapiens
  misc_feature 54: w=a or t
  misc_feature 94: y=c or t
  misc_feature 111: k=g or t
  misc_feature 113: y=c or t
  misc_feature 139: w=a or t
  misc_feature 163: w=a or t
catcagtttgttttgttgtgggttgcttggttaaccctacagagtatacttgawgcttatttgcatcaactgtattctggagctgtaatttttyaataactagactctgakayatgtatacattgtggttcatataggwatcatccatagtccagtgctagawcaatatgtatacataatccactccccacaaattatcactcatttattttt

SEQ ID NO: 26496 - DNA, 159 bp, Homo sapiens
  misc_feature 46: k=g or t
  misc_feature 47: k=g or t
  misc_feature 149: r=a or g
agtgaaataaactattctgtattttaggaaaaaaaatctatgagtkktcatttaataacatatacatcattatgctgcccaggctggtctcaaactcctggcctcaagcaagccacccaaagtgctgggattacaggcataagccactrcacctgatcc

SEQ ID NO: 26497 - DNA, 357 bp, Homo sapiens
  misc_feature 100: d=a or g or t
  misc_feature 112: k=g or t
  misc_feature 126: r=a or g
  misc_feature 172: r=a or g
  misc_feature 191: w=a or t
  misc_feature 275: m=a or c
taggataatggcttctagctgcagccatgttgctgcaaagggcatgatttcattatttttaatggctgtgtagtattccatggtgtatatgtaccatttdcttcattcaatkcaatattgatggaracctaggttgattctttgtctttgttattgtgaatagtgctcctgraaatgtgagtgtatgagtwgttttggtataatgatttgtttccttttggatatatacatagtaatgggattgctggatgaaatcgtggttctaagatctttgmgaaatttccaaactgctttccacagtggttgaaataatttacattcccaccaacaatgtataagcattcccttttctctgca

SEQ ID NO: 26498 - DNA, 154 bp, Homo sapiens
  misc_feature 123: k=g or t
  misc_feature 136: k=g or t
cagtaagactcagggagccttataactcctcttaacatatgcttacccatgcttaaattctagggaagctgtatccacagccctctgcattgcagccatgagagctctcacgctttcaacccktccataacctaakttagtcatttgggcctca

SEQ ID NO: 26499 - DNA, 110 bp, Homo sapiens
  misc_feature 103: k=g or t
atctcctgcacctcgtgatccgcccgcctcggcctcccagggtgctgggattacaggcatgagctgctgtgcccggccatcacccagcaataatttctaacgkaatgatt

SEQ ID NO: 26500 - DNA, 156 bp, Homo sapiens
  misc_feature 98: y=c or t
  misc_feature 102: w=a or t
attctctattatttatacctatggtaaaatttgccagtttgaccatacaactaatactcacagggaatatatagagtctagaagaaaatatacagggycctwaaaggctgccctgccaacaaaaccataacgcaggaacaaacatcacaaccatgc

SEQ ID NO: 26501 - DNA, 143 bp, Homo sapiens
  misc_feature 95: y=c or t
  misc_feature 97: y=c or t
  misc_feature 101: s=g or c
acacactgcgtgaaactgctcagaatagagccatgatctcaaccacgaaatgggaacttagattttggagaaactaacggggacggacttctttycytagscctgagtgttgagcagtgtcatgccttggcgtttcagctcct

SEQ ID NO: 26502 - DNA, 128 bp, Homo sapiens
  misc_feature 93: m=a or c
  misc_feature 95: k=g or t
ttaattccactgaaaagtccaaccttaaaggtacactgatttatctttacaaataccaattctggtggagcataatagcatggttaaaacaamgkttctccctaaatggcgacgatctacgggtcgga

SEQ ID NO: 26503 - DNA, 190 bp, Homo sapiens
  misc_feature 76: s=g or c
  misc_feature 88: m=a or c
  misc_feature 94: s=g or c
  misc_feature 97: v=a or c or g
  misc_feature 98: m=a or c
gagaactgcgtcccgctcgtcagaaacgcctgttccttcgtcgtctcccagcctagcccctgccccttcagcggasgcctgcggagamacgggscgvmgcgctcttgggaatgcgatcctaaaggcttgggacttctggggaagtggcggcttttagcccctgcgggagccgagccgggccgggggatgg

SEQ ID NO: 26504 - DNA, 253 bp, Homo sapiens
  misc_feature 101: y=c or t
ctcctgacttcaagcaatctgccaacctcgacctcccaaagtgctgggattaaaggtgtgagccaccgcacctggccatctcatactttcacaattccatyctttggtgcaagttctacaatatacattctatatttgtcaagtgataacttccatgtaacttataaaatacacataattcaggaagattgtgctaaaatacatttaaccaataggagtatgccgtcagaatattttggcaaacaagggttgt

SEQ ID NO: 26505 - DNA, 205 bp, Homo sapiens
  misc_feature 96: w=a or t
  misc_feature 98: w=a or t
  misc_feature 101: s=g or c
  misc_feature 110: k=g or t
agataaggcctgtaagtcttaaaaaaaaaagtattcatgtgttaccaagctcttgcaatattgattattaacaaaggtcttttcaactatgtgtawawttscctagagckaatatgcagctttattttctttatgtgatctgggtacctttagtataaaattatgagtaaaatatcagaagctgtttcagtaagaaagggcccct

SEQ ID NO: 26506 - DNA, 172 bp, Homo sapiens
  misc_feature 99: w=a or t
  misc_feature 101: k=g or t
ggtgatgcagcccaattgagcattggtgattggccctgaaatatctggcttgcacttcacagggagtaaagcaaactgatgtcattggttccccatttwakgtgttttatttgcagctcaccagttggtgtactcactgaagaaatcattaagttttttgtacaaatgccaa

SEQ ID NO: 26507 - DNA, 223 bp, Homo sapiens
caatgatagttcatttccaatttttagttatttctaattttcaatcaactcacatctctttagaaaaatgggggtcaatatattactttttatcctgttgagaggatagaaaaattataacactttgactagtaagatagtacctaatgttcattctgacaaacactaaatataaaagtgacatagtttaaggaagaaaattctctccttcctcttgccttca

SEQ ID NO: 26508 - DNA, 170 bp, Homo sapiens
  misc_feature 91: r=a or g
attcaataaaaaggaagtatttgttgccctaacatcagtattggctattcagttttaaaaaaggagttaaagagatgttatttataggcargcttcaaaagaggaaagaatgatcagtttcattctctgtttctagcatattctgactccttctctcatattacctcgca

SEQ ID NO: 26509 - DNA, 212 bp, Homo sapiens
  misc_feature 38: k=g or t
  misc_feature 39: n=a, g, c or t
  misc_feature 40: n=a, g, c or t
  misc_feature 41: m=a or c
  misc_feature 119: d=a or g or t
  misc_feature 121: s=g or c
gaaaatatactaaattttatttgagggtcattctcttknnmaaataatcataatagctattaaaagttttcatgtgagcatattttctttaatttgtttcataagctgttttgtaggadastgttacaaaaacatttgtacttggcgtgagcccgggaggcggagcttgcagtgagtggagatcgcgccactgcactccatccagcctgggg

SEQ ID NO: 26510 - DNA, 253 bp, Homo sapiens
  misc_feature 87: r=a or g
cgtaattatagaagaggaggaaacaatgtaaaaagggcaaagaagaaatagctcattacggtaaaactgatatatattaatcaatgraatgtttaatgttgaaggtcaaacagtatgtagactattttaatcattccattgtcagggacccactgggccaacttcaataagccatttgtcatttaaccattttaggctataagtttttcacttgaaaacaaaaatgtctgttctttactcattatatgtggcc

SEQ ID NO: 26511 - DNA, 258 bp, Homo sapiens
  misc_feature 194: n=a, g, c or t
atgatgccacattatctctaaattgagcctggcttatagtaaactctataagtgagactgcccttcatcttttcctaaagatacaacttctagtacagaatattaatcatctataggctgaggcctaatctgagattaaccttctggtttcttcctggagtttcatccaggagtatgccctgggcctcacatgnggatgagatggggcttttcgcctcaaaggtttgttcttatttggtctatttgagacagaggcgc

SEQ ID NO: 26512 - DNA, 134 bp, Homo sapiens
tttatatgactggcagtgcagcagtagtttcatcaccacatacatgtgagtaatgtgttgtactgcggtatgatgtcagctacagagtcactaggtgataggaatttttcagctccattataatcttatgggac

SEQ ID NO: 26513 - DNA, 176 bp, Homo sapiens
  misc_feature 76: m=a or c
  misc_feature 105: m=a or c
  misc_feature 108: m=a or c
  misc_feature 132: k=g or t
  misc_feature 155: s=g or c
  misc_feature 166: m=a or c
  misc_feature 172: s=g or c
acaagtgtgctgctccttcgaatgccagcctgcaagaggacctccggggctccggggcgaccccggctttgagggmgaacgaggcaagccggggctcccaggagmgamgggagaagccggagatcctggaakacccggggacctcggacctgttsggtaccagggmatgaasgata

SEQ ID NO: 26514 - DNA, 195 bp, Homo sapiens
ccagcagcaactgttcacccagagacatagtgcttagcatgagcttgatggattcaaaccactgggtttatcattactacatagatctttgaaaagacaggctgcaaatcttgtttctaagctgtgactagctattattatgtcaatttgaagaacagaagtaaaatcaatccagattcaaaaaaagacactctt

SEQ ID NO: 26515 - DNA, 310 bp, Homo sapiens
  misc_feature 13: y=c or t
  misc_feature 252: y=c or t
  misc_feature 253: m=a or c
  misc_feature 254: m=a or c
  misc_feature 260: m=a or c
  misc_feature 301: m=a or c
caagccattatayatttcactttggatagtttatttacggaatagcctaaaattgagaaggaaaattatatctatgatgcaaagccagtaatactatgggtttaagtgaaatagtaaatatatattggctgacccacactgcaccaggcactatgggtaatgtaaaagaaacatagtgccaccctaaaggaagaactctcctctgtgaagatcatgtgagtacagtaaacagtacaagacagtgggcaattymmtattgmattacacagaacagacttaaagtgctaagaactataaagamagggagagc

SEQ ID NO: 26516 - DNA, 347 bp, Homo sapiens
  misc_feature 195: k=g or t
  misc_feature 202: w=a or t
  misc_feature 203: w=a or t
  misc_feature 334: r=a or g
taggttttctatattcttaatttttttctttttttgcttctttcatcagttgctatgagaaagaagtgttgaattttttcaactataattgtgaatttgcctgtttccccatttagtcctgttggttgttgctttatctcttctctaaaactatattttaactgacttttactgattttgaaatggattttttckttaggawwacaaagtgttaaaatgtaaaccaaccagagataattttagtgagcagtgttgaattgagccttcaaacttgttcatgagtcgtgatcaatctttgtcacattattatactaaaaactatctcagagaggaratttatagccaga

SEQ ID NO: 26517 - DNA, 144 bp, Homo sapiens
  misc_feature 13: b=c or g or t
  misc_feature 144: k=g or t
attttttttagcbttatgatgaatttgtttgaagggcattttctttatgaacaaaggcttggatgcatattcctttctttctgtgaatgggtattattccctgaggaaagttgcacagtgaaaaccagtctggttgtgaccatk

SEQ ID NO: 26518 - DNA, 311 bp, Homo sapiens
  misc_feature 12: n=a, g, c or t
  misc_feature 83: k=g or t
  misc_feature 84: w=a or t
cacttactatgncttttccaagggcattgaccacaaaaagagtgatgacaggacacttgtggaccgaatcttggagccgcagkwtgtcgtccggttcggagtcttcctctacacgttgggctgcgtctgtgccgcttgcctctactacctgtcccctctgaaactggagcacttggctcttatctactttggaggcctgtctggctcctttctctacacaggaggaattggattcaagtacgtggctctgggagacctcatcatcctcatcacttttggcccgctggctgtgatgttcgcctacgcccgcc

SEQ ID NO: 26519 - DNA, 321 bp, Homo sapiens
  misc_feature 113: s=g or c
  misc_feature 167: m=a or c
  misc_feature 168: m=a or c
  misc_feature 184: m=a or c
  misc_feature 185: s=g or c
ctgacacagccgccttgggtaagttacctaaactgagccttagtttctccatctgtaaaatagtataatgaagataatgatgtagataaatacttagtagggtatctggtgcstaagaggtactcagtgaacttttctttccctgcctaggtttaaattagaaaagmmaaaggtcaaattaggmstcttttagtaagcccaagtgaaccatagcatgagaaatagggtgtaaaagcactgagaaaaatcttgcattttcctctgaaaggcacactattagcatagtataagttcccagcagcactggaaaaatgacacaca

SEQ ID NO: 26520 - DNA, 149 bp, Homo sapiens
  misc_feature 13: w=a or t
ctcagcgtggcawaattccatagataagttttctgtagtcactgtctccagttccttacctttcattctcctgtaagtctactccagtcatgcttttgcttcattcaatccactgaaacttctcttgtcaagaacacctgtgatgcctg

SEQ ID NO: 26521 - DNA, 304 bp, Homo sapiens
cagagatcctaactctacactccgagaactgctggtagaaagtattcagcctacaatctggcacacataaattgcccaatacatggaagctgattgttattattgttgctaataaaaacttatttaatggaaagagaaaaggtaaatcttccaaggtatttgcctcattaaattccggtgaatgattacctaacaaaattgttttcagaaaaggataatttaaacttgggtttttctgggcatattttatagctactattactatccattctttttttttgttttttttttttttttttttttt

SEQ ID NO: 26522 - DNA, 184 bp, Homo sapiens
  misc_feature 20: w=a or t
  misc_feature 21: k=g or t
  misc_feature 26: k=g or t
  misc_feature 142: r=a or g
aacaaaacaaagttgacttwkaagakaaggatgaaccttgcttgatccacaatctcaggtttcctgatgcatggctaatgacatccaaaacagaggtaatgttattaaatccatatagagtagaagaagccctgctatttaraagacttcttgagaatcataaacttcctgcagagccacatgg

SEQ ID NO: 26523 - DNA, 253 bp, Homo sapiens
  misc_feature 89: r=a or g
  misc_feature 109: r=a or g
  misc_feature 231: v=a or c or g
tgtcctcgttaaggaaatactaatcaaaatgataatgaaataccacttcacatccattaggatggctgtaatcacaaagacagccagtrataaatattggcaagatgtrgagaaattagtatattgctgataggaatgtaagatggtacagacactccaaaaaacacttcctcaaaatactaaaccatgtgacccagaaatctcactccaaagtatatatgaatgaatgavataaaaacatatgtccacatgt

SEQ ID NO: 26524 - DNA, 464 bp, Homo sapiens
  misc_feature 13: s=g or c
  misc_feature 346: k=g or t
  misc_feature 431: b=c or g or t
cacattaactggsaagaacttctggctcgaaaggtggagcccccctttaaacctctgttggtaagtatacatgaaagtgtataattgggtgcagtggctcacgcctgtaatccccaaactttgaagggccagggtgggaggattgtttgaggccgggagttcgggaccagcgtgggcggcatggcaagactccatatctacagaacatttaaaggttggctgggtgtggcggcttgtgcctgtaagtcccagctacttgcaaggctgaggcgggaggatcgcttgatatttttttagaataagaaaaatctcagagcagacagaaacattatttttattagcagtkcaaagatctctggtctatcctctccagcatctttattttattttattttgagatggggtctcactctgtcacccaggatggagtbcagcagcacgatcacagttcaatgcagccttga

SEQ ID NO: 26525 - DNA, 218 bp, Homo sapiens
  misc_feature 39: r=a or g
  misc_feature 44: k=g or t
  misc_feature 143: k=g or t
gtggaacctttgttctttcactctttgcaataaatcttrctgckgctcactctttgggtccacactgcctttatgagctgtaacactcactgggaatgtctgcagcttcactcctgaagccagcgagaccacgaacccaccakgaggaacaaacaactccagacgcgcagcttaagagctgtaacactcaccgcgaaggtctgcagcttcactcctga

SEQ ID NO: 26526 - DNA, 244 bp, Homo sapiens
  misc_feature 139: y=c or t
  misc_feature 140: y=c or t
  misc_feature 142: y=c or t
  misc_feature 143: y=c or t
  misc_feature 149: y=c or t
  misc_feature 150: y=c or t
atgatatgatgttaggttagaaaatcagaattaaaaattttaattacattctgattttgttgtgaataagaattaaatgtgagccgtaaaaaaatgaatgacagcatttggtatgttagaatggtgaaatagtagaatyygyytttatyytgtttattgtagtcgtggtgtgtgttcatttaagaaatttggagaacacctgttaataagtgatcttgagtagttttaacatttaggaggaagc

SEQ ID NO: 26527 - DNA, 145 bp, Homo sapiens
ttttagtagagacagggtttcaccatgttggccaggatggtctcgatctcctgacctcgtgatctgcccgcctcagcctcccaaagtgctgggattacaggcttgagccaccgcgcccggccggtcattcattcttgcaacaagc

SEQ ID NO: 26528 - DNA, 359 bp, Homo sapiens
  misc_feature 11: y=c or t
  misc_feature 19: k=g or t
  misc_feature 221: m=a or c
  misc_feature 313: m=a or c
  misc_feature 316: m=a or c
  misc_feature 317: r=a or g
  misc_feature 333: r=a or g
  misc_feature 334: m=a or c
  misc_feature 339: m=a or c
catgtaatctyctgtctcktacacacttcactggagcatcctgtctcctttgcaactataactctttttagtatttgctttaacattgattgaaatacctataatgtgcttggtgtacctaccacagtagatagtgtggaacatataaaagtatgaaatatggtctcccatcatgaaggggcatacagttggactttgttaagtctgtaagcatggctgamaaaaaatcacatactcctgtgtgttgtacaaaatggtatgggtgtgaggcttatatgagtttaggaaaggaagggttctgtgttgaatagamtamraggaagaacttcttarmggttmaacccatcgtagatcctgaa

SEQ ID NO: 26529 - DNA, 238 bp, Homo sapiens
  misc_feature 202: k=g or t
ttcaaagtcattgttctagagcttaccctatgtatcttgctagaatcaaattcagatttatacttgcttagtttcagtaatacatgctaaaatttattgaactttactgctatatagttcagttcccatcccccctttgtatattattgttatatatattacatatattgacataatccaacaatacatttttttaagagtkactttaccgtctgtagccatttccttagcccacatc

SEQ ID NO: 26530 - DNA, 149 bp, Homo sapiens
  misc_feature 117: y=c or t
aagttttttttagttgattttgtatcatgtggttaagatttttcaggcgtttgaaactattataatttaaatataattattacatatttgcaaactttttaaaaaaatgtgtaagtygcgagttatacatgcctaaatgacatactggc

SEQ ID NO: 26531 - DNA, 204 bp, Homo sapiens
  misc_feature 86: s=g or c
  misc_feature 152: k=g or t
  misc_feature 158: r=a or g
ctactgtaaattttcctacatccaaatggaatgtattttggatgttgaggattgttgagggggcggggtctgtttttaaacaagtsagaaattgatatatatttacacgctatcatattgtacagaaactggccattgatcagtagaaatckcaccaratacagagaaagtcttgattcaaaacttaaaatagcagggagacgc

SEQ ID NO: 26532 - DNA, 458 bp, Homo sapiens
  misc_feature 159: n=a, g, c or t
  misc_feature 177: y=c or t
  misc_feature 178: k=g or t
  misc_feature 263: d=a or g or t
  misc_feature 357: b=c or g or t
  misc_feature 415: r=a or g
atacatgtaaataaagacggggtctccctatattgcccaggctggtcttgaactcctgggctcaatggattctcttgcctcagcctcccaaaatgctaggattacaggcatgaaccaccacttccaaccaggggtcacacaacttaaagaaggctgccngtgttcactcttggcaaykgccactgttaaaatcttgctctatgtgatcttcctaaagttctttcagacaactgggtagatgttactttcatttaacagaagadaacattcagtgacttgtctcaagcaacacgtcactaccgtagaacccttcctcaccactgtcttcaccacataccccttagaacctttcatcabcactgtcttccaccacatacccctactcaactactggccacctgtctgtgctcttatracatagactgctaacgtctgtacgagtggttatcacagtacgt

SEQ ID NO: 26533 - DNA, 408 bp, Homo sapiens
  misc_feature 390: b=c or g or t
  misc_feature 402: y=c or t
atatttttggaaattatttttgtccattttgtgtaaatcaatagtttttaagagaaactcatgagacttttaggcttaatttcttctaggcttatatactggtataggggggagtatttcctccctttttctttctctctgtatagaaatttccatttctgtttgtgacttgtttgtgattccagctttttcattgtgctttgattttcatcttcttcctcatttaggcttagtggttagaaatcttgtctttaattgaatctcaaagtggttaagtttttgtcattttgcgttttcctgtccaacagggagggtttgcatctgtaggtacactgaaatctttaataatgaacttgggtttaaagagaaattgaattaaattcttgagtbatttcagaagtygtaaca

SEQ ID NO: 26534 - DNA, 362 bp, Homo sapiens
cattcatgttatgtcgatccttttgattgtggtgttcatttttttcactttttttgagacagagtctcacactgttgctcaggctggagtgcaatggtgtggtctcggctcactgcaacctccacctcctgggttcaagtgattctcctgcctcagcctcttgagtagctgggattataggcgtgcaccaccatgcctggctaatttttgtgtttttagtagagacgaggtttcgccgtgttggccaggctggtcttgaactcctaactttgtgatccacccgccttggcctcccaaggtactgggattataggtgttagccactgtgcctggcccgtttttttcacttttatatggtgtca

SEQ ID NO: 26535 - DNA, 98 bp, Homo sapiens
cagctcctagcctcctccacgtaccattttgattctccccttttccctttggtcgttacccttcaaaccctgtgcccctctggttccttggccaccat

SEQ ID NO: 26536 - DNA, 173 bp, Homo sapiens
ctaagctcctctggttagagccagccatgagagaaactccaagtacttctgactggttctctctctactcatccaccccttaggtggctgcagaaggaactctgtgcaacccccagagttctcattctcagtgacagggaaatgtaatgattggccctggatgattcagcagc

SEQ ID NO: 26537 - DNA, 403 bp, Homo sapiens
cattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatggtaagcgctttcctaattttaattagcacgtcagggtcctagatactgtgtagcaacccccatcccttgatgcctgctgtttgctgtttgtaactcacttgtcattcattaactcaagctgcctgagacatctcctgggcactttgttaacagagtgtgttactgtatgtgtctga

SEQ ID NO: 26538 - DNA, 153 bp, Homo sapiens
tttgacaaagagatagaaagtataaaatagtaccaaatagacatcaaagatgtgaaaaatactgtaactgaactaaaaaaattcaatggaggtattcaacagcagattcaatgaagcagaagaaaggatcgatgaaatcaaagacaggtcacc

SEQ ID NO: 26539 - DNA, 170 bp, Homo sapiens
taatttgttgtttaaatatatcttaataatacgtatattgataaaaatatgggacgacttggggcctctgctagtgggaatgtgcattggtacatcctttatagaaatcattttatcattgtgaatcaaggaccttaaaaaattaattctcagtaattgtaccagacacc

SEQ ID NO: 26540 - DNA, 125 bp, Homo sapiens
tttgtgaaacattcccttattgaagcaataactgaaagtttccagtttactgccatatttggttaaatgtgttttcttgttaaaatagtttatctcagactgttaactaattttttttttttttt

SEQ ID NO: 26541 - DNA, 212 bp, Homo sapiens
ttagatttctttttcagtttattcaagtaatgaatatttgcaagtacagcaagcagattacttcccattctttgctgttgtattattattatgaagtttacattgccttggctttcttcattttcaaataatgaccttgagtgatctttttttcatttaggtttatagatacctgtgcacatgtttttatgatattcttttttttttttttt

SEQ ID NO: 26542 - DNA, 195 bp, Homo sapiens
  misc_feature 139: k=g or t
gcacccccaagctgccactgcagcagtcagagtggcagctgaaggctcggttcatgccgtgccctcgggcagttctggtgaggctaagcaagaggcctctgcatcttgacacctaggagagcagggacggagtctccckaggtggaggaccatgctgcgccgcaagccctccaatgccagtgagaaggagccttc

SEQ ID NO: 26543 - DNA, 58 bp, Homo sapiens
actctgggagggagacagcagcaactaagctgtacaaggttttttttttttttttttt

SEQ ID NO: 26544 - DNA, 107 bp, Homo sapiens
ctgaactgtgagtcagttgaacctcttccctttgtgaattacccagtcataggtacatctttattagcaatgtgagaatgtactaatacacctgacttccttttttt

SEQ ID NO: 26545 - DNA, 433 bp, Homo sapiens
  misc_feature 9: k=g or t
  misc_feature 11: w=a or t
  misc_feature 169: r=a or g
  misc_feature 177: r=a or g
  misc_feature 183: r=a or g
  misc_feature 292: r=a or g
  misc_feature 302: r=a or g
  misc_feature 368: r=a or g
  misc_feature 411: w=a or t
ctcagaagkawtagttccagcttttgctcatccagtatgatgtctgtgggttggttgtagatggctcttattattttgagatatgttcctttgatacctagtctgttgaggggttttatcatgagggatgttggattttatccgtattcaataaatggtgttgggatargggggcgrgggggrtgcagaagaatgaaactggaccccccacctttcaccgtatatgaaaattaactcaagatggattaaagatttaaatgtaagacctcaaactgtaaaaatcctagaagaraacctaggaratacccttatcaacatcagccttggcaaagaacttttggctaagtccccaaaggcaattgcaacaraacagaaattggcagtggggacctaattaaagcactctgcacwgcaaagacactatcgacagagt

SEQ ID NO: 26546 - DNA, 187 bp, Homo sapiens
ttatttgagcagaggtgtttatagtattctctgatggtagtttgtatttctgtgggatcggtggtgatatcccctttatcattttttatgttttatttttatttatttatttttgagacagtctcgctctgtcacccaggctagagtgccatggcacgatctcagctcactgcaagctccgcccccc

SEQ ID NO: 26547 - DNA, 294 bp, Homo sapiens
cagtatagccatgattttaattggaatttcaactatgtttgcattaacttagatttattacttctaaacatttgagaacagacatttgtagtgaatgttaaacatgacatttgacatgcgtaccataccatatacattttaatgtatatgcagatttagagaaggtaagtgatgaccacaggatgtctactgtctttgaatctgatggatatatttttgaaactctaatttttataccttttacttttatgtgagagagggtgaaatcttattgtggtgtttttcccccaccct

SEQ ID NO: 26548 - DNA, 112 bp, Homo sapiens
acccctagcctgaattttttcttttcagttggcagttcgaaataacataaaggaaaattctgtaaatcctctttatcttttcattattctcattccctaccccgtggtcctc

SEQ ID NO: 26549 - DNA, 198 bp, Homo sapiens
atgtagaacagtggggtatttggcaatagagctgggcttggggttcagaagatgtaaaagctgagatggggttgttgaagattaagggtttgctttgagaactgggatgttaggaagctcacctcactggggcggggggacccaaagggtgaagggacaccgactattttttattttatttatttgttttgagaggca

SEQ ID NO: 26550 - DNA, 181 bp, Homo sapiens
  misc_feature 14: r=a or g
  misc_feature 33: k=g or t
  misc_feature 38: k=g or t
  misc_feature 60: k=g or t
  misc_feature 83: s=g or c
  misc_feature 85: v=a or c or g
  misc_feature 93: k=g or t
  misc_feature 96: r=a or g
  misc_feature 109: s=g or c
  misc_feature 112: s=g or c
  misc_feature 160: w=a or t
  misc_feature 161: k=g or t
ataaaatagccctrcccctctggcttatctcakcaaakagcagtgcccagcccagctcakagggcaaatgggacagatcccasavgccctgakgargtctctgctgctsatsaagctgagaccaaacgcacccaacccttggcagccatctgtccctgcwkccatagcccacattcccatg

SEQ ID NO: 26551 - DNA, 153 bp, Homo sapiens
acaaatccccaacttctctcgagccttggctgggtttcctgccgtgtctctctgcattgccctgaatctctccccattctcgggctctttccttccccttctgccccactgacccatgggcctcacctggcccggtgactctgtgtccgcttc

SEQ ID NO: 26552 - DNA, 128 bp, Homo sapiens
atgaccgttacaatctgcgagatgatggctggcagcattttgcgaatagcctgaggcataatgatatagaccatgatttgtacaggggtaaaaccctgtgacaaaccagcttcggtctggcccggtcc

SEQ ID NO: 26553 - DNA, 266 bp, Homo sapiens
  misc_feature 253: w=a or t
  misc_feature 254: y=c or t
gtcatttcaatacccaaagaaagacaagtgacaggggcaatggatctcaggctctgagataagtatatcagatgacactggtggctctaaggatattgcaattaagcagctacctgtagccaggtattctgctgctcttggccttttcccacgcatcgtctcgtgtcttctccgaaagaccttggaagataggcctggaagagactgttgatgccactttgaagaaaagaacactgagaactagaggagggawyactttgcccatg

SEQ ID NO: 26554 - DNA, 221 bp, Homo sapiens
aaagatattttaaaaattgcctttcattcatacttcatcccttaatcttctgactcaatctctttggcagcttagagtgtagtatgatgtcagtgacccacatataagaccttaattataggcatacctcagagatactgtaggtttggttctagaccactacaataaagcaaatatctcaataaagcaagtcactagaattttgtttatttccccaaaac

SEQ ID NO: 26555 - DNA, 454 bp, Homo sapiens
  misc_feature 378: k=g or t
  misc_feature 384: k=g or t
atatttcttttaatattgttttagattattttggaaggcagggggaatcctgtttgctcaagggacaaaatttgagaagatacacaggacagccctcagtgacttcttggccaactagagtgtagtgggcggttagggtggctgataggatatagtgtggctgagaaggaaacaaaccgttgcccttgaggagaccaggtggattcctagtattgtacttctctatcaatcacaggtatttccatttccttcttagattttgatttagtatatttagaggaattgagctagagctgataagatttttctgcgtttgcatttccttgaaattagattggcctctaaccagtcatgtaacacatcttcccctcttcttcktcctcktttacacattgagggaaaacatgatttctcaaaaaatttaacttttgattgatctcctattgaattgcac

SEQ ID NO: 26556 - DNA, 247 bp, Homo sapiens
  misc_feature 12: s=g or c
  misc_feature 13: r=a or g
  misc_feature 183: s=g or c
atctaacatctsrgccctgctgtcctttttctgtttcccctggacatcaaaaccactttttaaccattcctgccaatccatcccagggtgactgcaccctgacagtcaggtctggccatgacctgcacacggtggctctccatcgtacttgggtcagtgactcaagtccccagcatggcagtsatgggcttgcacgactgggctgcctctctgtttctcccagcatctaaatatccccttccccatg

SEQ ID NO: 26557 - DNA, 252 bp, Homo sapiens
tggaagtgttataggttttcctaaatagcatacaagtatatccagtgcccgattaggtgattgctaaggctctattttcctgtagagcagcatgtcttaaaatgtggcctgtgcaccagtaccagtccaaaagacttttaaaaaaatcaatccatgatgtgagaaatacaaaaactgagagcaagcatttagaaatgtgtatagcagtttgactccaggcatgtcactgtggacacatctcattgaactggg

SEQ ID NO: 26558 - DNA, 252 bp, Homo sapiens
gagcccaaaatgctaaataattctattgttattaacaattgaatcaactatttaaaaagttgttatgaaagtaataacatactttgaaccttttcaactcttctggaattactcccacatttctaaatattcttaatttactttttaagagatggtgtcttgctttgtcgcccagggtggagtgtggtgttgcagtcatagtccactgctgccacgaattcctgggctcaaactattctcccgctgaagcaa

SEQ ID NO: 26559 - DNA, 224 bp, Homo sapiens
caataacaaacagaaagctgggagttgggtgtctggcaaggattttggacacaggcttaggagcattgggggcccaggaaagagtttaaccttaagggctcatctcttaatacagtcacgttggcggttaagtttcagcatatgaattttcaggacatggaccattggcagacacattcagtgtgagatgcctgacgctgggagtcagttgagtacggaggcaa

SEQ ID NO: 26560 - DNA, 235 bp, Homo sapiens
ttgagataatgttagatttacatgcagtagttagaagtaatacaaactgttgtactctgtggatctgttgtactctttgcctggtttcctcagtggtacatcttgcaaaactatagtacgtcattacaacgaggatattgacaatgacagagtcaatatacagaacagttctgccaccagagattccttgtgctgcatttttatagccacattgaccttcttcctcacccccaat

SEQ ID NO: 26561 - DNA, 212 bp, Homo sapiens
atcaaatgattatattatacatgtcttcacattgccatctgcagtgtagctattgctttcgtttctggaggctactggatcacctcatctctgcactttctcttctgctactatatctttcttgaatttgttggtctaaataggtacctggtggaatgcacatggcccatatcatgtttgaccatgtttgtgaagtcttcttgacccgccct

SEQ ID NO: 26562 - DNA, 403 bp, Homo sapiens
tattcatcacaataggagggtgttttattcttcactaaaatacaagatgttcttgtgaatcaaataactggaagaatcaagcccctacaaagggcaaaatgccaggaagcttcaaacattttatgagggcaggttgggtagaattggatcccatcagataactagagatcttttatctgccatgaataattcatgacttctaagtcaataaatattgttaaaaacgatgatgcttttcataaatgcaaaagaccactgtcatttatggttgctatgttttcattctgtaactgattattcagaattacatgatgatggtgctttttggatgaatgattggcacacatagctttgatgaagaactggaaactttaccatacagttttctcaggtcattttttca

SEQ ID NO: 26563 - DNA, 350 bp, Homo sapiens
  misc_feature 235: s=g or c
  misc_feature 295: k=g or t
attattaaaacgtaaaaattaactttaagaaagctaagtgtatttctccttgagtgatcatgcctttgcttagaaaacattaaggcaacaataattttccaacaccctttattttcttgaagatagttttaacaaaagctgtgcttaggggttttcctagaagtttaaaacttctactaatccttactgttcttctttgagaaccctccaggattttatttatttattttacacstttcaaaagcatagagacaaaacccggcaactggcatataatactatattagtctgagtkatccagaggacaagatacacacacacacacacacacacacacacacacacacaca

SEQ ID NO: 26564 - DNA, 211 bp, Homo sapiens
cactgctttttaagctgaatcttagctggttttcttgaactttgactttaggtgtaaaaattcaaccagacattctctccttactgtggtcagctgacatcataaccactaaggcttaatgagcttaacttgcactttcatcactagcaaaggtcttgaagttatttctcttactgattcataatgggtgtgtgtatgaatcactctcacc

SEQ ID NO: 26565 - DNA, 170 bp, Homo sapiens
  misc_feature 20: r=a or g
  misc_feature 29: w=a or t
  misc_feature 30: k=g or t
  misc_feature 83: m=a or c
  misc_feature 167: b=c or g or t
cataaacagatgactttcaratcccttgwktctataagccactaactacaaaactcctagattaaagcagaaactataaagamaattattaagtgctaaaaggtaaatcacaatgacaaaataatatgcaaaaatttctgggatgtagctaaaccagactgtagggbgcg

SEQ ID NO: 26566 - DNA, 195 bp, Homo sapiens
  misc_feature 25: y=c or t
caaggtaatgttggtttcatgagtyagaaagtactccctcctcttttattttctggaaaacattgtgtagaactggtgttatttcttccttaaatgcttagtagaatttaccagtaaaactatctgagactggagatttccattttggaagattttaaaccacaaattcaatttcttaaacaattacaggactat

SEQ ID NO: 26567 - DNA, 336 bp, Homo sapiens
  misc_feature 326: k=g or t
acttcctgactcctttcctttttccagtggttatcgcggcgcccaccggcctctgatctctgagtcttctccaacccacagacgttttttgttgctctggttccaggaccttctccacaactaggccattttccctgccaggtgtcctttttgacctcttgacctctgactcaaaggtcagctcaaaggttccgaactcgggcctgggatgtgagggggtactgaacctaagttctccgaatctttagccctgggtccctaagtcgcatccttaaggcacctcactctagatctgagccttcatatcccaaactcactcatgagtktccacatcca

SEQ ID NO: 26568 - DNA, 70 bp, Homo sapiens
  misc_feature 17: w=a or t
  misc_feature 45: y=c or t
  misc_feature 47: y=c or t
  misc_feature 57: r=a or g
agtcttcatgaagtagwaggtgaaaatattcttccaggttaagcycygatgcagagratggtgtaagaat

SEQ ID NO: 26569 - DNA, 440 bp, Homo sapiens
  misc_feature 20: k=g or t
cctttaaaatatagcaaagkatacagggttaataatatatgatattccgtattaatgaatcatgtttaatgttcaccatacattcgtaaaaagtatttatagtttgcatgcattgatttgctgacagtgaaatataggtagtggcaaggttaatgtagaaatcttttcagatattatttgctctgaattaacaaatacagcagtgtttcctgtgatgtggtccccagaactctgatcccacaagatgtccggtgagaagaaagtctgttggttaaatatttttgacaactgctgcatcctgtacgccccacctagtggttcacagtgcacatagggaactgaaaggctctgagaagccatgtaataagtaaatctgtttaacttttgtaaactgggtacttccaaaacttattttgaccatagaacatccccttattttt

SEQ ID NO: 26570 - DNA, 184 bp, Homo sapiens
  misc_feature 22: k=g or t
  misc_feature 154: w=a or t
  misc_feature 155: k=g or t
gaaaaagagctgtcaagcagakggaagagctagaataaagttcttaaatcaagaatgagcttgagtattcatggaacaaaagaccagagaggctgtagtgaagtgagtaatagagggaagaagcattgcaagacaatgtcaaaaacttggctgwkgccagataataacgagcgagggtcagcgg

SEQ ID NO: 26571 - DNA, 108 bp, Homo sapiens
ctcggtccttagcacataggaaactatgaatattgatgatgattatttttatgacgttactgttaactattctctaccccaagaagcagggcagttgtctggggcaat

SEQ ID NO: 26572 - DNA, 149 bp, Homo sapiens
  misc_feature 63: k=g or t
  misc_feature 64: s=g or c
  misc_feature 65: s=g or c
tgtgaggctgagactccgccgtgggaatttccacacgggctgaagatgcctagcacttgggakssggaggcgggaggctctgctggccggagagcacccccatcctcatttagacctggagacgctcctgtggtgccactttgccgcca

SEQ ID NO: 26573 - DNA, 220 bp, Homo sapiens
  misc_feature 12: d=a or g or t
  misc_feature 13: d=a or g or t
  misc_feature 84: d=a or g or t
attaggattaaddgcctacccatgctcacgcctgtaatcccagcactttgggaggtcaaggcaggcagatcactagatcaggadatcgagaccattttggctaacacagtgaaaccccgttctactaaaaaatacaaaaaattagtcaggcgtggtggtgggcacctgtagtcccagctactctggaggctgaggcatgagaatggcgtgaacccaggaa

SEQ ID NO: 26574 - DNA, 129 bp, Homo sapiens
cattctcttcttgaaaacttaagtttaataaaacagttcagaggaaacttaattatagttcttatactataaaaagctcttataaaaacaggggtagggccacaataaatttcacctcttgagcacgta

SEQ ID NO: 26575 - DNA, 190 bp, Homo sapiens
aatttaccaattgggagagttggcatggatctgtatggaaaatatgcagatgaaagattccttttatttgtaattgacaaaattgtatatattattgtttataacatgttttgaaatatgtatacattttgaaatagctcaatttagctaacatatattatgtcacatactatcatttttgtggtgagag

SEQ ID NO: 26576 - DNA, 161 bp, Homo sapiens
  misc_feature 132: s=g or c
agaaggtgcaatcctagataacacagctagccagatagaagacacctttttctccaaaatgatgccttggggtggggagtggtagggggaagagctcccaccctaaggggcacacactgagttgcttatgcsacttccttgttcaaaataaagtaactgcc

SEQ ID NO: 26577 - DNA, 185 bp, Homo sapiens
aattcagtttagaaaactttttattacataatttttagaaatatacaaaagagaaaaacagaaaaatgaatctcccaactcttcaatagttaacattttccagtgtcatctcatctaattccccacacttttttcgttagaatatgttaaagcaaatactagacaatatattatttcacccacaa

SEQ ID NO: 26578 - DNA, 247 bp, Homo sapiens
  misc_feature 20: k=g or t
  misc_feature 235: k=g or t
tttatgtttgtacagcagtkaggaagttcttcttctttttagatcctttaagaacaggtaaaagaaaatcttatctaacttagatattatgaggatattattatatctaaatctcaatgactagagaaaactcttgaaaaatatcatttattttcctgtcactgccattaaaaatttggtgaatttcaaggagataaaaaggtagaaaaaacagtagcagtactttggttatgtktatctgaagatc

SEQ ID NO: 26579 - DNA, 208 bp, Homo sapiens
  misc_feature 16: m=a or c
  misc_feature 124: k=g or t
  misc_feature 202: k=g or t
aactgtaatgttgaamtcatatcacattttaggtcgtgaacctagcgagcatccatttgtagaagccagaagcaattgcaaaacttgcagagtctagggaatctggtatgacatatttattgtktgatttccctatgaaattaattacagtagtatctagaatagtcatcatatcaagttatgcgttacacttcttcctgtkgggccc

SEQ ID NO: 26580 - DNA, 100 bp, Homo sapiens
tttgggcatttgctacatgatgggtgctgccagattgtggcaggtaaagagacaatgtaatttgcactccctatgatatttctacatttttagcgaccgg

SEQ ID NO: 26581 - DNA, 300 bp, Homo sapiens
  misc_feature 185: s=g or c
  misc_feature 188: r=a or g
  misc_feature 189: s=g or c
agaaaacctagtgacagagattctatagcgaccccgaccccgacccaagaccatcatcctgcagatgccactgtgcccaaggcagagccccgcgaggaatccagccccgaatccctgcaccccaagtcccaacgcggcgttaaggataccaacagccaggatcttcccttccagcgcttcggggstgrsctgccgcccggagcactccagcagcttccagagcccctggacccccatgaggcggctgcgtcctaagagcggaccccgacaacttctactctaattcttctacgacggcat

SEQ ID NO: 26582 - DNA, 177 bp, Homo sapiens
  misc_feature 155: m=a or c
  misc_feature 156: m=a or c
caataacatcaataagaataagatgcttaggaataaatttaagaaggcaaaagacttgtatgctgaaaactacaaaatgttgctgaaattatagatgacctaactaaatggaaagacatcttgtgttcatggactggaagatttaatattattammattgtaatactacccaaagcc

SEQ ID NO: 26583 - DNA, 123 bp, Homo sapiens
  misc_feature 92: k=g or t
tcaataacgtcatcgtgaacaagactagcagtgtggatcatttctgcaattaaggctgtggcgcgctggctagcttgcacatgtcgggagtkattatgatgaatattacatgctcgggccgaa

SEQ ID NO: 26584 - DNA, 517 bp, Homo sapiens
  misc_feature 400: b=c or g or t
  misc_feature 415: m=a or c
cgtttacttatatctcaccaaggcaaataataaatgtgaaaatgctttgtaactgagaaatgcttcaacaatacaggatattattgatcaacctcagatatcatctctggtctggagatcatagctagtggttttaactcaccatctttttcaagtgattttgaaacaatgatgagtataatgccctcctgcctaactggccttttcctgtttctcttaatacatttattcacaccctctggctgttctttctagatcaacagttctcagagtgtggttcctggatcaacagcatcagcatcatctgtgacattgttaggaatacagattcttgggccgcattccggacctcctgtccagtagtctcgtttaacaggctctccaggtgattctgattcabgcttaagtttgagamcactgtcttgaatgagggctctcacttcaatgtctcctcagactttgacttctcattttaaagtagtcctccaggtcgctctctgatagatcatcttatttt

SEQ ID NO: 26585 - DNA, 179 bp, Homo sapiens
tatttgctttgcctctctcgattccatatgctttgtctacaaattgtgaacacgtcccggtttctacccgtgtgtgattctaagtcgttgctgtactctagcttgtacgtgaaaattcacccatatgcagatagctgccctcttggaggcaaaacttaaagctatcagaaccatctgga

SEQ ID NO: 26586 - DNA, 188 bp, Homo sapiens
atttttttctttttcttcctcatgggaagttgtggtttattacagtgtccaaaacactcatttctcattcttttctcaagataatgagggtcgtcattgacatgtcttcagtttctgttgagataagaaaatgtattcacccttgtggaattttcctttcataagtaatttaaataaaataagtggct

SEQ ID NO: 26587 - DNA, 118 bp, Homo sapiens
  misc_feature 10: m=a or c
  misc_feature 11: b=c or g or t
  misc_feature 12: h=a or c or t
  misc_feature 13: h=a or c or t
tattttgggmbhhgaagaactcaaagaatggagtgagaggtcagggtattgtggggatcacctgtgtggatattgaaatcgctaggtattaatattgttggaaagtgtgatggcgaga

SEQ ID NO: 26588 - DNA, 305 bp, Homo sapiens
  misc_feature 241: k=g or t
tgagcaagagcgacgtgaagcccgtgcctggcgtgcccggggtgtgccgcaagaccaagaagaagcaccttaaaaagagtacgccctccacgccctgcctcacacgagatgaaccccactaagccttgaccacaactctgtgacccctggtctccaacttattcttagcatttactacctcacctccattgcctgatctcagctccccttgccctggccccatctttcaccagctcctgtkacagctaacctccagcaacccctgacctctgaccctggccaacccttgccagcctgaccccgat

SEQ ID NO: 26589 - DNA, 248 bp, Homo sapiens
  misc_feature 11: m=a or c
  misc_feature 12: m=a or c
aggcttcttgmmtataaaaatgtatgtctttcatcaaatttggaaaattttaagttatctctttaaatgcttttttgtgcactgatctatttcatatctccttctgttttccaatactgtggtgctaagccttttgacagtgttccaaggtctctgcagagctgttctccccatgcctacccccctcaatcccactcatcttttttctctcttgttcttcagattggataatttatcttgacctgccg

SEQ ID NO: 26590 - DNA, 177 bp, Homo sapiens
caataacatcaataagaataagatgcttaggaataaatttaagaaggcaaaagacttgtatgctgaaaactacaaaatgttgctgaaattatagatgacctaactaaatggaaagacatcttgtgttcatggactggaagatttaatattattaaaattgtaatactacccaaagcc

SEQ ID NO: 26591 - DNA, 319 bp, Homo sapiens
actgttaaagccatgacatggtctgcctcttttcttatccatcttaaaatagggagatatagcttggccaggattcttgaatccaattgctccatagcgtctacttgagatgagagatgatgtaggtttctggtgaactaggagaggtctctatttgccctaatcaggcagccttctttctcctagaccaggggttggcaaactacagtctgtgggccaatgtggcctactggttgtttttgtatggactgcaagctaagaacagatttcatgtttttttttaatggttgaaaaaaatcaaatgatattttgtgatgtc

SEQ ID NO: 26592 - DNA, 221 bp, Homo sapiens
  misc_feature 123: k=g or t
tctatgatccatttcaggttatttttgtgcatggtgtgaggtcaaggtcaaggttcattttgttccttcagatgtctaattccattgtcatttattttgaaaagagtgtcttttcccccattkgaattgctttggtacctttgccaaaagcaattgtctttataagtctgtatctatttccatactctcacttctgtttcataaatgtatatatgtccgta

SEQ ID NO: 26593 - DNA, 179 bp, Homo sapiens
ctgttctatcatttattttcccatttaaagttcaaaattccagattcttgagatagagagcgttattggtctggcttgcatcaggtatctacctctgagtctgccattcaaagagaagggggaagttagtatacctatgttgagaagtgttaccctctcagctggagagctgcccccaa

SEQ ID NO: 26594 - DNA, 188 bp, Homo sapiens
caactgtcatgcactgatgggagtgctatttagcatggaaattggattataataaagctagatgtttgtcagaggttgcgtaagctgccatcaaggatttcaccagcttcagctggttttagtcccaagaagaaacttctgaccacagacatcctgtttcttaaaaataagcagagttaaaggtgaaa

SEQ ID NO: 26595 - DNA, 404 bp, Homo sapiens
  misc_feature 325: r=a or g
  misc_feature 326: r=a or g
  misc_feature 376: r=a or g
tcatttcatttcattttgaggatctcgttctgtcacccaggctggtgtccagtgacatgattatgactcactgcaccttgacctcccaggcttttaagtgacccttccacctcagcctcccaagtagctggaaccacaggcatgtgccgtcacatgcagctaatttttttgtatattttgcagagacagagtctccctttgttgcccaggctggtcttgaactcctgggctcaagtgatctgcccaccttagcctcccaaagtgctgggattgtaggcgtgagccaccctgcctggccctagtagtcatgttttaaaaagtaagrragaaagagacaaaatgaataatgcttcatcgagtataccagtatcatcaraatataatgtcaacacataatcaataga

SEQ ID NO: 26596 - DNA, 427 bp, Homo sapiens
  misc_feature 290: n=a, g, c or t
acagttttgtcacagtgtattttcatagtgtttggaactaattttctttagaatatttgcttccgtatttactacatggagctggtctgtagttttgttctttttcataaacctgtattttgtcctgtctaagatttgttgtcaccagcactttgtgaaggttcctggggtggcctggagcagcttttcccgcagctccctcacactgccaccttatgacagggataatgagatggacccggatttcagaaacaataaaatgtggaatgtgtccatgaaatagggttganagtttgacttggaactcagtgggcctgttgcttttctctatgaaacgtctgtagcttcttagcacagtgcgtccatttagaaaggggggtctgttaactagtacatggtcattgtttaatgcaccttttaatctctt

SEQ ID NO: 26597 - DNA, 325 bp, Homo sapiens
  misc_feature 280: s=g or c
caatttaccacatctgctgagtaggaccagctatataattagcagggcccagtgtaaaatgaaaatgtgagcctttgttaaaaaattatttagtttcttaaaattctaattttaatcagatcattaaaccaagcactgcacccttcggagctgcagctgcacaggttacatgcctaccaagccagggctactgctgtactccacttcatgttcccttctctgttccatggcccagtaattctcttcaaggcaataagccaagacaattgtagggctggtstcctttgtttcccatctctcagaggtcactgtctttttttttttt

SEQ ID NO: 26598 - DNA, 183 bp, Homo sapiens
ctgaaagagttagttttgtgttattactacctccatctcaaagatgagtcttggaaagcttaagtaactttaggtcacattgtaatcagtggcagaactgggacttaagaacataattcatgactgcattttcttttctttctttctctttctttctctctctctcttttttttttttttttt

SEQ ID NO: 26599 - DNA, 234 bp, Homo sapiens
ttgcagtattcactcacgaactgttttattttaggaataatgcaaaaccaaccttcgtccggtgatgagaatagccgtatgataagagaatttgctcatcgtgctttaaatgattaactgttttaccttatttagtatttcatagactttgcatgatacggtacactcctaattatgcattctttggtttccaaatcttaatctaagatactttgttaactgactggtagcccc

SEQ ID NO: 26600 - DNA, 447 bp, Homo sapiens
  misc_feature 211: v=a or c or g
  misc_feature 221: h=a or c or t
  misc_feature 327: h=a or c or t
  misc_feature 362: v=a or c or g
  misc_feature 375: r=a or g
  misc_feature 391: m=a or c
  misc_feature 408: m=a or c
  misc_feature 416: n=a, g, c or t
tatgatatgtctagaataggcaaatctgcaggcagaaggttagtggttgcttggggttagggaagggtaggagggaataaggaggggcgagtgtgagaaatgattgttcaagtctaaatcactcttaaagtaataggacatgaccagacttgaaagaatggaggatggaggaaggtaaagagtagtagggaattaatgagtaaagcaagavaaaataagahagtgaaaaacagttttagaattggcagtttaaaggccttaaacctcttgtttggttggtatcatcaacatatgctggcctagtaaatgggttttggatagccagthcattataagtaaaccggatggattacgtttatgcvaagaggccataarcacacttagaaacacmacttgtggaccttggcmacaatttnctgatttgtatgtgttttttgtacatgatct

SEQ ID NO: 26601 - DNA, 163 bp, Homo sapiens
tataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttt

SEQ ID NO: 26602 - DNA, 114 bp, Homo sapiens
gggattaaggccctcaccaccgtgcccaaataatttttgtattttttgtagtgatggggtttcaccacgttggccaggttagtctcgaactcctaacctcaaagatccccccca

SEQ ID NO: 26603 - DNA, 321 bp, Homo sapiens
  misc_feature 247: s=g or c
  misc_feature 293: s=g or c
ataagtaactattaggaggttcagagcaaacctcaggacacttactccctgagctaaggtaaagaatattgtccctcatagccctggtctcagaaactctgtggggaagataagtcctgagcctagagctgccatttccacagacaactgaactaccttcaaacagatgtgtttttaggggcagcagatagaaggagctgaatccaggagtttccttccctgaaatgccccaacagaggcacagtcstccaccttccctggaacagagggctttcatctgtctctctgaagcsatctccctcccctgtttatgcccagagc

SEQ ID NO: 26604 - DNA, 258 bp, Homo sapiens
gttgtgattctgctttagttgggtctgggggggtctctctggagagtggctataaatgctagcctttgtgctgggcagcaaagcaaatcatcgggaataacccgggagcctggcagggaaaccgctgcactatggagaggacgcttccagatacagaggacaaatcaagtgaagggacggaacaggtcacacccagagcggcacagaggatctatgaaagataaaatgtggtgtgaggacacggcccagccccaccac

SEQ ID NO: 26605 - DNA, 325 bp, Homo sapiens
acatttcactcctaactccaccccctgggtatacaaagctttttaggagtcctttggaaacagtcgggaaccttcggtgttccaccagttttgacaacctgcatgacacaaaaggaattttgctttcaaactccataataaactcacggagtcagttccaatattcacttgctgaataacttctttacacttacctgcaattcatcaattctaagtaacctacaatcctgcaggagagaagaagggtcagcatctggaccagagctgttctgacagttagtattactggaggttcctggaaattttacagcaacataggcacggg

SEQ ID NO: 26606 - DNA, 169 bp, Homo sapiens
tcatctcattgtgttaaaggctcaagatgtgttgctcggtttgaatatattggagagcagaaggatgagttgagtttctcagagggagaaattattattcttaaagagtatgtgaatgaggaatgggccagaggagaagttcgaggcagaactgggattttccccgacc

SEQ ID NO: 26607 - DNA, 444 bp, Homo sapiens
  misc_feature 341: r=a or g
  misc_feature 370: k=g or t
acagtgacccaggctgtgaaaacacttcaggccagtccctgagtaggaatggacaacaaggtggtcaccatgctgacagctattccctgtgtgatttactttattatgaagtctaaatttgatgctgaagtgctagcctaagctcactaacctgccaacttagagaagaaggtaaccatggctaggatgactgggaatctgatggactcaattaagaatttctacagatgggaaaaccaaaactccttagtggcaagaggccaaagatggtcagcgaattgttgtttccggctgttggaagttgactgcagttgaataacagaacaaaaacggagcttcaraatcatggcgtgcctgcttcttctgggtkcttttaactgcaagcaatcagctttgaagagcacgtagggaacttctgatctcaagaataacatttacatatga

SEQ ID NO: 26608 - DNA, 248 bp, Homo sapiens
acacgcgactcccacaaggttgcagccggagccgcccagctcaccgagagcctagttccggccagggtcgccccggcaaccacgagcccagccaatcagcgccccggactgcaccagagccatggtcggcagaagagcactgatcgtactggctcactcagagaggacgtccttcaactatgccatgaaggaggctgctgcagcggctttgaagaagaaaggatgggaggtggtggagtcggacctca

SEQ ID NO: 26609 - DNA, 127 bp, Homo sapiens
aacatttgcaatgaagtgatatttaaagccttgtgtgacaaaagagaacccagttcagcagttggagaatgtccgtgctcagggttggattagagaagaggtggtcagtggagtggggagggctccc

SEQ ID NO: 26610 - DNA, 326 bp, Homo sapiens
  misc_feature 290: r=a or g
ttttccccttgctctcagaaacacaactaaaagctcgaagacctcaggtgacagactgcctcctgttacctcaccaagactgaaaacctaagcagtggctccgcccaaagagcaagcttctagccctctgacgggaggcccggcaagatcgtcctctggacagcaccttgctattttgtgacgctgctccagcccccaagatgtccaagatcttgggccttcccttgaggcgtgacgctcacgacccgaaacacctctcatacagcgtgcacaccacatttcagattttratgatttacactgcaatcaagcaaagaggctgcgaa

SEQ ID NO: 26611 - DNA, 423 bp, Homo sapiens
  misc_feature 277: b=c or g or t
  misc_feature 278: b=c or g or t
tgaaattctgtacatcatgtgctacatattaaagccagaaaggaattatttttctgatttaatagaaaatccaataaaccaaaatacttcattcattcctttagtatcttgatatttgaagtcctccttgtaaagcacaaaatctcttttcagtgtttataatcaagttacacactatgaaatcaaggtgcatctacaattgatagtgtatcttaatttaattgccagtatatttttgttaatggagtataaaatgttgcctcttgcaaacaacatbbtagatttgataaaatatcatagactttttgtaagaatactagctaccaccagacacagtggcttacacctgtaatctcagcactttgggaggctgaagtgggcaggctgcttgaggccaggactagcctggacaacatggcgaac

SEQ ID NO: 26612 - DNA, 206 bp, Homo sapiens
  misc_feature 197: s=g or c
cctcccgggttcacgccattctcctgcctcagcctcccaagtagctgggtctacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgascaccgcgcc

SEQ ID NO: 26613 - DNA, 295 bp, Homo sapiens
attatctctgttactcattttgatatggaattggaatatatcctgttcccagttcacactcccttaagttaaagagatacattctttttacaacagagccttatgttttcatctggctaattcagaagatatcttgttctcttttgaccagagacaaaagaagaaaagtcttggaaacatccttcacagtttggggatgaatgaaggcagagaagtattcatcagtcttatgttcctggcaatgaaagtcaaaggaagtcaaaattgtggcttctagctgacatagccccagcac

SEQ ID NO: 26614 - DNA, 137 bp, Homo sapiens
agcgtctctgcccggccgcccatcgtctgagatgtggggagcgcctctgcctcaccgccccatctgggtgaggagcgcctctgcccggccgagaccccgtctgggaggtgaggagcgtctctgcccggccgccccat

SEQ ID NO: 26615 - DNA, 199 bp, Homo sapiens
ctcttcccagccgccatcacatctaggaagtgaggagcgtctctgcccggccgcccatcgtctgagatgtggggagcgcctctgccccgccgccccatctgggatgtgaggagcgcctctgcccagccgcgaccccgtctggaagatgaggagcgcctctgcccggccgagaccccgtctgagaagtgaggagaccctg

SEQ ID NO: 26616 - DNA, 366 bp, Homo sapiens
gtccttccctgtaccaatacactgggagacaacaccatgtggtgtttttagttttttgtttatgcgaagttttagagttgagcttctcacatgtatgtctttggtccatcaggaattgcttttacttatggtgtaagaaagggatgtattttttactttttccatatggaaaaccaattttcccgacactatttattgaatagtcatttctctatgggtttgtatgacctcttctgtcatatatcaagctctcacaaagtctgtgtctttgtctaggctctctgtttcattgcgtagtcttgtttgtcctatccgtgtgccaagccacactggcttaatagtgctgatacctggtggagcaagtac

SEQ ID NO: 26617 - DNA, 410 bp, Homo sapiens
ccagttgtttgtgtcatctctaatttctttgaatagtattttgtaattctcatcatagagatctttcacctccctggttagctgtattcctatatattttattctttttgtggctattgtatatgggattgtgttcttgactgttaatattttatgtatcaatacataagataattagctaggaagaagtgttcctatctaaatgactttttagcatattcttcacttcttttcctctcaggattctcagctggtgaggggagcagatcaataagaccttgaagaaaataccttcagaaaatttagtttattcactcctagaagttcaaaatgcataaacatctaacgttttcagattttatctttcttgttatggttgtttgaaccttatcttttatattcccctcaag

SEQ ID NO: 26618 - DNA, 137 bp, Homo sapiens
  misc_feature 104: k=g or t
caagcccccggcttgctcatttcatccaggtgaggagtctggagtagagcagggcttctgaaatggtgacatgcacatcactctcctgggcatctggttaacakgcaggctccagttccccaggtctgggcgggctg

SEQ ID NO: 26619 - DNA, 224 bp, Homo sapiens
  misc_feature 208: s=g or c
aaaaaacctctacctcctgggttcaagtaattctcctgccttagcctccagagtagctgggattacaggcaccctgcaccacacctggctgatatttgtattcttagtagagatggggtttcaccatcttggccaggctggtctctaactcctgaccttgtgatccacccaccttggcctcccaaagtgctggtattacaggcgtaastaccacacccgaaccc

SEQ ID NO: 26620 - DNA, 437 bp, Homo sapiens
taatccattttatcgagcagtgattcccaaactttgagattttcagattttatgctctcgtctgttagattttatgacattctatcatcctaaaaaatgtactatatgtgttatatgtatatataagttaaagcaacttgaaattgacttggtttggcattgtctcaagaaccctagatatcattattgataccatggggaatcatagaaataaagttgaatatcattgatctgagagtaggatccagaaataagtagtttcagttcctgatcagttaagcctcaagtgtttgagtaaccaacacagcaagacttgggaaatgcagtgagcacccgaggaaaggaaagtggtagtctttgcctgcatttcagcatgcattttcctttcctactcagttgctatcttccacttaaataccctcatttgaccctaggaa

SEQ ID NO: 26621 - DNA, 305 bp, Homo sapiens
tgaagtccatactttattcaggtttctttagtttttacctaagatcctttttaaagaattgtttcggccaggcactgtggctcacacctgtgatcccagcactttgggaggccggtgtgagccaccatgcccagccacgtcatggtttttaatattctttttattgtttttttgacacagggtcacactgtcacccatgctgcagtgcagtggtgtgatcttggctcactgcaacctccaccttctgggttcaagtgattttcctgcctcagcctcctgagtagctgagatgataggcaccccgg

SEQ ID NO: 26622 - DNA, 408 bp, Homo sapiens
tctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcact

SEQ ID NO: 26623 - DNA, 296 bp, Homo sapiens
ttaaaaaatttttaggctgggtgtggtggctcacgcctgtaatcccagcaccttgaggctgaggaggcctgacacctgaggtcaggagttaagagaccagcctggccaacatggtgaaaccttgtctccactaaaaatacaaaaattagctgggtgtggtagcaggtgcctataatcccagttactcgggaggctgagacgggagaatcacttgaacctgggaggtgaaggatacatggagctgagatcgtgccattgcactccagcctgggcgacaagagtgaaactccatcaaa

SEQ ID NO: 26624 - DNA, 426 bp, Homo sapiens
ccctggtttctggcggcgcgcggctcccttttccactctcccgcgcgctcacagactgccaaggaaatctgatgtggaaaggaaaatagaaatagtgcagtttgctagccggacacgccaactcttcgttcgattattagctttagtgaggtgggctaataatgctggcaaagtggaaaaatgtgcggtgagttaaactttttattttactttgtataaaataacttttcgaatgttatgatagacatagttttacattttagctttaacttatccctgctgatttgagtgacatgtgaataatcatatttctgaatgataatgtatatttctgcagaacttagtatttgtttatggacacctgatcagaaagaagaggagatagctggagacatcattacgtgaggagactttaaatatgagact

SEQ ID NO: 26625 - DNA, 61 bp, Homo sapiens
gtgtttagatacgttttggagacctgttgaaacaaataccctactcttttttttttttttt

SEQ ID NO: 26626 - DNA, 123 bp, Homo sapiens
  misc_feature 61: y=c or t
  misc_feature 85: y=c or t
  misc_feature 98: s=g or c
ttaattaaactgtggatgcacaacagttgtagacctgtgcacctttttttctttttttttyctgagacaggttctcgttctaatycctggctggagtscagtggtgcgatcatagctaactcc

SEQ ID NO: 26627 - DNA, 254 bp, Homo sapiens
tttttttcagccagaagcatatacaggaatttaaatagtattgcaatccagggtagggcaaacactgtctcctttctcgatcctgagggcatcactgggttgccacagtggcctaccctaccctatcttcctaaggagaatgctggacaattgtatttaaatgttcttcagcatgttctgtttcttttagaatgctttctactaggctttgatgctttaaatgaatgagtcccccagctcttgagaaatgccgt

SEQ ID NO: 26628 - DNA, 107 bp, Homo sapiens
acatggctggtattggtatcgtggaaccaaggtcttccggaaacctggtggcatgatattcctttttttcttcacctagaatcttcaatgtttttcttttttttttt

SEQ ID NO: 26629 - DNA, 385 bp, Homo sapiens
tgttggggtccatagtaaaggataggtgaaatcaagaatagcactcttacaagggtgaggagagaggaactgggaatactctgctagaagacagctgcactgcccatgaagtggtaaagtgcaatttgaaagtggatgttgattagttgcaaatctatattgcgaactctaggacagtgaattaaaatgttttgaaagaagtataattataatgctagaaagtaaaaagagtggaatcatgtaaaattctcagttaaaccaagaaaagacagtaatagtagcagaaaggtaataataaagatcagaacagaaataaatgaattgaaacaaagaaaacaatacaagagatcaacaaaaccaaaagtatgctttttgaaaagataaa

SEQ ID NO: 26630 - DNA, 335 bp, Homo sapiens
  misc_feature 237: n=a, g, c or t
  misc_feature 319: b=c or g or t
tcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgnatttttagtagagacggggtttcaccatgttggccgggctggctgcaaactcctgacctcaggtgatcagcccgcctcagcbtcccaaagtgcatggg

SEQ ID NO: 26631 - DNA, 153 bp, Homo sapiens
ttcgcctcctaggttcaagtgattctgctccctcagcctcccaagtagctgggattacaggcacctgccaccacgcctggctaatttttgtattgttagtagagacggggtttcaccatgttggccaggctggttttaaactcccgacctcca

SEQ ID NO: 26632 - DNA, 179 bp, Homo sapiens
tttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccctag

SEQ ID NO: 26633 - DNA, 397 bp, Homo sapiens
  misc_feature 7: n=a, g, c or t
  misc_feature 8: n=a, g, c or t
  misc_feature 9: m=a or c
  misc_feature 157: n=a, g, c or t
gtcagcnnmatgggtgctgtgcctcagtatcaccagggtgctgtcaggaccagggacagatcaggaggtgaaggaaatgtttgcttcatgagaaaatgagagggggctgcaaactccaagacccaggaatgcctctccatggcttcacacatatgtnctacgggtggagatggggcttgctgaagcaggttactccaaagcacctgccacctcaagggggtccccaggtcatggtctccacacaagacatgagctccagagagcatgtggtcagtagtccctccagccatgcagatcctgccactgatcaaaggacagccccgtggtgagagctgtggcctgaggcaggtgaccccacagcacctgtcacctcagaagttgaggaccagagagtcca

SEQ ID NO: 26634 - DNA, 223 bp, Homo sapiens
acaaaacattattctaagtgaaagaagccaggctcaaaagatcatatattatatgattacatttatatgaaattcttgaaagacaaatttatagagacaataatcagaacagttgttgcataaagtgagaatcgggattaactataaataggcatgaaggaacatttgggtgggggtgttgagaatgttctaaaattggattgtaatgattgttgataactgc

SEQ ID NO: 26635 - DNA, 107 bp, Homo sapiens
acttctcctgggtcccctgttcgtcccagcatcccaaggcagtgctgaggccccggggtggctgcgggaggggggccacacccctatatctcacctagcacagcacc

SEQ ID NO: 26636 - DNA, 93 bp, Homo sapiens
taatggaattaatatcaacaatcttagagaaatcccacactattcatgccattttcatgatctccaccttggtaatttttttttttttttttt

SEQ ID NO: 26637 - DNA, 187 bp, Homo sapiens
aagggaataaacgcacaatggcaacctgcttggggcctcttgcacacggtggaagctttgttttttagctctttgtagtaaatcttgctgctgctcgttgtttgggtccacagtgtctttatgagctgtaacactcactgcgaaggtctgcagcttcactcctgaggccagcaagaccacgaacccc

SEQ ID NO: 26638 - DNA, 280 bp, Homo sapiens
agataaaactactggaggatgtgctccaccaaaaataagtgaagagggcaagaaagcaaaaggtgtgggatgcagcagttttaaagttgtggtttatgaatcttagtactgttctgtaaaacttattttatttatgtatgtgtgtgagacaaataactgtcctaatgatgtcagtgcaacattgattgtgatagaatgatacgaggaggagggtggatggaaaggctgcccttgtgtgtgttggggggcggtggcaagggaggaaaaaaaaggaagccgt

SEQ ID NO: 26639 - DNA, 50 bp, Homo sapiens
ataaaactatacttacataaaacatcggtctttttttttttttttttttt

SEQ ID NO: 26640 - DNA, 66 bp, Homo sapiens
tgcgtgagtaacgagaggcttctgggaagtggagtctctcccccaccttttttttttttttttttt

SEQ ID NO: 26641 - DNA, 213 bp, Homo sapiens
actgcaagctccgcctcccaggttcacgccattctcctgcctcagcctccggagtagctgggactacaggcacttgctaccatgcccggctaatttttttgtagagacagggtttcgccatgttagccaggatggtctggatctcctgacctcgtgatccgcccgcctcagcctcccaaagtgctgggattacaggcgtgagccaccgcgccc

SEQ ID NO: 26642 - DNA, 65 bp, Homo sapiens
cttgttcagagaggtaaaatttcactttcaactaaggaaagatgagaccaatttttttttttttt

SEQ ID NO: 26643 - DNA, 168 bp, Homo sapiens
ctctaataggataacaattttcgagcattttctgtgatggaatcactcatagttgtttgagaactttgatacatatctccaacaaataaataaactattcgtattgagtaaatctttttacttgaatcatttggttcataaaaatgacttacctgccatttccagagc

SEQ ID NO: 26644 - DNA, 178 bp, Homo sapiens
  misc_feature 14: k=g or t
tataaataattttktttccttttttgtgatggaatctcactctgttgccaggctggagcgccatggtgcaacctcagcctcctgggttcaagttattctcctgcctcagcctcccaaatagctgggactacaggcatgtgccaccatgcccagctaattttttttttttttttttttt

SEQ ID NO: 26645 - DNA, 238 bp, Homo sapiens
aaaagttagctgggcatggtggtgcacacctgtagtcctagctactccggaagctgaggcagttggatcacttgagcctaggagtttgaggctgcagtgaggtgtgactgcactcaggcatcatgagagagtatcttactctatataactaacccagaagatgataaaaatttgaagtaagatttctatacattgcttttaagctatggtaaagtcaaaaaattttaagtcgggaggc

SEQ ID NO: 26646 - DNA, 223 bp, Homo sapiens
atttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggag

SEQ ID NO: 26647 - DNA, 210 bp, Homo sapiens
  misc_feature 198: m=a or c
cctcccgggttcaagtgattctcctgcctcagcctcctgagtagctggaattacaagcatgcaccactaggcctggctaatttttgtgtttttagtagagatggggtttcgccatgtttgccaggctggtctcgaactcttgacctcaaatgatctgcccgccttggcctcccagtgttgggattacaggcgtgagcmactgtgcccggc

SEQ ID NO: 26648 - DNA, 348 bp, Homo sapiens
  misc_feature 35: k=g or t
  misc_feature 36: n=a, g, c or t
aaaacatatatccacacaaaaacttgcacacataknttcatagcagcattattcatccaaaaagtagaggtactcaaatgactttcaactgataaacacagatgaacaaaatgtatgtccaaacagtagaatattattcagctataaaaaagaacagagtacacttagcaaactaagaatagaaggaacttcctcaatctgataaaggacatccatgaaaaacccaccactaatgtcatacttaatcatgaaaaaccgaatgcttttctcctaagataggaaaaagacaagtatgtctactcatgccatctctattctactttgtattggtgcttctagccagggcag

SEQ ID NO: 26649 - DNA, 439 bp, Homo sapiens
  misc_feature 37: n=a, g, c or t
  misc_feature 38: y=c or t
  misc_feature 406: m=a or c
atggctgtgatgtcacagaacatgtgaagtcagaggnyctatggaaggtgaagcctctgaacgggagcccaggccccaaagatgggagccagacagagaaaacgccctctgcagaccagaatcaagaacagttcgaagagcactttgtggcctcctcagtgggtgagatgtggcaggtggtggacatggcccagcaggaagaagaccagtcgtccaagacggcagctgttcacaagcactctttccacctcagcttctgctttagtctggccagtgtcatggttttctcaggagggccattgaggcggacattcccaaatatccaactctgcttcatgctcactcactgaccctccctccctcctgggctccaggtcacaactcccaaaggagatgcaggcatggmtctctgcctctgatcaccatcactgtatctcaa

SEQ ID NO: 26650 - DNA, 272 bp, Homo sapiens
ataccatcttcgacacggggacaaatcccgggatggagtccagggtttcccgcggcttcggcgcttcctgacctggcgtgactgccgacttgtcggcaccacccagacctcaggctccctgtctgtagtggtgaatcgaccttcctcatggcagtccaggcttcccaagccccatgtcctgttgatccgggacaaactcttccttgaacgttcttcactacgagccgctgctgatctgtactgcctggaggagcatttccatagcgcccgtc

SEQ ID NO: 26651 - DNA, 208 bp, Homo sapiens
aaattccctgatttaaaagcatcttcctctataagtcctcggtttaaaaacaagaatcaacaaggaacaagatttgtctataagtaaaaccgtttctgttgctattttttgaacaacaagagacatttctctaggagattaagccagtcgtttatcatgttgtttcagggaagagtatactctgagttataatgtaatacccagacag

SEQ ID NO: 26652 - DNA, 372 bp, Homo sapiens
  misc_feature 289: m=a or c
  misc_feature 291: n=a, g, c or t
  misc_feature 292: d=a or g or t
  misc_feature 293: n=a, g, c or t
  misc_feature 327: k=g or t
  misc_feature 344: r=a or g
atcatatgatgttttggtatgtttattccaaagcagatttaataaaaactgaactgtagttttaggtcaacttttaagccatggcgtgtgcttgtggtcgcagatacttgggaggccaaggcgggaggatcttgagttcaagcccagcctgggcaaaataatgagaccctgtctccaagaaaacaaacagacaaaaaagaattgccttctttcaaattatacaatttaaggaagggcaggcaacgtatagttgaaattatttgatcaaagatcatagttttatgtaacmcndnagaagttttcttgggcagaacattgttatatttkattttcttgcagatagragaacagtagaaggcagtgcaatgtagt

SEQ ID NO: 26653 - DNA, 220 bp, Homo sapiens
tatggaagtataggaagtcaggaaagacttctgaggagtctacattttgatgagcactgagggagttagcgatgtgaagattagggagaacaaatttccaggctgtgttacaaaggttattcaggatttaccaaccagcagaaaaggctataataagctctatcttagcctttcatgaaatcacgtatttccaatacaaagaaatctaactgctacattc

SEQ ID NO: 26654 - DNA, 319 bp, Homo sapiens
accatatgatccagcaatctctcttctgggcatatatccaaaggaaatgaaattgccaccttgtaaagatatctgcactcccatgttcattgcagcattattcacaacagccaacatatgaaaacaacctaagtgtacatcaacaggcaaatggataaactgtgatgtgtacataaaatggaatattatccagccatagaacagaatgagatcttgctattggccacaatgtggatgagtctgaaggacattatgctaagtgaaataagcctgacacagaaagaggaatattgcatgatctcacttatatgccgacggt

SEQ ID NO: 26655 - DNA, 369 bp, Homo sapiens
  misc_feature 333: n=a, g, c or t
  misc_feature 334: n=a, g, c or t
  misc_feature 335: r=a or g
ttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactnnrctatgtgactcggatggtctttcacacggcgcga

SEQ ID NO: 26656 - DNA, 200 bp, Homo sapiens
catcaatgcactggtgctctatgtcgggactcaggccattgcgcacatccacaacaagggcagcacaccttcaatgagcaccatcactcactcagcacacatggatatcttccagaatttggctgtggacttggacactgagggtcgctatctctttttgaatgcaattgcaaatcagctccggtacccaaatagccaca

SEQ ID NO: 26657 - DNA, 321 bp, Homo sapiens
aaaacattctgaatagtttatttgtcttgacggaaagtaaaaagaacaaacttgttttatacaaaatcagatgctccaaatggtcagttgatgatgataccaatcaaagaaaactaaggaggaagaaaaagaaaacaggaaagagaggaggcaacaggaaaatcggccttcgtccttcagtctacgcttgaaattgccagggatggataaatctgaagatgaatgaaaaaaagaaactactgggaacggaacagaaacaaaaaaaaaggatgggaaatctgaagctgctatttcttattctgatcttaatagcaggataca

SEQ ID NO: 26658 - DNA, 324 bp, Homo sapiens
atcgcgcggtgcgggtgcctccgccgccgccgcccccggagcgggaggacttctatttggaactgagtccgacagctcaggactggctgctcaaactccacaatttaatgaaaaatctcagatgatgactcagaaaacctctaatgatctgaggaatatattaagggattccagagtcaaaggctgatcatggagggcattgatgagggaagacttcagccagaaaacaaccaactaaagaaagaaataaaaagaaaagaagaaaggaaagaaaggagagaaagaaaaggaaagaaggagagagagaaggaaggaaggagagtc

SEQ ID NO: 26659 - DNA, 348 bp, Homo sapiens
aaaagcaagctgccggaaccagcggtggcaactggcttgggtccgcttctgcagtgtgtgagttttgttcttttgctctttgtgataaatcttgccgctgctcactctttgagtccttgctgcctttgtgaactgtaacactgtgaaggtctgcagcttcactcctgaagccagcaagaccacccactggaaggaatgaacaactccagatgtactgcttttaagagctgtaaggcccactgtgaaggtttgcagcttcattcctgaagtcagtgagaccacgaacccaccagaaggaggaaactctggacacatctgaacatctgaaggaacaaactccggacacac

SEQ ID NO: 26660 - DNA, 390 bp, Homo sapiens
acctcttttgcctcagcctctcaagtagccagtattacaggcacctgccaccatgcccagataatttttttgtatttttagtagagacagggttttaccatgttagccaggctggtctcgaacttctgaccttaaacgatctgcctgcctcgggccctcaaggagctgggattacagggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtga

SEQ ID NO: 26661 - DNA, 171 bp, Homo sapiens
tcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccac

SEQ ID NO: 26662 - DNA, 255 bp, Homo sapiens
ctaaagtgtcttaaagtcaccttgtaacttgcactttataatcttgtacctggaccttgtaacttgtacagtaagactggaaccttgttaataaggcatcatatttgaaagctgtattttttagttttctgttcagtcacaactatagacagagagccacatcttcatgagtttaaaagaaaatcttgctgtgaaggatacattgttgttttagtctgttttgtgttgctgtaacagattatctgagactgggct

SEQ ID NO: 26663 - DNA, 255 bp, Homo sapiens
  misc_feature 26: w=a or t
  misc_feature 32: s=g or c
  misc_feature 47: y=c or t
  misc_feature 76: k=g or t
  misc_feature 97: s=g or c
  misc_feature 173: m=a or c
  misc_feature 192: w=a or t
agaaaaaaaaaaacaaaaacaaagawtttgascctaggtcacttgtyccctttccctgcctcagtgaaatcatgakttgagatacagcttctaccascctgggtccccaggatccaaatcaggataccaccttaaatttaacataatgcccttaaaaatgaaaaaggtcagamccaagctctatccacagawtcaaatcaaaatttcactttggcatccttcttttgctcacccttcaccctgttccccacccag

SEQ ID NO: 26664 - DNA, 62 bp, Homo sapiens
atgtcactctgggagggagacagcagcaactaagctgtacaaggtttttttttttttttttt

SEQ ID NO: 26665 - DNA, 383 bp, Homo sapiens
  misc_feature 375: s=g or c
tggtttagtttcttagatattaatcttaaattcataaagatttttctaaaattggctagcaagctaacctgtttttttaatgatcttttttcttttttttctttttttttgagatggaatttcactcttgttgcccaggctggagtgcaatggcgtgatcttggctcactgcaacctccgcctcctgggttcaagcgattctcctgcctcagcctcctgagtagctgggattacaggcatgtgccaccacacctggctaactgtatttttagtagagacagggtttctccatggtggtcagactggtcttgaactcctgacctcaggtgatccacgcacctcggcttcccaaagtgctgggattgcaagcgtgascaccgcgc

SEQ ID NO: 26666 - DNA, 231 bp, Homo sapiens
  misc_feature 210: m=a or c
  misc_feature 216: r=a or g
gagagggaggaagggagaaagtgagaagggaaatcggaaagagaaaagggaggaaacggcagagccagagagaaagaggaagagactgagtgtgaaggagagaggacacaggggatgactgagagacagagagagagagagagagagagaatgagacagagacttaaggaagagaccctgtgagtctgacaataaaagatttggacagamacagaragattggagccagag

SEQ ID NO: 26667 - DNA, 285 bp, Homo sapiens
cttaactcagcacaggcacacagatgaacaaagataatatgtataagaatattcactgcaacatcgtttagtgaaaaataagaaacaactttatatgcttaccaatggagaaatggttattccacggtatatccagttaaaactaattaaatagctatatatgtaccaacctagaaagaaattcaagcaaatttctagggtaagatggcaaattgaacacacgcctcaattttattcctttatggcatcccactaaaactcaagatttttttttttttttaaaaa

SEQ ID NO: 26668 - DNA, 120 bp, Homo sapiens
  misc_feature 49: v=a or c or g
aatgtgacatcagtgcagtgcaggaggcgcttcaaaattcatggcagtvgtgagagcaattttgtgctttaaactgcaggctccctgcatctttaagaaaataaaaataacaaggtgggc

SEQ ID NO: 26669 - DNA, 217 bp, Homo sapiens
  misc_feature 7: s=g or c
  misc_feature 21: s=g or c
  misc_feature 61: r=a or g
  misc_feature 130: r=a or g
aacatascctgtaggtatgasgctacagaaagactcatgaaggaggagagccccctgtttrcaaaagtccaggcctatctttggaaaatcaaggctgtgcaggagacggggtcttgctaagttgatcaarctggtcttaaactcctgacctcaagctgtcctcctgccttggcctcctagagtgttgggattacaggcataaaccgctgcgcccctt

SEQ ID NO: 26670 - DNA, 258 bp, Homo sapiens
agacattctggtcctcacgggccaagctggccagagctccaatcccttatcacagtgaccaaactacatagagaaaaagaggcatgaaaacaaggactcttacaagacttgccaaatgttaggctgaacaagtgaaatagccatttttatgggttacaaaacagttagacatcagtaacggcattgaattccacctaatttgaaccaacgggaaaggtcaatacttaactggattaaaagaagaaacacctggagata

SEQ ID NO: 26671 - DNA, 339 bp, Homo sapiens
attcttgagaactatagacaagaaatgagagagaactgggatagtctaaggccacatggagatctgtcttgcactatgttgacttagtttagaggccccggctggagaggagtcaggcccttttcttgtggggtcaattaagtccgatcctcaattacctccttgtttgtctctcagacccttggccgctattcagtcgccatatgtgcctcggagccaggtaccagacaaccaggaacaagcccactgaaattatttcaagtcatcaagcctaagcctgtttgccctgcctaaccctttcattcctgcagaaaccacaaaaaaaggttttcgcctact

SEQ ID NO: 26672 - DNA, 196 bp, Homo sapiens
  misc_feature 27: d=a or g or t
  misc_feature 28: r=a or g
gatcctttggagccaaagactcgaacdracatgcgagacctctaccaactgaaggtttcgtgagcgcactcctttgccaagatcttggtgaatagtctttcactgtgcaattttatcttagaaattgttttacgtttgatcatgattgtgcttggctggatgttttttgttggacttgtgtgttacatgggcacgt

SEQ ID NO: 26673 - DNA, 274 bp, Homo sapiens
  misc_feature 28: y=c or t
  misc_feature 201: r=a or g
  misc_feature 241: r=a or g
  misc_feature 259: r=a or g
  misc_feature 260: m=a or c
  misc_feature 273: m=a or c
gctaaaaaggaagggatcacagggcctyctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagaraagaaaagaaaggtggagaaggatacaatgagtgatcaarcactcgaggctctgtcgrmttcactgggcgcmc

SEQ ID NO: 26674 - DNA, 111 bp, Homo sapiens
ttgtttccttgaagaatgtggcaacactgttttgtgattttatttgtgcaggtcatgcacacagttttgataaagggcagtaacaagtattggggcctatttttttttttt

SEQ ID NO: 26675 - DNA, 217 bp, Homo sapiens
  misc_feature 157: k=g or t
catctccatcgtaaatactcactggggccagcaattcatcctcttgagcttcttggtcttctgacatttaattttctgaggaacaaaaccaagtatgaccatgagagtgatctctgatcatcctcactgctacactcccaccagggccatgacagtktacaaatgccttgttgttttgttttttttttttcgttttttttttttttttttttttttt

SEQ ID NO: 26676 - DNA, 423 bp, Homo sapiens
  misc_feature 14: m=a or c
  misc_feature 19: d=a or g or t
  misc_feature 28: w=a or t
  misc_feature 74: m=a or c
  misc_feature 88: k=g or t
  misc_feature 112: k=g or t
  misc_feature 114: k=g or t
  misc_feature 125: y=c or t
  misc_feature 136: k=g or t
  misc_feature 320: r=a or g
  misc_feature 332: w=a or t
  misc_feature 339: r=a or g
  misc_feature 375: d=a or g or t
  misc_feature 378: r=a or g
  misc_feature 392: w=a or t
  misc_feature 410: w=a or t
ggttgtttcattgmactgdgccctgagwttcccaaggagtaaccataaaagatttcttttattttgtccatgamctacgagacaggakcattctaagaagagcaggcatgaktktgagtgcagaygagtcactctkcctgcaataacgccaataattctacagaaaagggtgattaaagtatacagtgaagatgaaaccagcagggctttagatgtacccagtgacataacggctcgagatgtttgtcagctgttgatcctgaagaatcattacattgatgaccacagctggaccctttttgagcacctgcctcacatargtgtagaaagawcaatagragaccacgaactggtgattgaagtgctatccaactdggrgatagaagaagaawacaaactatactttagawaaaattatgccaa

SEQ ID NO: 26677 - DNA, 230 bp, Homo sapiens
agatggaaaggtactatacctgataaaactggcgatgtatacattgacaaaggtggccatcagatactggcagtcaaagcgatccatgatgcctccatggccaggaatggctcgtttgaatccacttgcgaagaatcctccaaaggggccaatgagcgaggcaaaggtggagagagcgatgctgtgaatctggaaggggtacatccggaccgttttctgagaagagtggt

SEQ ID NO: 26678 - DNA, 138 bp, Homo sapiens
  misc_feature 13: d=a or g or t
  misc_feature 101: k=g or t
  misc_feature 133: m=a or c
aatcgtcctagcdaccttttaaccaaacactggtgcagatttgctggcctacatgacggggcgctgcatcaacttcaccagggtcaagaacaaccagccakccaagtacccactcaacaacgcctaccacacmtccac

SEQ ID NO: 26679 - DNA, 339 bp, Homo sapiens
  misc_feature 93: r=a or g
ctttttttgaaatgttctaggccaaagtaatgattcatggattcagcacactttcctttgttgaaaagcactgcttgttccccctcaaagctrtatgagaggctgtgtaggagagagtggagagcaggtagcctaccggacctacagttcaccatttcagccctgtaattgaccagctgtgggacctcagtgtgaagcttattcatgaagagacctctgcctgaacatacagcaaatttaagaaggttgtgcagatagtctgaaggaggaccagcagagagaagagattccatcttccagaggttgccactgtctgcctccccacttgtccccgtccac

SEQ ID NO: 26680 - DNA, 186 bp, Homo sapiens
  misc_feature 156: r=a or g
  misc_feature 157: r=a or g
  misc_feature 175: n=a, g, c or t
cctcagcctcccgagtagctgggattgcaggcgcgtgccaccacgcccagctaatttttgttcttttagtagagacagggtttcaccgtgttggccaggttggtctctcggctcctgacctcaggtgatctgcccgcctcagccccaaagtgctgrrattacaggcgtgagcgcncaatgcccagc

SEQ ID NO: 26681 - DNA, 170 bp, Homo sapiens
aacttcttcaggctgaatgaggcaatgatattcctgcctaactgtgagggtctcttgcattcaaggtagagaggagctcagtcagaaggcctcgttatgagctaactatgacatgaaccctaaaatttctgttccctggaaggcagagaccaagagaaagtaccgccatc

SEQ ID NO: 26682 - DNA, 473 bp, Homo sapiens
  misc_feature 76: w=a or t
gtgtgttccttctgaatgttaacagctggaggtccatactatctccaaggatttgatggcctttaaaaactaaagwaaaaccaggttggtgggtaattttaggtttattgtatatagatttgcattgggcaagaacggaatgttagaaatctgtaatactgtatgctgatggtaaacttactgtaaggatctcatttgggtatctggaaggtgatagttctgtttctttgttatatacacagcatgttacagagatgtgatttttctccccattaaacagaactaaaagacagtatatttatttaaacgcaaagctttttccccttttatgtctcctcataaactccagagacagtctggaaggccctcttaaatttgtcaaagagcagtaaagtgtctcacgctcagtttttctagcagatcgtaatactctcagttgaccctgctgggatttgaacctgcagtttctatta

SEQ ID NO: 26683 - DNA, 84 bp, Homo sapiens
aatcttggctggggcactgagtggtggcttcctcttcctggatagagtatcagctatgcttattgtagtaaacagtagtcagca

SEQ ID NO: 26684 - DNA, 328 bp, Homo sapiens
  misc_feature 11: d=a or g or t
  misc_feature 13: d=a or g or t
  misc_feature 14: w=a or t
  misc_feature 30: v=a or c or g
aaatgttagadadwagcaaggctgtcagcvtggattcaagccaccacctcttggctggaagatgtgcccttcgaatggtgtctccaggatcagagatggatctgtcttcatctgtccataccccaactcaccttgttgctataagaaactgagccctccagttcaagaatacaaaccacagagaggggaatactgaagggaaatctaaaaggtcagtgatgtttctaggcaaggcatctgtggaaagctgacttctgccttcaaatgcatctggaatccaaccacctctcaccacctcctctgtaaccccctgtctagaccactctca

SEQ ID NO: 26685 - DNA, 186 bp, Homo sapiens
taatttttgtatttttatttatttatttatttatttatttatttttgagacggagtcttgctctgttgcccaggctggagtgcagtgggggtgatctcggctcactgcaagctccgcctcccggattacgccattctcttgcctcagcctcccaagtagttgggactacaggcacccgccaccaca

SEQ ID NO: 26686 - DNA, 165 bp, Homo sapiens
atgcaaatggaaaccaaaaaagagcaagagagcctatagttttatcacataaaataaacttaaatcaagatggttaaaaaaaaagacaaggccattatataacgacaaaggggtcagtacagcaagaggatataacaatggtaaatatatatacacccaacacca

SEQ ID NO: 26687 - DNA, 320 bp, Homo sapiens
  misc_feature 7: n=a, g, c or t
  misc_feature 8: s=g or c
atcatanstagctgagctcacagaggctggcggacgtgcgccccatggcggaggagctgaagttgcagcctgggaccagggaaatcaagagacagagcctcactcggttgcccagactggagtgcagtggcagaatctcagttcactgcacctctgcccacgggttcaagagagcttcctgcctcagcctcccgagtagctgagattacaggcacttaagtattttatttaaaagccacacttttaagaagacccaagctcaagccctggctgcaccatgtaccatccttgcaaccctgagcaagttgtttcgccacccc

SEQ ID NO: 26688 - DNA, 233 bp, Homo sapiens
aacctaggctgctttactcttggaactgtctttccctcttcaccttccatgggctctctgacctctttacttggtctgcttccacttaggcctgcccctcagcctcattgcatggccatgtgtaggttcttcttctagcagtgttctctgagactgctgtggctaatgtgccttctgttgcaactgacccctggacaccttacttgagatttggctctagaaagtagcaccac

SEQ ID NO: 26689 - DNA, 204 bp, Homo sapiens
tttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccagc

SEQ ID NO: 26690 - DNA, 216 bp, Homo sapiens
  misc_feature 65: r=a or g
  misc_feature 66: v=a or c or g
ctttgggaggccgaggcgggcatatcacaatttcaggagttcaagaccagctggccaacgtagtrvaaccctgtctctactaaaaatataaaaattaggtgggtatggtggtgcgtgcctgtagtcccagctacttgggaggctgaggaaggagaatcgcttgaacccgggaggtggtggttgcggtgagccgagcctctgtactccagcccgggc

SEQ ID NO: 26691 - DNA, 144 bp, Homo sapiens
  misc_feature 106: s=g or c
  misc_feature 108: k=g or t
  misc_feature 130: k=g or t
  misc_feature 141: s=g or c
  misc_feature 143: s=g or c
  misc_feature 144: s=g or c
acggttactggggaaggaaactgcttccccaggtcaacccggcagcctcagtaggtgaggggcactgggtagaatacttggggtgccagggaggcattaatgcgasakgagtcaggtgctcagtttttakatggagttggsass

SEQ ID NO: 26692 - DNA, 112 bp, Homo sapiens
  misc_feature 7: s=g or c
aatcttsgctggggcactgagtggtggcttcctcttcctggatagagtatcagctatgcttattgtagtaaacagtagtcagcagttgttcattcttttttttttttttttt

SEQ ID NO: 26693 - DNA, 228 bp, Homo sapiens
gaaaatgtttaagttttttcgttcatttgaaatgtagaatcaaagtttcatttacatgcatattctatgtacttggtactataatcttagagtttgttctattctttgtaaacacagaatgtgaatataaattttctgccatgttttgttaggaataatgtatctctccattaatttgcatgttttcataccattgactcttaaatttccatgaacactagcccacga

SEQ ID NO: 26694 - DNA, 101 bp, Homo sapiens
cttcctgcctatgctatggctggatgaacacagatgtgaggggatttgaaccatctacaatcaatccatatgtgaccaatggaggagaagcagccccatag

SEQ ID NO: 26695 - DNA, 231 bp, Homo sapiens
atcattctatgtagatttgactaaagatgaggttttcacttgcctttatgtactgtgtatttgaactgctcatagaatcccttgttctttaaatacgctgtgcattcatggataaaatgaaatctatatgagatctctctgaggatttttgttattcttatgcttgtcttctgagcatcttcaagtaattgatttttacccagtaactgccctcatagaggtggaccccaa

SEQ ID NO: 26696 - DNA, 251 bp, Homo sapiens
cacacatatatataagtatttttgagagagtttcactcttgtcgcccaggctggagtgcagtggcgcgatctccgctgactgcaaccttcgcctcccgggttcaagcgattcttctgcctcagcctccccagtagctgggattacaggtgtgcgccaccatgcccagctgattttgtattttcagtagagacaggtcttcaccatgttggtcaggctggtctcgaactcctgacttcagatgatccacccg

SEQ ID NO: 26697 - DNA, 332 bp, Homo sapiens
  misc_feature 43: k=g or t
  misc_feature 134: r=a or g
  misc_feature 289: r=a or g
  misc_feature 290: s=g or c
  misc_feature 331: m=a or c
agcaatttgctgaggttccttaccccaccttggaaggtttgtkcttttgctctttgcagtaaattttgctgctgctcactgtttgggtccactctgcgtttgtgagctgtaacactcattgcaaaggtctgcarcttctctcctgaagccagtgagaccacgaacccaccaggaggaaccaacaattccagacatgctgtcttaagagctgtaacactcaccgcgaggtctgcagcttcactcctgagccagcgagatcacgaacccaccagaaggaagaaactccgarsacatccgaacatcagaaggaacaaactccagacagggccamt

SEQ ID NO: 26698 - DNA, 245 bp, Homo sapiens
  misc_feature 11: w=a or t
  misc_feature 26: k=g or t
  misc_feature 43: k=g or t
  misc_feature 45: w=a or t
acacctatacwaatttttattattakctggctatgaaggaaakawatgcacttaattgggtaaacagtttatttcttatcttcttttaagctttctgaacgaacagaatttggctagctggttttctacccttgaaagcataaagaagcttggactgtctgaaaatactcttttctgggagtatgttcgtagacaactgaaataaactgcaactcactggtgccaaatatatcacacacagccca

SEQ ID NO: 26699 - DNA, 347 bp, Homo sapiens
  misc_feature 132: r=a or g
  misc_feature 133: m=a or c
  misc_feature 137: r=a or g
  misc_feature 142: d=a or g or t
  misc_feature 144: w=a or t
  misc_feature 145: r=a or g
  misc_feature 310: r=a or g
cccaaattcttctcatcttggaaaactgaaactctatacgtattaaacttcccattcccccagcccctgacaatcaccattctaccttctagctctgtgaatgtcacaagtacatcattatgtgggatcatrmagtrttttdtwrtgactggcttattatacttagcatgatctacgttgtagcaggtgtcagaatttcgttcctttgaaaggctgaataatattccactgggtttagatacaccacgttttgttgacccattcacccatcaagggacccaagttgcttccacattttagctacagtgartaatgctactagaaacataagggcacaaagctgggtc

SEQ ID NO: 26700 - DNA, 173 bp, Homo sapiens
  misc_feature 10: r=a or g
  misc_feature 26: k=g or t
  misc_feature 83: b=c or g or t
  misc_feature 99: r=a or g
ggcggatgtrgtgacacctgagctgkggcggttgtcaacgtcctataccagttttggtctcagatacattgaaccgtaatttbgttctccaaataaatrttggggtgttgaatatttatacggattggcatcataaagataccgcgatacctgcaggaaagtaaaggagacag

SEQ ID NO: 26701 - DNA, 270 bp, Homo sapiens
  misc_feature 12: m=a or c
agggctggggamgaaatggcaaactagggatcttacctgggccttcccagttgagactacgtcaaaatgggctcccatgagactgcctggctcatgcagatggaaggctaacatctttttagaaacaactcgtgctaccctctcctgttccaaaagcctgtctggtcagaatggtttgatgagccctcctcttcagctaggaaaatgacggtgttcagaaagttaaaacttcttcgctggaaggatttcatcttaaagttgggagagctg

SEQ ID NO: 26702 - DNA, 285 bp, Homo sapiens
tttgttttctcgttattttgtggtcttctcttccttcttccttcctgtcttccttttagtgaaattgattttctctggtgttatgttttaatttcctgccttttattttttgtgtatctgttgtatgttttttgatttctggttaccataaggcttacaaaaaatatcttataacctgttattttaaactgatgccaagttgacactgattgcataaacagacaaacaaataggcaaagagaaaactagtggaaactctctacactttaactttatcccccgcct

SEQ ID NO: 26703 - DNA, 385 bp, Homo sapiens
  misc_feature 33: r=a or g
  misc_feature 88: r=a or g
  misc_feature 89: s=g or c
  misc_feature 163: r=a or g
  misc_feature 171: k=g or t
gacggcgtggacgggctgcccaaggaggcggtrggcgccgagcaaccgccctctcctgcatccaccagcagccaggaatccaagatgrstgctaccaccagccaaccccaaatgtcatcattggaataatttcaataaccacaactgacattaccataatgtractgagtktacctctttgggcttttagttatgctaattgattacaatgagacttcacttcagctattttgcatccccaagaagataagacatagactcaccagcatgtgatttagattttgaaatggtgctataagccacccagtgccctagtggagccacggaccaaagtgaccctcattcctggaggattatttctgaacctggaccacaatccaaccca

SEQ ID NO: 26704 - DNA, 189 bp, Homo sapiens
  misc_feature 149: w=a or t
  misc_feature 150: m=a or c
taacatttctttttgttggtctcaatattattaaaacaactaaaagaacctaagtggaagaaaaatcacacatgctctaagttaaacttgtttgattatttttataagaccttagctgagtgtttgaggagtcatcaatcacctagggwmaagttgtgagctagcaattggaagataatatgggaaacc

SEQ ID NO: 26705 - DNA, 113 bp, Homo sapiens
  misc_feature 14: r=a or g
taccgctccagtarccgtttccgaggcagcaggtgcggccgctttagccctgagcgggctctgcggctgcctgcgagtctctgctgtgccgacccttctcttcgcggacccca

SEQ ID NO: 26706 - DNA, 362 bp, Homo sapiens
  misc_feature 45: k=g or t
  misc_feature 316: w=a or t
  misc_feature 322: r=a or g
  misc_feature 355: s=g or c
cttaccttcaaaatctcgaccaggttctcacattaaatgtcagakaaaaatgccctcatgcttctggcaaagggagggagaaaggaacgattttgaaatgcacagagcaccctgttcttaacaaggccttcccttaggagaaactattcaaccagagcctaagcccctgagattttatcacagcctacccgacctgggggagggaaataccctactccagcaactctagccatcctgtcccacataaggtggggaggagacaagggactgagaagcacttgtgaagttcagaggcacaggctcactaagaggctgwgactarccacaggaccacagaatgccttccccacttcascacccaa

SEQ ID NO: 26707 - DNA, 135 bp, Homo sapiens
atctgcattgcctactgggccatgactgctctgtacctggctacatcggggcaaccccagtatgtgctctgggcatccaacatcagctcctccggctgtgagaaagtgccaataaatacatcatgcaaccccacg

SEQ ID NO: 26708 - DNA, 103 bp, Homo sapiens
tgctgtctgatgtacagtgtttaggtttgtcttgaccttattaaatcatggaaagcggctcctatgagggaagttttttttctttttcttttctttttttttt

SEQ ID NO: 26709 - DNA, 314 bp, Homo sapiens
  misc_feature 8: m=a or c
aaagatgmctctgaagaatggcatgggatggatcctttcgaatgcacttgagcagcggtctccaaccacagggccacagagctggagctggatctaccatgaaagacctctgaatccaggaagagagactgactgagcaacatgttattcagggtctccatctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaattttcgcata

SEQ ID NO: 26710 - DNA, 304 bp, Homo sapiens
aaacatgagacttgccaccatcttggaagcagcccaccaccatcttgggagctctgggagcaaggaccccccggatactataagaagattgggatagatactgagtgagcctcagaaaatcagctggatacaccccagctgcagcagagccatcagaaaacaactcctgattttagttgatcagattcaagtcaatgaaaaaatgacgtttctgtgtgtctacttcgggctaagcaccagggtaggcacaagagagatcacagggatgaattagtcctagccccttggagattatcctctcacc

SEQ ID NO: 26711 - DNA, 175 bp, Homo sapiens
attatagtatgtatttagctaaaaagcaattaatataattatagcagagttaagaatttatatcagatcacgaataacattttaatgtttcaacaaaatatcccagaatttgaattggaaggattgttttgagttgctccaatccaaagtgcttttttacatatctgagggattt

SEQ ID NO: 26712 - DNA, 232 bp, Homo sapiens
  misc_feature 130: r=a or g
  misc_feature 131: m=a or c
acttggtcttgccaactgcaggaaattcttgcacactttctctacttctctctcatcccttcttcctcctcttccttttctctccctctcagaaaacccccagtcctgtatgaagagaggaatcctgcarmgaacgctgggcaagccctaatggcctggatcataggtgttgataatgattgttccttattataagcagacaacaaactgctgagaacctgcgctgcggccc

SEQ ID NO: 26713 - DNA, 227 bp, Homo sapiens
agacttgaagatgtgtgattattttcagtaggcagacatctaaccctgaaaaccactcgcttgcagagcgctggatcagcaatgcctactagttcttcattcaaacaccggattaaagagcaggaagactacatccgagattggactgctcatcgagaagagatagccaggatcagccaagatcttgctctcattgctcgggagatcaacgatgtagcaggagagat

SEQ ID NO: 26714 - DNA, 114 bp, Homo sapiens
ttggaatacctgagtcctaggtttctgtataacctttccccctagatagtcatagtcaattttgtgactttatgtatgatgatgataactcccaaatttccacgtttttttttt

SEQ ID NO: 26715 - DNA, 188 bp, Homo sapiens
  misc_feature 91: r=a or g
gttaggccgctctccgacggcgtccttcccgaccgggacgcactctccttcccgcctgtgaggaccgcgtcgctttgtccgaaagacagtrtggcctgctcgagttgcgtcggagcatctggctttggggtggccctgggtgggactgcctgtttggattaccgcgcagaccttggcgccgcccccac

SEQ ID NO: 26716 - DNA, 165 bp, Homo sapiens
tacaggtgtttttgtaaatagtatttgccatagaacaaaattgtgcgactacacccataaaaatgaagtataatcatgtatcactaactttgggcctctcaagtcatcaggatagaaaacttttattttgctcttacatacaaggtactattttaagctccccta

SEQ ID NO: 26717 - DNA, 295 bp, Homo sapiens
tattagggttgggtattacagtatgtggctcctatttttattttattttattttatattttatttttgagaccgagtctcgctctgtcacccaggctggagtgcagtggtgcgatcttggctcactgcaacctctgcctcctgggttcatgcagtcctcctgtctcagcctcccgaatagctgggattacaggtgcatgtcaccatgcctggctaattttgtgtgtgtgtgtatttttggtggagatggggtttcaccatgttggccaggctggtctcaaacccctgacctcaag

SEQ ID NO: 26718 - DNA, 331 bp, Homo sapiens
aagctgtactctttcagcacatttcctttcatctcccccttcttccctcttctgtgctctcaagactttccccctcttgctgccacagatgcagtgaagcctgccatatataaggtacaatgtgtggcaactctgcaggtggggtctatgcaagctacagacccctctgagtgtggtcagtgccttagcctggcctggatgcctaccaggccccaccaacacctagctgctggatattataatggcatggtggttttctggaaccttcccactaactcacccctgcagcggatacggctctctgatggctccttctagccctaccccttct

SEQ ID NO: 26719 - DNA, 249 bp, Homo sapiens
ccccctgttgcgcatgtagatcatttttgaatttgttattggaaaatactgcagcaaataccttaaagttcacatgccgtaaatctacttttatagttaaaaatttttaaaaggaacacatgagatggctttttgtacatttttgtgcttaacttaccactgacttcttttcaaggtcactctggaatatagacccgtaatcgacaaaactttgaacgaggctgactgtgccaccgtccccccagccag

SEQ ID NO: 26720 - DNA, 175 bp, Homo sapiens
gaacccagtgtccctcgggctgacaagaaccacttcccaagacccacagtgcctggagaggacatggggaagggaccagtgtatcagttgcgtggagatactagagacacacttgcccagctgggaattgcagagctagtgcatttctcccaaagcacagactaataccccagac

SEQ ID NO: 26721 - DNA, 224 bp, Homo sapiens
gaatgtacatggcctcaggttaaaaatggtgccttgagaagtgtgatcctcttagaccctgaactggtttggggagtggggaatggagtatgaagtgaaaggaggagtttggtttgtagagtttgagatgccagagggccatccaagtggaaagataatcaccagacaataggaaatgcaaagttgaagcttgagccaggctggagtcattgattcaggagctc

SEQ ID NO: 26722 - DNA, 300 bp, Homo sapiens
attcggcagagatgaagtctcactatgttgcccaggctggtcttgaactcctgacctcaagcaaccctcctgctcaagccatcttcccaccttggcctcccagagtgttgagattacaggcatgagccaccacacgctgcctattttttttatttttacgaatttttttgttgttgcccaggctcaagcgatccacccacctttgcctcccaaagtgctgggattatgtgtgtgagccacagctcctggcctctttttttgtttttcctatcccaagttgtattactagttttggggagt

SEQ ID NO: 26723 - DNA, 186 bp, Homo sapiens
atcatgcaccttaaaagtttaagaagcactgtaggggcttctgggtttttttttgtttttgttttgttttgttttgttttgttttgagacagagtctcactctgtcacccaggctggagtgcagtggtgcaatcttggctcactgcaagcatagactcccgggtttcacgccattctcctgcctcg

SEQ ID NO: 26724 - DNA, 169 bp, Homo sapiens
atatatagagatgagagaggggaatctctgagggatgtagtaacttgccaaggctacacagctggtaagtggcagccggagatttcagcaaggcctgtcagactccaaagcctatgttctttctagcaccccaccccgcttttcatgtaaactcttgctcccagagagg

SEQ ID NO: 26725 - DNA, 415 bp, Homo sapiens
agtctagtctgaacactccctcctggaaggattttcaactctttagccccacctaatcacttcttgtccttatgagcagtcaagagccctgccatagccttccagtgcccagcccatagcctagatagatgacagagaagagccttgacaagtctcacctacttcacagcaccttgcaatagatacctttacaatggaaattctctggcaaaggacaagcccatcccatgtgcctgtggtatttttaccagcccattacaaagagaaactccttggcacaattcctcatggacacatattgctgaagcttgttcaagatttttaaaaattttttatattcaggcaccttataaaatttattcttcacatccctttggtggagccctgagccacttgcagtgtgaagcagccccca

SEQ ID NO: 26726 - DNA, 186 bp, Homo sapiens
  misc_feature 152: m=a or c
atcatgcaccttaaaagtttaagaagcactgtaggggcttctgggtttttttttgtttttgttttgttttgttttgttttgttttgagacagagtctcactctgtcacccaggctggagtgcagtggtgcaatcttggctcactgcaagctmtgactcccgggtttcacgccattctcctgcctcg

SEQ ID NO: 26727 - DNA, 325 bp, Homo sapiens
ctaaactggcagaaatagcaggtatgaaggatttaagagaaagggaaaagagtacaaaaaagatgagtcctttctttggcaacttaccagatagaggtatgaatactgagagtgaagaaaataaagattttgttaagaaaagggaaagttgcaagcaagatgtgatctttgacagtgaaagagaatcagtagaaaagccagacagttacatggaaggtgcaagtgaaagacaagggtagaggagaaatggagaggccaggagagggagagaaggaactagcagagaaggaagaatggaagaagagggatggggaagagcaggaag

SEQ ID NO: 26728 - DNA, 200 bp, Homo sapiens
cagtttttttgtaattatgaaatgtgaatatgtttacttgtaccaatatgtgattgtttctttatggtatatgtggaggagtgatattgctaaggtgagaggatatgtgcatcatcagctttgccaggttttgtcaaattgctttccaaagggcttgtgccaatttgtgcagccatagtatataattctttccggtgccg

SEQ ID NO: 26729 - DNA, 251 bp, Homo sapiens
taaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgtaaatactgtgccattttatatcaggaacttgagcatctgcagatattggtatcggagggcggtcctggaaccaagcatccacggatactgaggggcgac

SEQ ID NO: 26730 - DNA, 121 bp, Homo sapiens
aacttcattgccaactttgaataggcagttatagaaactcttatttgtcctcctaggacatgccattttttttttccttctcatggccctcattttccctttgaatttttttttttttttt

SEQ ID NO: 26731 - DNA, 285 bp, Homo sapiens
  misc_feature 116: w=a or t
  misc_feature 123: w=a or t
atctccatttgttgtctgtaatttaaaatttcttcaatttatagggtgattctgtagggcaagatagacatggtaatagatagactgtagaaatgaaagaccaaactcgttttttwccttgawaacataccagcaaacacactcatcccatgcatgttgttaaaaatccatcaatagactgggcgcggtggctcacgcctgtaatcccagcactttgggaggccgaggcaggcggatcacctgaggtcaggagttcaagaccagcctgaccaacatggagaaacc

SEQ ID NO: 26732 - DNA, 201 bp, Homo sapiens
ccaaatggtgaatcattagtctcagatggatggtccctggaattaagacagccaactacgtagtcaattgtgaggaaagaggaaaataaagggcacaaatgaagtgctgaaaatgtgtcatctaagatgatatttcaaaagctgagttattaggaatttcatgctgtttttaatacgtagagaacagacaatcccccatta

SEQ ID NO: 26733 - DNA, 406 bp, Homo sapiens
  misc_feature 41: r=a or g
  misc_feature 71: r=a or g
  misc_feature 89: r=a or g
  misc_feature 104: r=a or g
  misc_feature 117: k=g or t
  misc_feature 120: w=a or t
  misc_feature 121: w=a or t
  misc_feature 163: r=a or g
  misc_feature 216: w=a or t
ttgtataaaataaatcattcagaagagcgttgcaaaaagarcagaaaaatattattttgtacttaaaaatrtagttgtttagttgctaratgttgagagactarttttatttttatkttwwtggaacagagtcttgctctgtcgcccaggctggagtgcagtracatgatctcggctcactgcaacctccgcctcccaggttcaagtgattcttgwgcctcagcctcctgagtagctggaattataggcacatgtcaccatgcctggctaatttttgtatttttagtagagacagggttttgccatgttggccaggctggtctcgaagtcctggcctcaagtgatccacctgccttggcctctcaaagtgccgggattacaggtatgagccactgggcctggccat

SEQ ID NO: 26734 - DNA, 460 bp, Homo sapiens
  misc_feature 413: k=g or t
tttgcagaaacgaggcctcactatattgtccaggctgagtggctcttttattaaccagtcattacactgcggaacagccaacatagagtacttgctctcgtcctgtgaattttctttcatgagggagtcaatatgtagtggaaagaagcatgtagcaaaaaagacaaccttgatctttaataaaaaagaagttggtttatttccaaaataaatcccctgacaaaaaacctggtgatgttaagcaattgactgtcttagagtccagcagaagaccttagaaaaaaaaagcagaacccactggagtagaaaaggaagcatgtagcatatactcagtagtgaaatttaattttactgactgttaggtatctatgccaatttgttttcatacttcagttggttttggaatctgcctkatacctaatatttatttattcacactcataagcatcaaatatttaat

SEQ ID NO: 26735 - DNA, 197 bp, Homo sapiens
tgtccctgacaaccatccatactgtgtaggtgcagccagatccagggctttgcaatttgctgatgtaattgtgttatttggtgccagactaaattggattttacattttggactgcctccaagatatcagccagatgtgaagtttatccaggttgatatctgtgcagaagaattggggaataatgtaaagccctcgc

SEQ ID NO: 26736 - DNA, 231 bp, Homo sapiens
aatcatataaacgagggttaaagacagttcggtaatccctgtggacaatcatgaaaactaactaagcttccaaatatattttggctgtgtgaactaattagaatggagttttctatctcatagagatggttcaaaaaagtaagagagcattcaaggtatttctgagtgtttcctgcatcaaagaacacacaaatctaaggaatgttagcttcctctcctttcctcaggcca

SEQ ID NO: 26737 - DNA, 336 bp, Homo sapiens
attctagaatctacctcttgaagattacaaatgagactgggaaaccctcttcaataagacctgtgtgatgatagattgtgtcctgagcccgcagtcaggctgaaagagtcaacaaccagcaaagtgaagatctaggagtctgttccccttgaacctgtgtggacctgatcaaacctcgagggaaaggctgggagaacacatccctggtcagctgtaggaaagccagagagcatttgagaagaggctggagcttgaattttgcaaacacacaagccctctgcatttccccagagagaaggtttttttctcgtcttcatttcctttgaaacacctgag

SEQ ID NO: 26738 - DNA, 326 bp, Homo sapiens
  misc_feature 14: d=a or g or t
  misc_feature 123: d=a or g or t
  misc_feature 249: w=a or t
  misc_feature 295: h=a or c or t
  misc_feature 305: r=a or g
aaattctgcaagtdgatgatgacagtggcgaccctctgaatttggttaaagctccagtgtcaaggtcccctccaagggagcaggtaattgaagacaatatggtccctcagggaaatgcctgadcaggaaactacagttggtgccatccaggaccacacagaatccagtgttcacaactaagaataaatacctagagctacttgtgagtgaatcattggcttctagaaatcagatgcccagatgatccawgactagtttgttatctcatctggaacctacaccaagagatgcagthagcatcttaragtaaatgttcatggaagcta

SEQ ID NO: 26739 - DNA, 225 bp, Homo sapiens
  misc_feature 17: m=a or c
  misc_feature 73: m=a or c
  misc_feature 128: h=a or c or t
atggtagtgaataagtmtcatgaggtctgatggttttataaatggatgttcccctgcacatgctctctcctgmccaccatgtctgactaaattttgtatttttactagagacgggctttcactatgthggccaggctggcctccaactcctgatctcgtgatccgtccaccccgacctcccaaagtgctaggatcataggcataagccaccacacccggccgaaa

SEQ ID NO: 26740 - DNA, 156 bp, Homo sapiens
  misc_feature 71: w=a or t
agctgcccacagtcatccttctccatcccactgaccttccacccgtgaccaatcaggagatgtttccagtwtattggtgaatttattagggctcagagaggatgacctatccaaggtcccactgccaactgaatgtaggacaagtctctgaatccc

SEQ ID NO: 26741 - DNA, 167 bp, Homo sapiens
  misc_feature 3: r=a or g
  misc_feature 21: s=g or c
  misc_feature 158: k=g or t
cargtactgtaagcaagtcasttagcatcagtaagccttagtttccttgcctataaagtgaggataaaagtgtctgctataggaggattacttgagccgaggagttcaaggttacagtgaactatgattgtgtcactgcactccagcctgcgtgacakagcaagatc

SEQ ID NO: 26742 - DNA, 153 bp, Homo sapiens
  misc_feature 24: r=a or g
  misc_feature 44: r=a or g
  misc_feature 117: m=a or c
  misc_feature 124: m=a or c
  misc_feature 129: r=a or g
  misc_feature 130: w=a or t
  misc_feature 131: k=g or t
  misc_feature 136: k=g or t
agaactatcctttcttctcccatrgtgtatcctcactgtccagractctcttctcagaagcccactccttcccctgtgctgtttatatgcttaatgaaaccaagtacccaaagtgamcgtttcmaactrwkactakgcagctaagtagactcc

SEQ ID NO: 26743 - DNA, 325 bp, Homo sapiens
  misc_feature 12: w=a or t
  misc_feature 129: w=a or t
cagtatttagawaatacttgcattcatctagtgattttgtttgattttgttttacagtgaagcctgcctacagttttcacaaatctgtatcctttcagtaaagaatggcttatatatatacatttaatwtaccttccttttggttaatttatgaaatttagaaattattcatttttatttaggaaatcatacattcttttttatggaaactttattactaagtgtcctcatttaaaaaaaatgttattataggaaatttcaaacatatataaaagtaactcaatggtgtagtgcaccccatacattgagataatatattgcagct

SEQ ID NO: 26744 - DNA, 183 bp, Homo sapiens
cttttgcgacagggtcttactgtgtcatccaggctggagtgtagtagctcagtcatggctcgctgcagcctcaaccttttaggctcaagagatactcttgccttagcctcccaagtagccaggactacagatgtacatcatgactcctggctaattaaaaagcattttttttttttttttttt

SEQ ID NO: 26745 - DNA, 361 bp, Homo sapiens
  misc_feature 116: k=g or t
  misc_feature 117: m=a or c
  misc_feature 183: r=a or g
  misc_feature 184: s=g or c
  misc_feature 360: s=g or c
gaggaaacagatttggtgagcaatgagctggcctccggcacaggtccagggtagaatgacaacattgttggagtagagacggggtttcaccatgttggccacgctggtcttgaackmcctgacctcaaatcatcgacccacctcagcctcccaaagtgcttggattacaggcgtcagctgtcrstctccttgttatctgcagtctggtgtgcaggctgaagaaacaaccctgtgtgggacactgctggtcttctggtagaaagaaaagaaagatgatggaatcacactgtgattcagattgtgggctgcacttccacttacgttttattggctaaagtgtgcctgccctcaacccgggasa

SEQ ID NO: 26746 - DNA, 236 bp, Homo sapiens
  misc_feature 61: r=a or g
  misc_feature 115: r=a or g
  misc_feature 117: y=c or t
  misc_feature 119: m=a or c
taaaaatatctaactagtaaaccttaaaaaacatagttatttataaagtagctggggccargtgcggtggctcacgcctgtaatcccagcactttgggaggcagaagctggcaartyamaaggtcagacattggagaccagcctggccaatatggtgaaaccccatctctactaaaaatacaaaagttagctgggcatggtggcaggcacctatagtcccagctactctggaggct

SEQ ID NO: 26747 - DNA, 375 bp, Homo sapiens
  misc_feature 77: m=a or c
  misc_feature 78: m=a or c
cccaaattcttctcatcttggaaaactgaaactctatacgtattaaacttcccattcccccagcccctgacaatcammattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccacgttttgttgacccattcacccatcaagggacccaagttgcttccacattttagctacagtgaataatgctactagaaacataagggcacaaagctgggtctgtgacaccctgcttttaattcttttgt

SEQ ID NO: 26748 - DNA, 112 bp, Homo sapiens
agagagaaccgccatgaagagagaagggggtgccgcccacctctgctccgacagcctcccggagtcccagcagcaagacggcaaccacgcacccaacttctccagccacggc

SEQ ID NO: 26749 - DNA, 349 bp, Homo sapiens
  misc_feature 180: k=g or t
  misc_feature 182: r=a or g
  misc_feature 183: r=a or g
  misc_feature 304: n=a, g, c or t
  misc_feature 305: v=a or c or g
  misc_feature 306: v=a or c or g
  misc_feature 310: s=g or c
tcaagaaaaataatgccgccttaatcctggatgccaaggtcaatcatctctgtgccctttgatagtaaggatgtcattatgaaagggtttttaatgaacatgaacataatgctcgccgcactcctcagggagatggatgcgttctgcaacttcgggatggccaggtgggccttcattgckgrraaaaatgattttaaaacattagctctattagaaataaatcccgaacagctggttgaggttgcagaccagccgtacccagcagtgattgagaaattcaggaatgagctgcagcaggtcaaanvvtgasaagggcccaagccctgattagcggttgggcaacacagcg

SEQ ID NO: 26750 - DNA, 125 bp, Homo sapiens
gtattccgaggtccaggatacagaggctgaaactctgactggttttttgaatggcattgagtggattcttgaagaagtggaatctaagcgtgcaagatgattctcttttcagatcttgggaacgt

SEQ ID NO: 26751 - DNA, 210 bp, Homo sapiens
  misc_feature 147: s=g or c
  misc_feature 167: k=g or t
aactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggastttcgttttcagtgagccakgtggagcgcagtctacgggagggccactacgctcagcgcctga

SEQ ID NO: 26752 - DNA, 351 bp, Homo sapiens
cctagtccatgttcctccctttgcctccatgcagcacagtatgtaaaccagcagcaagaatgccggggaagaaatcaacctgtaaaatacattgatagaggactggttagacacatagaagagcttccaggccacgaaaactcatcagccattttaaagattgtgacaattagtgtgtgtcttccatgaaaagattcctaaagaatattgttaagaaaagaaaaaggaccctaatattacatgtacagtgtgatgattttgcattgggtgtacacacagatcaaactatggaacatttctagcactgagggaggctcttttggggctccgcccacctggcatcccaccccg

SEQ ID NO: 26753 - DNA, 144 bp, Homo sapiens
tgcagtgacacagtcatagctcgctgcggcctcgacctctcgggctcaggtgatccttctacctcggccacctcagtagctggtactataggcgtgtgctaccacacctggctaaattttgtatttttttgtagagatggggta

SEQ ID NO: 26754 - DNA, 213 bp, Homo sapiens
aaaatgctcatcgtcactgatcatctgagaaatgcaaaacaaaaccacaatgagataccatctcacaccagttagaatggcaatcattaaaaagtcaggaaacaacaggtgctggagaggatgtggagaaataggaacacttttacactgttggtaggagtgtaaactagttcaaccattgtggaagacagtgtggcgattcctcgaggaaag

SEQ ID NO: 26755 - DNA, 211 bp, Homo sapiens
agtttgagtaatttcagcggactctgggctggaggagtggaattagctagtcctgtgagggcagtctctcaaggatcaaggccccagatgccagagcatcaagaatatggaaaatcagagaacatgatcaatataccagctcatccctggatgaagctccctgcctttcctcatacagacaaaaaagtgcaatcctcaattttccggcccc

SEQ ID NO: 26756 - DNA, 90 bp, Homo sapiens
tcaagtaatttcactagtgcctcatttttaaactgctacttgttttagttttctttgttctctgtaatacagtcaggtagctggactttt

SEQ ID NO: 26757 - DNA, 466 bp, Homo sapiens
  misc_feature 9: k=g or t
  misc_feature 10: y=c or t
  misc_feature 425: r=a or g
  misc_feature 428: r=a or g
  misc_feature 458: y=c or t
gtcttgggkygttctagctctcaaagaacttcccgccaggactcagctggagcccctgcctactaaccttggatttatttttctacaagttccttcattcttaaaggggcaggaagtggctagctcaagagctctgaattttaggcctagatcgtgtcactagccacgtggggcacgtaagataaatcacaatttttggatccagcttattattgtaaaaaggaagaaactgggcttgactagaattgtccctaaggctgaagccctttagaagtcctaagcactgaaaattcaggtctgggccgaatcgttcaggctgaagaatatctattccaagcccagtggacagtcctcaaatcaactgactgtagtaatgccacccactctttactgcatcggaatctgggacttctctatatagctargaraaactatgaagaagccgttatcatctggcyaatgatat

SEQ ID NO: 26758 - DNA, 307 bp, Homo sapiens
  misc_feature 48: k=g or t
agaaaatactctggcagggatcctatcttgccctcctacaccccgcakaacaatcatcagggttaagaaagcctttcacatcttagtatattaataatttggatcagtctgctttcttctcagttgcccactgaaagggttgttaggtgctaactttgttttgtaaggaaaagaaggttgctgatttgcgggcatgatttattttcgagaaaggattgtttggttgttatgctttactggagttagggacttagcagtttgagtggactctgcatctgataagtgtagcagtaggtgataaagaatt

SEQ ID NO: 26759 - DNA, 215 bp, Homo sapiens
  misc_feature 126: r=a or g
caagataggctgatgtggtaataagccctggtcctgctccctaggaaataagagtccaggcattgtctttcaggatgtttttctggtatctggtcggatgttagcattttttcagtcaaaaactgrgagttgggaggagtgcgtggggcacaggagatctctttgatggctggctcctcggaaaacaataaatagcttttagagagaagggagct

SEQ ID NO: 26760 - DNA, 176 bp, Homo sapiens
  misc_feature 21: s=g or c
  misc_feature 22: k=g or t
  misc_feature 24: s=g or c
agcatagcaacagcagcgtaskasacatcttacggatggcccagggctccaaaggctcgtttcctaagtgagagagagcctggctgaagctgtattaccattcattctccagcctccgaagtctcaaagcatcacttccaccatactctaactgtcaagacaaacacaaaggccca

SEQ ID NO: 26761 - DNA, 394 bp, Homo sapiens
  misc_feature 245: k=g or t
ttgtctttgacttctgtctttcccttccacccacagttaaccaggaaatcctgccatctccgcctttattttattttattttttgagatggagtttcacccttgttgcccaggctgtagtacaatggcatgatctcggctcacggcaacctccacctcccgggttcaagcgattctcctgcctcagccttctgagtagctgggattacaggcacctgccaccacgcccagctaattttctttgtktgtttgtttgttttgagacagagtcttgctctgtcccccaggctggagggcagtggcacgatctcggctcactgcaacctctgccttgcaggttcaagctattcttctgcctcagcctccctagtagctgggactacaggcgtgtgcca

SEQ ID NO: 26762 - DNA, 333 bp, Homo sapiens
aacaacgcgctctgattctcttccaaataatgggaaggtttttccccccgtttttacagtaagttttgctgctaatcactttggattttcactgcatttatgagctgtgacattcactgtgaaggtttaaggttttgctgttgaagctggcaaaaccacaaaaccaccaagagaaactaacagttccacaggcactgtcttaagagctgtaacacccaccatgaaggtctgcagtttcactcctgagccagcgagaccatgaacccagcgcaaggaaaaaagtgcaagtacatccgaacttcagaacatcagaaagaagaaactctggacaag

SEQ ID NO: 26763 - DNA, 340 bp, Homo sapiens
  misc_feature 77: r=a or g
  misc_feature 112: r=a or g
tgcaggacaagttttgcttgtgagattttccctgtcaggcctcctaaatagttttctgcaacatccttagagaaggrattgagggggaaaaagtaggttttctgaaaaggaragagtgattgcaggtacacagatcactggggtcccaggtgttttgaggaagtcacaaagccccttcagaatctgtttaaagtcatagagcctcttcccagaaaaacacacatgccattttctacacttcttgggagttcaccacactcccgcatctgaggccaaactatggatcttccaggggttagagccccttcccctgtaggggttttcctgatgagttattttt

SEQ ID NO: 26764 - DNA, 116 bp, Homo sapiens
acactcatgattttacaggtctggggcccatggacccccttgaactggatgattaccatgaaaagatggtagcagagttaacacgaaagataggatttgacccagagccgcaaaag

SEQ ID NO: 26765 - DNA, 225 bp, Homo sapiens
ttaacgtctgtcattagcatggcacatttgttacaattaatgagccaatattgatacattattcactaaagcccacaggttgcgttaggggtcattcttggtggtgtacgttcttcaggtctggacaaatctataatgacatgcattcaccattactatatcacgcagagtcgtctcctggccctacaagtcccctcattccccacctgctcactcctccttccc

SEQ ID NO: 26766 - DNA, 430 bp, Homo sapiens
  misc_feature 46: s=g or c
  misc_feature 415: y=c or t
attttatcatctcatatcatcacaagtaaaagaagagtcttgctgstgctccctctttgggtccgcactgcctttatgagctgtaacagtcaccgcgaaggtctgcagcttcaatcctgaggccagcgagaccacgaacccaccaggaggaatgaacaactccggatgggaggaatgaacaactccggatgggaggaacgaacaactccagacgcgcgccgctttaagagctgtaacattcactgcgaaggtctgcagcttcactcctgaagccagcgagaccatgaacccaccagaaggaagaaactccgaacacgtccgaacatcagaaggaacaaactccaggaactggtgggaggtgactggatcacgggggtggttttccccatgttgttcttgtaatagtgagtgagtyctcacgagatctgtt

SEQ ID NO: 26767 - DNA, 230 bp, Homo sapiens
  misc_feature 67: s=g or c
agacaggagactgaagctcggaaatgttaacaggctctacccacctgcaagctcccgtttccatcascgctgcctcggagatagctccagaatttctttgcatgggaggagcctagggaagggccacgcttttggaatggaaacgtcatgggcttgttttgctcatttcagtgggaatcccatggcactgccgagagtatttctttttattttatttattttgggaggtc

SEQ ID NO: 26768 - DNA, 244 bp, Homo sapiens
catttatagttatcattcattatgtttagcagtcatagaccttaaattgagaagggcctttaggaagttaccgttccattttaaagcagataaaagagataattagtggcaccaatgaagggtagacaagcatattgggtacccgataccttctataaaagggagtaatatagaatcgactttatcctatgaggggaaaggcctagctgtagttagtaaaaatattactctggactaatcatgc

SEQ ID NO: 26769 - DNA, 326 bp, Homo sapiens
  misc_feature 120: m=a or c
  misc_feature 121: m=a or c
  misc_feature 137: d=a or g or t
  misc_feature 321: r=a or g
agttagggtcgcactcatcacggggcccccattgcctctggcgcaccccacgactgacatctgcggggccttcgcgctaggcttcgagtttcagcttccgcaccaggcctgcctttctgmmggggccagggtggggdtcgtgtgctgattgggccctctgaaccgccaccgctgcagaggggctgttccttccgtcacatcccttgtgcccgaatccaccctgtgtcttctcttttctcagcaggacattttaaaagcccagaccccctccttacagagcaaatgtccaggcttcggaggtcactgtcacatcccaagaarccccc

SEQ ID NO: 26770 - DNA, 129 bp, Homo sapiens
  misc_feature 73: r=a or g
  misc_feature 122: w=a or t
  misc_feature 123: m=a or c
gtgactccgggggctccgcccgtagccttggcccagtcttggggtccaaggctgagggagcgggacggaagtragcgggtcccgccccttccccttctcgtctccgttggagtcgtctctgwmgcggcg

SEQ ID NO: 26771 - DNA, 173 bp, Homo sapiens
tcactcttgtttattccaactctcctcacccccaccaccaagagaaaacctggaaattcatcaacagaggacagactaaagtaggagtcttcatatgatgaactgctagagactcatttaaaaaacgataatacaaacctgtatttactgaccaggaaagacatccatgaccc

SEQ ID NO: 26772 - DNA, 309 bp, Homo sapiens
  misc_feature 14: m=a or c
  misc_feature 21: y=c or t
  misc_feature 68: r=a or g
  misc_feature 82: v=a or c or g
  misc_feature 120: k=g or t
  misc_feature 149: s=g or c
  misc_feature 160: k=g or t
  misc_feature 161: s=g or c
  misc_feature 188: k=g or t
  misc_feature 253: s=g or c
  misc_feature 262: s=g or c
  misc_feature 263: r=a or g
aaggatggtgtggmgtgtgtygctgcagggaaggcttcccagtggaggtggctcctgagctctaggaraagggaagtgagtvtccttccaggcagagggaacagcaggtgcaaaggcctkggggctcgtctataaggcccgctggagtsacaagccccaksccagactctccaacgctggacctgcakcgcccagccctgccctggtgctaccacctgccagctctgtgcctgcccctccactagatcatgasttcggctcsrgctccctcactctccatgcctctcacttgcgggttgtgccccgttg

SEQ ID NO: 26773 - DNA, 230 bp, Homo sapiens
cgagtagctgggattataggcgtgcaccaccacactcggcttatttttgtattttgagtggagacggggtttcaccatgttggccgggctggtctcgaactcctgacctcaggtgatccaccctcctcggcctcccaaaatgctggaattataggcatgagccaccatgcctggcctatatcattttacttaacagctgtatttagtcttccatgatgtgacaccccact

SEQ ID NO: 26774 - DNA, 225 bp, Homo sapiens
  misc_feature 26: d=a or g or t
  misc_feature 118: m=a or c
  misc_feature 120: v=a or c or g
  misc_feature 122: n=a, g, c or t
  misc_feature 138: r=a or g
ctaaaagaagaaaactgatggctaadtttgcatgaaaactgcactttattgcaagttagtgtttctagcattatcccatccctttgagccattcaggggtacttgtgcatttaaaaamcvancacaaaaagatgtaartacttaacactcaaatattaacattttaggtttctcttgcagatatgagagatagcacagatggaccaaaggttatgcacaggtgcc

SEQ ID NO: 26775 - DNA, 162 bp, Homo sapiens
  misc_feature 107: r=a or g
  misc_feature 124: k=g or t
  misc_feature 129: k=g or t
aggagcggttatccattgaaaaggaggttaggaatcaggtcttgggctgtcaacaagagccgcatgctgtgctgtagatgactaaatgatatactaaactaacatgratttgccaatgaaatgkctcakcatttggcaacagaggtaacaaaatgaaaggca

SEQ ID NO: 26776 - DNA, 204 bp, Homo sapiens
  misc_feature 4: s=g or c
  misc_feature 11: m=a or c
  misc_feature 71: w=a or t
  misc_feature 73: n=a, g, c or t
  misc_feature 97: r=a or g
  misc_feature 106: w=a or t
  misc_feature 129: r=a or g
  misc_feature 130: w=a or t
  misc_feature 134: k=g or t
  misc_feature 166: w=a or t
  misc_feature 190: r=a or g
aatsaataagmcctactgtttgatagcacaatagggtgactatagtcaatggtaacttaattatatatttwanaataacatagagaatgtaattggrttgtttgtwacttaaaggataaatgcttgagrwgatkggacacctcattcttcatgatgtgcttatttwacattgcatgtctgtatcaaaacrtctaatgtacccca

SEQ ID NO: 26777 - DNA, 170 bp, Homo sapiens
  misc_feature 2: h=a or c or t
  misc_feature 4: y=c or t
  misc_feature 8: m=a or c
  misc_feature 55: r=a or g
  misc_feature 79: w=a or t
  misc_feature 103: w=a or t
  misc_feature 152: w=a or t
  misc_feature 167: h=a or c or t
  misc_feature 168: m=a or c
thtytgtmtatctttggacttgcactattttccatttctcattggatttggagartaaagagaattgtcacagctgtcwttctccatccccagttgcagtagwacgtctcataataggtgagaaatgtaaactctcttatctaattagtctwttgagttttggtgthmcc

SEQ ID NO: 26778 - DNA, 178 bp, Homo sapiens
  misc_feature 9: r=a or g
  misc_feature 12: b=c or g or t
  misc_feature 20: y=c or t
  misc_feature 21: y=c or t
  misc_feature 25: y=c or t
  misc_feature 43: s=g or c
  misc_feature 45: b=c or g or t
  misc_feature 65: m=a or c
  misc_feature 86: s=g or c
  misc_feature 107: s=g or c
  misc_feature 108: m=a or c
  misc_feature 127: w=a or t
  misc_feature 128: r=a or g
  misc_feature 154: m=a or c
  misc_feature 158: s=g or c
  misc_feature 175: s=g or c
tcactgcarccbccgcttcyygggytcaagtgattctcctgcstbagcctcctgagtagctgggmttacaggcacgtgccatcatscctggctaattttttttgtasmgatggggtttctccacgtwrgtcaggctggtctccaactcctgacmtcasgtgatctgcccacctcsacc

SEQ ID NO: 26779 - DNA, 161 bp, Homo sapiens
  misc_feature 13: w=a or t
  misc_feature 21: y=c or t
taaaatctactcwcagcaatyttcaagtatatatcacgttgctgttaactctagtcatctatgttgtgcaattgatctcttgaatttattcttcctgtctaactgaagcattgaccctgtgaccaacatctccctagtcctccacctctgccagccccggt

SEQ ID NO: 26780 - DNA, 172 bp, Homo sapiens
cataattgcaaaacaaatctgtgactaacttaatgtcttcagatctaaagggtgtaaaaatattgatacttcaatatttcacttgctgccaggaaaaacaaaattctcaatcttttgtaaatgggaggaggacttttgcatacatttttactctttaaataacgacaacgac

SEQ ID NO: 26781 - DNA, 99 bp, Homo sapiens
aggccaccgatgctggacacacatgctggacaatggctctgcggtttccacaaacatgacccccaaggcccttctgaccatctccatcccaccaggccc

SEQ ID NO: 26782 - DNA, 224 bp, Homo sapiens
  misc_feature 133: k=g or t
tctcttggcgtctcaacgttcggatcagcagcttttttccattctctctctccacttcttcagtgagcagccatgagttggactgtgcctgttgtgcgggccagccagagagtgagctcggtgggagcgaatktcctatgcctggggatggccctgtgtccgcgtcaagcaacgcgcatcccgctcaacggcacctggctcttcacccccgtgagcaagatggc

SEQ ID NO: 26783 - DNA, 197 bp, Homo sapiens
ttctttatatccttattctataagtttttatctatttccttatttatttggtttttgagctaggatctcactctgttgcccaggctggagtgcaatggcatgatcacagctcatagaagccttgacttcctgggctcaagcaattctcctgcctcagcctctgcagtagctggaactacaggcatatgccaccactc

SEQ ID NO: 26784 - DNA, 152 bp, Homo sapiens
  misc_feature 150: h=a or c or t
tagattttcactggtaatacacattgccaagttttatgggaaatctgaatatactgtgaaaatgcatatctggttagttgtctgctgcccagatcttatcaataccagtaactaaccagtatttaacataaaatgatacaaataaaggchga

SEQ ID NO: 26785 - DNA, 474 bp, Homo sapiens
  misc_feature 367: v=a or c or g
  misc_feature 372: n=a, g, c or t
atacaaagtagattgttggcaaagtctgtgaggactttcagtgctatacttaaaacaatcatattgctaaagaaatatgtataggtactgttgaaatacaaaataattctatattcaagtaacttaaactcttcataggaatataagtttaaaaaattttagcccgggcaacatggtgaaaccccatctctacagaaaatacaaaaattagccgggcatggtggtatgtgtctgtgatcccagctactcaggacgctgaggggtgggagtatggcttgagcccgggagactggagtgcagtggcgcaatctcagctcactgcaacctctgcctcccaggttcaagcgattctcctgcctcagcctcvtgagntagctgggattacaggtgcccaccaccattcccaggtaatttttgtatttttagtagagacagggtttcaccgtgttggccaggctgatctcaatctcttga

SEQ ID NO: 26786 - DNA, 245 bp, Homo sapiens
ctaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcgggct

SEQ ID NO: 26787 - DNA, 326 bp, Homo sapiens
tttttagagcagttttaggttcacagcaaaattgagaggaaggtacggagattttttttatatactccctgccccaacacatgcagagcctctcccacattaccagcatccccatcagagtggtgcatttgctagcatcgatgaacttacactgatgcatcattgtcatccagagtccgtagtttgcataggggtttgctcttgttgatgtactttttaatgggtttggacaaatgtgtaatagcttgtgtccattatagtattcacagcattgccactgtcctaaaaattctctgtggggttatttaaatttaagataacatttt

SEQ ID NO: 26788 - DNA, 220 bp, Homo sapiens
aaatgggatagacggtattacagcacatactccctcaaccttctccaggagatggagctcactcagcaggcaggacctcagggctatgggagagcaactgcactgtgcaagcacagccaacaggaagtgaatgcaaacacattctcctcaacataaacacacacagacttcacctatggctgaacttctgcccttgggtgaccaacaccattaggacgcg

SEQ ID NO: 26789 - DNA, 315 bp, Homo sapiens
  misc_feature 314: k=g or t
  misc_feature 315: n=a, g, c or t
cacctcataattgtgatatagagcatttctatcacccagaaactccctctaaaccctttgcagccgagacaggaagattacttgaggctaggagctggagaccagtatgggcaacatatcaagaccccatgtctacaaaaaattaaaatttaataataataaaatatttaaaaagtataaataaaattcagcttacaaaccttgtttgaaaatctagattttagcaaatgcttctaaggggctttttacaactttatatcttcaaacgtaaatgaataggtttgattttctttttcagtatctcagtgtggaakn

SEQ ID NO: 26790 - DNA, 192 bp, Homo sapiens
  misc_feature 58: n=a, g, c or t
aaaatacctctccatgaatttattcctattttcatcacatatgttaaatgcaaatatntattgacgactgttcatccacacatacaaggatatgagtacacgcatacatgcgtgtacatgtgtgtatactcacacatattcgcaacatccttttctcacacagttagttaataacatccatttagagtggac

SEQ ID NO: 26791 - DNA, 246 bp, Homo sapiens
  misc_feature 233: n=a, g, c or t
tgcctggaccaagctactccagatcatctgaccaactcttaaaaatcacggccaggccagtggctcatgcctgtaatcccagcactttgggaagcagaggtggcaggatcattccagcccaggagttcaagaccagcctgggcaacacagcctcctcccaaggagaacatgagaccacttcatatctggaactctagaaacactggctgcagcaatcaacctcctgtgccaangctggcccctatg

SEQ ID NO: 26792 - DNA, 270 bp, Homo sapiens
agactagaattgcagtcaaaaatgaaaagaaatagttgtgccaactgcaaagtccccggagggaaatactgatcatatcctgagaaaaaactgatgccccataccaaaggcatggcaggaacccaggctagttttgatgttttagtgctagatgactcttctcagtaggcggtgagcccacctggttagacttacattgctgccacagaaatttaactcttaattcttccaaggattatttttttgtttttgtggttttttttttttttt

SEQ ID NO: 26793 - DNA, 264 bp, Homo sapiens
ccaaaatgtaagcaccataaagacgaggacttcattcagttcagtgctatattcccagtgcataaagcatggcctggcacataacaggtactcaccaggtctttgtcatataaatgaaagggaacgactgagtctccatatacatttgatccatgaacaacatgggtttgaactgcatggacccgcctctatgcagatttttttcaataaatatattggaaaaattgtttggagatttgcaacaatttgagaaaacttgcaggc

SEQ ID NO: 26794 - DNA, 335 bp, Homo sapiens
tctagtactttcagtttcattttttacaatttaaacttttaatctattatagatacagaaactcatagtaaaaaactaagctacctatacttagataacatggccttagaacagatgtggagatggtcttctctaactaaagtaaccatcagtcacagattgtctaggaccatcccaattttaaggatgtagtacagttgtcctcagattattgaaatattacaggaatttctacactgacatctacattacatcagactgactttttaaactattagaggcacagaaatcttttatcaaaatatgcatttaattcagctttagaaaggggccat

SEQ ID NO: 26795 - DNA, 405 bp, Homo sapiens
agaggggcgagcaggagcgattccgtcgccaaacagagctggggtcttgctgtgttgcccaggctggtgtcgaactactgcacccaagccatcctccctccttgtccttcaaaagcattgggattgtaggcatgagctaccgtgcctggccgatacttcattcttttttatgactgaatactatttcattgtgtggataccgcattttcttgattcattcatccattgacaaacatttgggttgtttccaccttttggctgttatgaataagtactgcagtcagcatttgcatacaagtttttgggtggatatatgtttttgcttctcttggttgtgtatacctccaagtagaattactgtgctatatgctagcaccatgtttaattgtttaaagaactggtagc

SEQ ID NO: 26796 - DNA, 186 bp, Homo sapiens
  misc_feature 12: m=a or c
  misc_feature 13: y=c or t
  misc_feature 87: m=a or c
ctacaggcacamyagacaaatataataacttatattgtggtataaatgaagtgctcattatgttcagaaaagtgtcagtaactaggmtcagtagcaactgatgtgaaaaagacatgaaagaagaaaaagacatttttgattagatgttggtaacaagcagtgtaacagttcttatactttggtagc

SEQ ID NO: 26797 - DNA, 381 bp, Homo sapiens
  misc_feature 253: w=a or t
  misc_feature 254: s=g or c
  misc_feature 270: w=a or t
  misc_feature 271: n=a, g, c or t
tgtgcatttttttctactggctgtttctttagtatatgtagaatcaaattactttacattaaatttgagggaaattttatgtatttttatgatacattgtgagtcagtggcttatttccacttagtggtcatgaaatgatagcaagttagacttactgtttcagtctcctcacttatacactccccccttcctcattgcacatggtgaaaatgaaacatagagaaattaaatgttgcacctcagttcattctwstttagagacagtgccwngagaagtacatagttacatctcagcctgtaggccctgtccctcatttgtctttttactgtttactttacattttgaaagaaattagagaaaaatcatttatatgggaaaa

SEQ ID NO: 26798 - DNA, 348 bp, Homo sapiens
  misc_feature 52: k=g or t
  misc_feature 53: y=c or t
gcattttaggagacactttctgttgtggctgatatcagaattggagacgcakyttgctctgtcaccaggctggagtacagtggcgtgatcttggcacactgcaacctctgccctccgggttctagcgattctcctgcctcagcctcccgagtagctgagactacagaaaagtaaaaatgctgaagaagaccaagtttgaattgggaaatctcatggagcttcatggcgaaggtagcagttctggaaaagctactggagaagagacaggttctaaagttgaatgagctgatggatatgaaccaccagtccaagagtgtgtttaacactcagacatttaaaatggcagac

SEQ ID NO: 26799 - DNA, 221 bp, Homo sapiens
  misc_feature 19: v=a or c or g
  misc_feature 26: k=g or t
  misc_feature 52: v=a or c or g
  misc_feature 110: r=a or g
  misc_feature 113: y=c or t
  misc_feature 121: s=g or c
  misc_feature 122: s=g or c
  misc_feature 136: m=a or c
  misc_feature 137: k=g or t
  misc_feature 138: s=g or c
  misc_feature 160: s=g or c
  misc_feature 198: k=g or t
ttgcagggtcagttaaaavaattttktttgagttataaggttcttttttaavaacagtatcttgctgtcacctaccctggagtgcaatagcacaatcctaatgaactgcrgcyttaaactsstgagttggagatcmksccacctcagcctttcggttgcsaagactacaggcacatcaccacgcctggctcatttgakaaatatttttctgtagacgtggg

SEQ ID NO: 26800 - DNA, 136 bp, Homo sapiens
  misc_feature 2: m=a or c
  misc_feature 19: m=a or c
tmtgaacttatattttttmgagtcggggtctcagtgtttcacccagactggagtgcagtggcatgttcatagctcactgtagcttcaagctcccaggctcaagtgatcctcccttgatcctacctcagcgcccctg

SEQ ID NO: 26801 - DNA, 165 bp, Homo sapiens
  misc_feature 115: m=a or c
  misc_feature 141: d=a or g or t
aacagggacagtgggccagcaggaagcagcaggtccctcctccctctgccagcctttcagtcttcctttagctgattctaatgacggagcctaataacctagcctggtgaaaggmgaaatacgacattgcagattcctgcdgcaaaacagatgatgaaggggacg

SEQ ID NO: 26802 - DNA, 230 bp, Homo sapiens
  misc_feature 3: r=a or g
  misc_feature 135: d=a or g or t
  misc_feature 136: d=a or g or t
ctrttattatccctttgaataaactttctaccccatctctttttctacctcctcgttaaggtcaataacagatttgctcttttgagactattttctagatcctgtagttgtgcttcatttatttaaaattctttddtcttttgtctcctctgactgtattttcaaataccctgtcttcaagctcactaatcctttcttcttcatcatccattctgctattaagggactcg

SEQ ID NO: 26803 - DNA, 205 bp, Homo sapiens
  misc_feature 150: b=c or g or t
cttaatttttaaaacctaatctgtacaacataacttgaattattattatttctttttgagataggagtcttgctctgttggccaggctggagtgcagtggtgtggtctctgctcattgcggcctttaccttccgggttccagtgatcgtbctccctcagcctctcgagtggctgggattgcatgcgtgtgccaccatgcccagaa

SEQ ID NO: 26804 - DNA, 155 bp, Homo sapiens
caacttttattttaaattcccgggtacgtgtgcaggtttgttacataggtaaatgtgtgccatggtggtttgctgcacagatcaacccatcacctaggtattaagcccagcatccattagctattcttcctgatactctctctccctctgccccc

SEQ ID NO: 26805 - DNA, 98 bp, Homo sapiens
  misc_feature 83: d=a or g or t
  misc_feature 84: m=a or c
acttcagtttccgtccaaggtccgcctcctacctccttctgcttcggtgcgtttgcttctgaggatctccagtgtcacaacadmcacatgccagccct

SEQ ID NO: 26806 - DNA, 167 bp, Homo sapiens
  misc_feature 12: y=c or t
  misc_feature 159: v=a or c or g
tagtataattaytctatcaatggatacatttttagtaaatgtgcattgtcacaatcctgggcacaaagtgcctgatgtcaaaatgaagatagtaaaacaagggaggaagcagtggatggaccaggattaattcctttcatttcttagtaaattaaaacvtgcagccg

SEQ ID NO: 26807 - DNA, 147 bp, Homo sapiens
cagaatctttatgtaggtgactctagatcatggttatttattttcattttctcagatattaaagcatattttccttctgagttttgaatggtaagggtaaggctattcaccgcatactatcatccaaatagaagtggatgtgcaacc

SEQ ID NO: 26808 - DNA, 99 bp, Homo sapiens
atacctaatgtagatgacaggttgatgggtctgacaaaccaccatgacacgtgtatacctatgtaatgcaactgcacattttgctcatgtaccccagtt

SEQ ID NO: 26809 - DNA, 66 bp, Homo sapiens
  misc_feature 66: k=g or t
atcccgcccccacccccaacctcagcctcaagtatgtaacaccatgcctggctaatttttgatttk

SEQ ID NO: 26810 - DNA, 188 bp, Homo sapiens
ttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaggggacacatttggcacttttttttttt

SEQ ID NO: 26811 - DNA, 171 bp, Homo sapiens
ttatgtatgttttgcctttttgtgctaaatgtaaacaccacaaggggaggtatctttgtctgttgacaatgatacattcaatgtttctcaagcacccccaatgctggtttgtatgtggttatcattcaatctgtatttgttgaatgaataaatgattgactatgtggagag

SEQ ID NO: 26812 - DNA, 221 bp, Homo sapiens
ttgcagggtcagttaaaaaaattttttttgagttataaggttcttttttaaaaacagtatcttgctgtcacctaccctggagtgcaatagcacaatcctaatgaactgcagccttaaactcctgagttggagatcctcccacctcagcctttcggttgccaagactacaggcacatcaccacgcctggctcatttgagaaatatttttctgtagacgtggg

SEQ ID NO: 26813 - DNA, 149 bp, Homo sapiens
aagttccccacccctctgcgcccctttgtcaccagagaagtcttggtggaaacgtatgaagagagtgtgcctgtgtccagttaccagcaggcaggaattcccgtggacttgaaaaggaagattgcacggctggggatcaacatgctcct

SEQ ID NO: 26814 - DNA, 166 bp, Homo sapiens
gaggggtaagaataaagtggctgctcagaattgcagaaaaagaaaactggaaaatatagtagaactagagcaagatttagatcatttgaaagatgaaaaagaaaaattgctcaaagaaaaaggagatgacaaaagccttcacctactgaaaaaacaactcagcaag

SEQ ID NO: 26815 - DNA, 488 bp, Homo sapiens
  misc_feature 329: n=a, g, c or t
  misc_feature 330: r=a or g
atttttaaaagcaacttctgagaagggcttagaacaaattttttcccggagtgccatttcccaaaggtactcacagaacaatcaggtgtgaccataatggctgcactgagttgtctcttggacagtcagaagggacataaagaaggtggacagagaactaaggcaactgagatgcatcgacgaatttagcacacggtgcctgtgcgacttgtatatgcacccctattgctgctgtgacttgcacccatatccgtactgcttgtgctattccaagcgatcacgctcttgcggcctgtgtgatctctacccatgttgcctgtgtgattaanrgctttactgtctgcgaccatctctcagaagtttggagaggaaagccatcagagcatagaagatgagaagcgagagcttgccaaactgagaagaacaacaaatagaattctggcttctcctgctgtagcagtaacattttaggatcggtgaatgtatgc

SEQ ID NO: 26816 - DNA, 78 bp, Homo sapiens
ctatggaatctcaatttgattaaaatattgaatagggataaaccaggtagatttctggttttttttttgttttttttt

SEQ ID NO: 26817 - DNA, 496 bp, Homo sapiens
  misc_feature 134: r=a or g
agatgctttccaactaacagggaccaaatgggaccgttctaagatatcctaaaaaatttgggagttaggggaggtaaactaagataattatattacaaagggtacaagaccacaagacaacaaccgactccggrattcttggacctccgccttccgtacaagatggagtcttgctctgtcacccaggccggagtacagtggcacaatctcagctcactgcaacctctgcctcccaggttcaagtgattctcctgctgcctcctgagtagttgcgatcacaggcgtgagccactacgccaggataatttttgtatttttactacagacggggtttcaccatgttggccaggctggtctcgaactcctgacctcaggtgatccacccgcctcggcctcccaaggtgctgggattacaggcatgagccaccatgcccagccaaattcttgctggagaaatgaagtcagaaatgcaagattgatcagacaacaatccaga

SEQ ID NO: 26818 - DNA, 341 bp, Homo sapiens
ccgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgaga

SEQ ID NO: 26819 - DNA, 108 bp, Homo sapiens
caggcatagatctagccccaccatcaagacaaacaacattttctattatgttaaaaagtgtccttgtaagcctttgcagttggtctcctcccctgacttccagcccca

SEQ ID NO: 26820 - DNA, 300 bp, Homo sapiens
  misc_feature 287: r=a or g
ttatttaaattggagatgtaggaaggttaagttgatgagtttctaaattggaagtactttgttaaaatggatcatggtgggggtttaggttgggtaaagaggtaaaattactatatactgaagcactgggcaaagataagggactttatctgaatataaagagctattagcagatttcagaatctaggatcttgaagagctaaattaagtgcttatagatgagtctgtgagtctcaacagagggtgaaataagatgtatgaaaatcccctcggagactttcttcgartgatacaggcgtg

SEQ ID NO: 26821 - DNA, 209 bp, Homo sapiens
  misc_feature 48: m=a or c
  misc_feature 49: y=c or t
  misc_feature 149: s=g or c
cttcttttgttttctgagacctggtaacccacgctcttgcattgtggmytttaaaatgtatactctgtacggttctgtaaaccgaaaaacttttgtaaatatataaatatacatagacataaaaatactgtatgtgacagcacatagastagttttcccacaccaaagttaatttttatgcatgctttaaaagtatatatcgggactgc

SEQ ID NO: 26822 - DNA, 259 bp, Homo sapiens
  misc_feature 14: r=a or g
  misc_feature 182: w=a or t
acttgggacaagaratcaaactttaaagatggtctaaagcccctcttaaaggtctgactgtgtcggacctctagagctaatctcactagatgtgagccattgtttatattctagccatcctttcatttcattctagaagaccccatgcaagttccccacctaagggtctggacacaggtgawagataccttcattggttatagaaatttgggatttacaagtatgtgcatattgttccactgtcttcttagctttcaga

SEQ ID NO: 26823 - DNA, 392 bp, Homo sapiens
  misc_feature 386: m=a or c
acacatttgaagagctgtgtgagagaccacttggagccagtgactatttggaactatcaaagaattttgatacaatatttttacgaaacattccgcaatttactctggcaaacaggacaggtcgaggattcataactctcatcgataacttttatgatctcaaggtgcgtataatttgctctgcgtcgactcctatatcaagcttatttttgcatcaacatcatgacagtgagttggagcaaagcagaatactgatggatgatttggggctgagccaggattcagcagaaggactctccatgtttaccggagaagagggaatctttgcatttcagcgcacaatttcccgactcacggaaatgcagactgaacagtactggaatgamggaaac

SEQ ID NO: 26824 - DNA, 458 bp, Homo sapiens
  misc_feature 114: r=a or g
  misc_feature 144: r=a or g
aacaggggaagaattaggaaagaggacacgcaagaccacagtaagagatggaaataagagaatattcctgatttccactggatgactttgactggtatgatttcattctctgaragtgttaaccagggtgcagcatggccagaraccattccgagcctcatgaagtgggcaagtcaggtttggtcatttttggtattcctgtaagctgtgagctcatccacaggtggcctggaaattctcactcctaaggcacaagggaacctctctcttgcccactgggtcctcagtagcttgaacacagacctgtggcttctctccctgtgtcctcctctgcatccttgacatcacccttctctggagggcccggactttcagagtctactggaagctctcatatgactggggaatctatcactgggttctcacatggatttggggtaatgtcattgcatgtcaca

SEQ ID NO: 26825 - DNA, 353 bp, Homo sapiens
  misc_feature 12: v=a or c or g
  misc_feature 13: m=a or c
  misc_feature 242: m=a or c
  misc_feature 329: m=a or c
cagttagttcavmatccatcatctttcactagacctcattgccagtttagaggtactagagaagtttgcttcaagggaacaagagttctcttccttaggcccatatctctcaggatattgcctccctaaacagaagagcttgcaacacaggacttgtgtaagctctcagcaatcagtaatgtggaaactaatcttgtcaaggagatgaccagttacaggatccttagtttaagaaaatctamatggccttgggcttactcttacccaaatctagtcttttctacttcttccatcctgcctgtctagacccttaagttagacccccagamcctcattggactctccccaccctt

SEQ ID NO: 26826 - DNA, 199 bp, Homo sapiens
cagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggccttt

SEQ ID NO: 26827 - DNA, 447 bp, Homo sapiens
  misc_feature 386: r=a or g
cattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgcgatggctgggtcaaatggcatttctagttctagatccctgaggaatcgccacactgacttccacaatggttgarctagtttacagtcccaccaacagtgtaaaagtgttcctaatttctccacatcctctccaga

SEQ ID NO: 26828 - DNA, 363 bp, Homo sapiens
  misc_feature 12: s=g or c
agagcttttggsaagctatacgttcctggccccgaggtaaagctcccacaggctgcttgacccaacagagcagctcctacccactgggattctcggtctgcaggaatctggcatccacctgggaatctcagcctctcccctaaaccagaacagactcacagagtgacccagtggaaggggcctcagaagacatccagttgagtctcttccgtcactgaacagatgaggaaactgaggctcaaagggaaacgtccccatggcagggagcatctggctgaggcagcctggagacaggcacgcaccagaagacttctggttccatccaggcccaaggaccactgaactggagcggtcttctccatc

SEQ ID NO: 26829 - DNA, 423 bp, Homo sapiens
cggtgtttttttaaatttgaaattaatttctaacttgattatattgtggtctgagaatgtggtatgtgcgatgctgatttttctgagatttgttgagacttgctttatggcttagtatgtgagcagcctctgtaaacacgccaagtgtgcttgagaaaaatgttggttttgatgaacattcttgataattggttcggagacttttatatttctattaaatcaaggttgtagattaggttgttcaagtcttctgtgtcttttctaatgtgcgctgcctcatctgtcagtattcgaagaagacatgttgaaacctccctccagcatctttgttggcctgtggaggggtggggcatggctgacctcagcattcttcaggcaatcctttccttgatgttagtggcactctagcttttgctcactgta

SEQ ID NO: 26830 - DNA, 303 bp, Homo sapiens
  misc_feature 23: s=g or c
  misc_feature 25: m=a or c
  misc_feature 31: r=a or g
  misc_feature 44: w=a or t
  misc_feature 45: w=a or t
  misc_feature 191: r=a or g
catttctaaaggccgtcttgaasamaattaraccagaaagatcwwgaaaggctggagtgcaatggtgtgatcttggctcactgcaacctccaactaccaggttcaagcaattctcctgcctcagcctcccgaatagctgggactacaagcgcatgccaccatgccaggctaatttttgaatttttagtagrcacacggtttcgccttattggccaggctggtctcaaactcctcacctcgggacatccactcggcttggcctccctaaatgctgggattacaagcataagccactgcgctgtc

SEQ ID NO: 26831 - DNA, 338 bp, Homo sapiens
  misc_feature 11: v=a or c or g
  misc_feature 12: y=c or t
  misc_feature 132: y=c or t
  misc_feature 242: y=c or t
  misc_feature 302: y=c or t
  misc_feature 303: y=c or t
  misc_feature 315: y=c or t
  misc_feature 332: k=g or t
cgcccagctavytttttatatttttagtagagacggggtttcactatgttggccaggctgatctcgaactcctgacctcgtgatctgcccacctcggcctcccaaagtgctgggattacaggcgtgagcaaycgcgcccggccagtggtttttaattttgaggaatttcttttttctttatggtggatatcttttgtgttcaactctttgccagccttacagtcttgaggctttctcctgtyataaagtctttgtaattttagtttagatcacatttaagtgatcctaggtctagtttttgyygtggtatgagtyagagatcatggtttgaktttttt

SEQ ID NO: 26832 - DNA, 191 bp, Homo sapiens
gtggtagcaggaactaattccccctcgggtcacccgggacctggagctggaaatttcacggatcagggttccctaagacccttggaagaggggacgatcgccccaagttagaaatccttctgccagctcataagcgtggttcaatttaaactagggttttggccccttgaccccaaccaagccccgcccca

SEQ ID NO: 26833 - DNA, 65 bp, Homo sapiens
catgttgttatatgatatgtaatattgatattcgtcatttcactgaaaatttttttttttttttt

SEQ ID NO: 26834 - DNA, 319 bp, Homo sapiens
  misc_feature 223: r=a or g
  misc_feature 235: m=a or c
  misc_feature 236: s=g or c
  misc_feature 284: w=a or t
  misc_feature 305: r=a or g
gtcacactgcaaactctgggcctggggtcccatgggacttcagtggttccaggactgatttcactgccatcacttatatatgatgatgcagacttcaagcatcaaagtacacaaactgaagaaactttatcctttgtatataattatcttaaatatatgccatcatttcaaggggagcttatgctaagtgtgacttcataaacaaatcatttgtgaaagagaraaaccacatccmsggtaaagtcataaggtgaaaaagcctatttcagagagcacttcctgawagagacaaagcagcaattaargtcagcccagcacc

SEQ ID NO: 26835 - DNA, 236 bp, Homo sapiens
ctaggaaacttctgtcaatttcttaaaaatctaaaactacctatggaatacacaaaactcctaatacatttcttttaaagccaagttctctctttctatgttattgtgtattgaatgagttcttttcagctctctccaggttgtttaaatataagtacaaatgacttcagtcaagaaggtaaagtcattattagtatatagaaaaatgaatctaaaaatatgtagtcgtgcccgca

SEQ ID NO: 26836 - DNA, 207 bp, Homo sapiens
cgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccagag

SEQ ID NO: 26837 - DNA, 215 bp, Homo sapiens
agaggaagaggaggaggaggaaagcaagccccccatcccgacacaggtggggcccgccaccgcctcccctgacctaggcaccagcatggccactggtacccctgactccacagcgcccatcaccatctggcgctctgagagccccacagggaagggtcagggcagcaaggtgatcaagaaggtaaagaagaaaaaggaaaaagagaaagacaagg

SEQ ID NO: 26838 - DNA, 359 bp, Homo sapiens
tcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggccttga

SEQ ID NO: 26839 - DNA, 261 bp, Homo sapiens
cattgatttttattcagacttttccacctttggaagggatattagatagcactctgatagcccagcaaagttaactctttactgtacaacgcagcactctacttcttaaaatctgtgcatgttgctgaatatgtatttagttttttgctcctaactactgcatgatatttcacaaaatcatatctcatgttttactttttcagttctgggaagtcattactgatctttgaaaggacaatttcaatttcaataagcgcccat

SEQ ID NO: 26840 - DNA, 356 bp, Homo sapiens
aaaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagat

SEQ ID NO: 26841 - DNA, 158 bp, Homo sapiens
atttttggaacctaggccatgggacaaaatctgggctggcctgctgaatgatgacagaggagtggccaagtcactcattgttgtcccatttgtcaaccagccagccaccagacatgtgctaagaagaaaataaacagagaacgtcttgcagtgggcca

SEQ ID NO: 26842 - DNA, 63 bp, Homo sapiens
caagcatgagccaccacacccagtcttaagcaagacctagctttttttttttttttttttttt

SEQ ID NO: 26843 - DNA, 273 bp, Homo sapiens
  misc_feature 33: s=g or c
  misc_feature 96: s=g or c
  misc_feature 117: s=g or c
  misc_feature 168: s=g or c
  misc_feature 187: s=g or c
  misc_feature 190: s=g or c
  misc_feature 200: s=g or c
  misc_feature 222: s=g or c
  misc_feature 228: k=g or t
  misc_feature 232: s=g or c
  misc_feature 242: y=c or t
  misc_feature 243: b=c or g or t
  misc_feature 249: k=g or t
  misc_feature 263: s=g or c
acaattacaccccaacatcacccagctacagcscgacatcacccagctattcacctactagtcccaactacacacctaccagccctaactacagcscaacctctccaagctactctscaacatcacccagctattccccgacctcaccaagttactccccttccagcscacgatacacaccacagtstcsaacctatacsccaagctcacccagctacagcsccagckcgcscagctacagybcaacckcacccaagtacacsccaaccagcg

SEQ ID NO: 26844 - DNA, 85 bp, Homo sapiens
ctgattcaaaatatgcattcccttccaccccacatgttgaagtaagctgtctttcaaaatgttcatttattagtcatttattttt

SEQ ID NO: 26845 - DNA, 441 bp, Homo sapiens
taactagagaaggatacactcaatgtctcccagtggagaactccagtttcccagcccagacacatggaagttccctctaatgtcacaccgcagtcagtctccagcccaggcctctgaaactctccattgctgcccgcacaggtgggctccaagtgcttcttttgaccttctcaatctcaaactctccttttcctcctcccgtatctgcccatcccagctgatgctcatgtctgttctcacctgcctgtttgagtctctgaaccacatgttaaggtgagtgaggttctctgccctccgaggccccatccccctggccctgatatgtcacaggacccttcctccctgtttttctcctgaagtccccacaagactaagataatccaaaaagaaaagttcacagtcgacacaatgaacgaaagtagggctgtgctatagcatcta

SEQ ID NO: 26846 - DNA, 458 bp, Homo sapiens
  misc_feature 183: k=g or t
  misc_feature 436: n=a, g, c or t
aaacaaactctggaacaaaccctgtctcatcatcatttaagccttcgttggacagactttctgactggcagctgaacataagctcattgatgtcttcacagtctccagctgaggcacaccttggccagagggaatcttccagtcctcagacagggcttgcctttgactggcccctgctgcttktgccctttgtgaatcacaagcggtacctcttagtgtactctgccttcactcctaaacgcatgtggcaggcatgtaatgctgctattaggcgcatgggctctggactcgaataggactgagttctaaccttggatccaccacttactcatgcagaggtctcaggtaagtgacttgagtttttccacagaccataaaatgagattgacactactccttaagtgactatattgcgttaaatgagaatatgtataanatgctcagcacagtattagcaa

SEQ ID NO: 26847 - DNA, 194 bp, Homo sapiens
cttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccc

SEQ ID NO: 26848 - DNA, 140 bp, Homo sapiens
atcactcaatctgctcaccaaaattctgaaacagccaagacggccccaagcccaaggaaaggcttcaacaacactgttctgtgaaaatgatgatggcaatgaattatgcattgttctctaaagtctggtaccacggccac

SEQ ID NO: 26849 - DNA, 417 bp, Homo sapiens
  misc_feature 272: s=g or c
  misc_feature 273: w=a or t
  misc_feature 310: w=a or t
  misc_feature 311: r=a or g
  misc_feature 312: n=a, g, c or t
  misc_feature 399: r=a or g
aatctgatgcagcacccacacagtggggggggcctatgagtcacctgccagagcacagctggaacatctggataccctcccaacattgacatggggcctggcatgtgcaggccgccttgggcactggagctatccaaagcacgtgccattggctttgccacctgccctagattttgcacaaggctctgtggactgaatgggaaggcacaccccgcgcctcacagattgtacgttatttctgggaaggatcacctgggtgtttactcattgtswggtggcttaagacaacataaataggtggaagacctcwrntcccctcttccagcccacagaagatgggaggcagagagaccccaagaaagagagaaagtgaggagaagagccaacccatctgtgaargtggatgacagatccaga

SEQ ID NO: 26850 - DNA, 51 bp, Homo sapiens
tagggtatatactcagaaatggtggtgctggatcatataggatttctattt

SEQ ID NO: 26851 - DNA, 339 bp, Homo sapiens
  misc_feature 302: m=a or c
atgctatgtctctggcatatccaggacagtcctgcccaaagaactctccaccccaaatgccagcagcatccctatcgaggaacctcaatgcctttagcctccggagtatgagggatgttgtcaacctgtagcgcactggaactgtgagaagggaggatggcctgcgcctcgtgaaccatggggtggcatcgttgctggtttgtcacacaaaacccatgttcagggtcatcttgggagaactgtaggagctctggacccacatggtgactgtgtcactcgtttgtgtgatgccttctgtccamtaggcctggactgaacgaggcttggtgatgcaccaca

SEQ ID NO: 26852 - DNA, 175 bp, Homo sapiens
  misc_feature 132: n=a, g, c or t
  misc_feature 133: n=a, g, c or t
  misc_feature 157: r=a or g
  misc_feature 158: r=a or g
ggcaaaccgcagtccctgccccgcgggcttcctttactttttgggagtggggggcggtttccctgctttttccaccacagcccctcctcccgccgcaatgtggctgatgctcataaaaagttgtattaaagnnctgactgcagccgagaatcgatcrrcaaaagcgaccagccat

SEQ ID NO: 26853 - DNA, 267 bp, Homo sapiens
gagtgttatatactgtttagctcgggcgtaactgatcacccaggaagagctggccgtaggtccagacagcattatggggacagtttgggagggtgtggacagccccatactgagaacatgccatgtacttctgcctctgaagatgtccttggaaacagttgcacatcagtagtgaccccctggtgtaggttcttggggagccatgccattctgccctgaagcctcctgttaggctgttcattcagaatcagaaactggcagagttgg

SEQ ID NO: 26854 - DNA, 139 bp, Homo sapiens
aacaggacacagctccgggcgccggcgtagaatctgagctgcaggaaggaggagaagaaatgtggtcggaagatgaggaatgaggtggtccataaagtgagagagaagagaaatttctcttcctccagtgaaggactgg

SEQ ID NO: 26855 - DNA, 85 bp, Homo sapiens
tctccctggcttctggaggaaagagaaggagggcagtgctccagtggagacagagtgagacttcctatcaaaaaaaaaaaaaaaa

SEQ ID NO: 26856 - DNA, 361 bp, Homo sapiens
  misc_feature 189: r=a or g
  misc_feature 190: s=g or c
ctcttttctatcacttccactggaatggacctcaaagagcagttctgctctggtcctttttgttttcttttaaaaaaaaaataggccaggcacggtggctctcacctgtaatcccagcacttcgggaagacgaggtaggtgggttgcttgaggccaggagatcgagaccatcctggctaacacggcgarsccatctctactaaaaatacaaaaaattagctggcgtggtggtgggtgcctgtagtgccagctactcgggaggctgaggcaggagaatggtgtgaaaccgggagacagagcttgcagtgagctgagatcgcaccactgcactccagcctgggcgacagagcaagactccgtc

SEQ ID NO: 26857 - DNA, 479 bp, Homo sapiens
  misc_feature 430: v=a or c or g
  misc_feature 431: d=a or g or t
  misc_feature 432: w=a or t
  misc_feature 433: y=c or t
cagatgttaagaggatttgatatattttgcatgccttatcagaagatacattccaaattttttataacaatattttaaatattttaaaatgttactttggctttaccacagaccagggcttttaggtctgtttcactaatattcaggtgggcatagtaatgggtgatgagaataaaaacatatgaaaaatatttttctttatctaataccggattgttttaaaggtcccttcatcagttattcagaccactacaaatgtaatagtaatagactgttagctttgaagggttgtctgtaattattatgtggtaattatgtaatccttctaatgcccacatgcgtaaattttgatatgactgatgtccaacccaccactaaataaataagctttttgatgggtttttgttttgttttttgagacagggtcttvdwyctgtcacccaggctggagtgcagtggtgcagtctcggttcgctgtc

SEQ ID NO: 26858 - DNA, 259 bp, Homo sapiens
  misc_feature 7: y=c or t
  misc_feature 8: y=c or t
actatgyygatgattttaatagtaccagccatcgctcagagaaaagtgagataagtattggtgaagagatagaagaagacctttctgtggaaatagatgacatcaataccagtgataagcttgatgacctcacacaagatctgactgtatcccagctcagtgatgttgcggattatctggaagatgttgcatagacacgaagaaggaagtattctaattaacaaggacagaggactgaccggttccatttttttttttt

SEQ ID NO: 26859 - DNA, 123 bp, Homo sapiens
  misc_feature 20: d=a or g or t
  misc_feature 21: w=a or t
  misc_feature 106: y=c or t
  misc_feature 107: y=c or t
aagttcgatccttttggtgdwgctagtgggcgccattttgaagttgggcagaaagtgactccagtggtggaacccggagccaaccatttttagttacccagcgtcyyatgctcggtggcccct

SEQ ID NO: 26860 - DNA, 206 bp, Homo sapiens
aagggcataaaagctggccaccgaagccagcaagcgccaaccgtggcgggtcctgttccaagctgtgggggctatgttcttttgctcttcgaactaagtcttgctgctgcttactctttgggccttcgctacctttacgacctgtaacactcactgccaaggtgtgtagcttcactcctcaagtcagcgagaccaccaacccaccg

SEQ ID NO: 26861 - DNA, 112 bp, Homo sapiens
gagactgccacctgaatactttgggctcctcatgcctctgaatcaacgggcaaagaagagagttatagatcctaaccacccaggagaaattcggtggccactacacaaacag

SEQ ID NO: 26862 - DNA, 128 bp, Homo sapiens
  misc_feature 59: w=a or t
ctccatcttttctctcctctcccctcctctttctctcccctcctctttctctccccttwccctctcctctctctcctctctccctctcctatcatctctccctcctttcccttccctttcccccccca

SEQ ID NO: 26863 - DNA, 163 bp, Homo sapiens
actaccatgcctagctaatttttatatttttagtatagatgagggttcaccatgttggccaggctggtcttgaattcctggcttcaagggatctgcctgccatggtctcccaatgtgctggcattacaggcatgatcttacagtctttaaaaagaggcagacg

SEQ ID NO: 26864 - DNA, 71 bp, Homo sapiens
tcctcctatgtatattcaatttcagtgttttttctttttctttcttttttctttttttttttttttttttt

SEQ ID NO: 26865 - DNA, 316 bp, Homo sapiens
tttgaatagggatatccagttttcctaccaccatttattaaagaaactatcctttccctgttgtatcttcttggtacctttgttgaagatttgttgaccatataggtttgggtttctttctgggctttctattctgttccattggtttctatgtctgtttttatgccagtgccatactgctttgattactgtagttctatcatataatttggaatcaggaagtgtgatgcctccagctttgttcttctttctctagattgctttagctactcgggatcttttgttgtactattaatatacaaatgttaggggtatt

SEQ ID NO: 26866 - DNA, 273 bp, Homo sapiens
cactgtgttagccaggattgtctcgatctcctgacctcgtgatccacctgccttggcctcccaaagtgctgggattacaggtgtgagccacctcgcccaacctcagtgggtgattttaacagcatctgaacacaactgatgaaactgaagagagaattagtgaagtggaattgaggccagaagaaaatagatagaatggagtacaatgagtaatcattgcagccctagggaaaaattagaggactaataagaagactgattgctagcttcttt

SEQ ID NO: 26867 - DNA, 286 bp, Homo sapiens
  misc_feature 265: s=g or c
attttctcctaggctactaacctgtatagcatgtgactgtactgaatactgcaggaaaccgtagcacaatgttcttattgtcttaggtacattcaagacaattcaactgaaaagaatgtgatgggtaatggagaagcagattatttcatattggttctgctaaaaacatcaaagcccaaattcagcaacaaaagaccactgtgttttcaatatgagagaaaacaataccaaatatgttccacagtatcagaacattaaaagaatsgacttctaaaaagcaagacaa

SEQ ID NO: 26868 - DNA, 242 bp, Homo sapiens
  misc_feature 25: s=g or c
  misc_feature 68: s=g or c
  misc_feature 76: w=a or t
  misc_feature 119: w=a or t
  misc_feature 121: w=a or t
  misc_feature 130: k=g or t
  misc_feature 155: w=a or t
  misc_feature 167: k=g or t
actagaaggtgggcttgacaaccascattgtggtagctttatcaggaaatagaaaagagaggaattasttggtgtwcgttgaggagctaacattatcaatctcacttttaaaatggtawawttgatgcakttgtggtatgtctagtggaattttwcatctggcagtkagaaatgtcaatttaatcttgaaagtggaaataggtaaaagataggctaataatcttgattttatatgttgggag

SEQ ID NO: 26869 - DNA, 309 bp, Homo sapiens
  misc_feature 211: v=a or c or g
gggggcagggtagccccaaaccaggaggggtggacaggctgtggcctacagcttgagggggctggcccttcttttccacagcaagggtcggcccatcggtgccaagacaggacaggcctgtgcgtgagggtacacgggtggcttccatcgagaccgggctggcggctgctgcagctaagttgtcccagcaggaggagcagaaaagcaagavaaaaaagagtgccaagaggaagctgactcctaacaccacctccccttccacctccacctccatctctgccggcaccacctccacctccaccacgcgct

SEQ ID NO: 26870 - DNA, 248 bp, Homo sapiens
  misc_feature 4: r=a or g
  misc_feature 121: m=a or c
  misc_feature 203: k=g or t
acaractatatcctacagtagtatcatcatcagtatcaaaggtctcctttttttacttggaaaagtaattcacaaacattataaaaatactattcaaacagtaccaaagagtagattagcmaaaagtaagtttttttccctagcctgtctcatttttccatcattacacagactacttggaatgtcttagatgtccttgtatkgtaattttctgtgtaggtagaaataaatgtagctttcttatttac

SEQ ID NO: 26871 - DNA, 199 bp, Homo sapiens
  misc_feature 12: m=a or c
atcgcacaggamattaagaacaactcttggaaatagctctgtgactgctaagttaggaaagggaacgtttgtttactcggcagcagaaaaccaggaacccaccgaccggccagcgaaggtcgcccgtctccagcagtgcgcatcgttcccctaccccgggcgccctgaattccaatttttccagtcccaatcaggcaac

SEQ ID NO: 26872 - DNA, 294 bp, Homo sapiens
ttatgctgtgccacgtgcagatggtgcacagatgcatagatccctgccccgaagaagcttcaaacgtttttaaaaatttttaaattgattttaaaaattaattaattatttatttttggagatgaggtcttactgtgttgcccaggctggtctcaaactcctggactcaagcaatcctcccatcttgacctcccaaagtgctgagattaaagggatgagtcaccatgcccagctgctttaaacttttagaaagaaaactagcttattagaaaatgcagattttgaggccagcac

SEQ ID NO: 26873 - DNA, 113 bp, Homo sapiens
  misc_feature 35: s=g or c
ttgcccaatgtcacacagcagtaagtgaaaaagcscagattcatgcctaggccacctggttccagagtttatgtttgtaactactctggaattgatttttttttttttttttt

SEQ ID NO: 26874 - DNA, 53 bp, Homo sapiens
attggattatacctgtgagctaccacgcccggccttttttttttttttttttt

SEQ ID NO: 26875 - DNA, 165 bp, Homo sapiens
tcctcttttttattgttataaacaatgcttgcttttctattcccttaaaataataccatggaattgtgattcctgggtcaagtggaatatcctttgaaaggctctggccttttaaactttcattctaatgctggatataagacaagagatagaatgaccccccct

SEQ ID NO: 26876 - DNA, 145 bp, Homo sapiens
taaatatagaaaaaattagccgggcatagtggtgggtgcctgtattcccttgagcctgagaggtcgaggtaggaggattgcttgagcctgagaagttgaggctgcagtgagccgtgatcatgccactgcaccccagcctgggtga

SEQ ID NO: 26877 - DNA, 353 bp, Homo sapiens
gagtctcctcattgtgggagctccgcccacccagggatagccacccatcctggaaccctcccgttctggaagtcccagccgcggtgtaaccacgcccactgcggaacccctcccactagagagacccagtgtggaatctctgcccagagagggtgcccgcctagacacggaagctgctcccgtcaggaatgagagcccactgtataagccctgctacacacacaattctggaagcccactcaactcactctaattatcacagaggcatagtggagggtggagacaacctcaccaaccttgagaactctcctccaaccctttggtattaagggcagattgtgtccacacccatc

SEQ ID NO: 26878 - DNA, 111 bp, Homo sapiens
  misc_feature 23: s=g or c
  misc_feature 39: w=a or t
  misc_feature 47: h=a or c or t
agtgctgggattgcaggcgtgascgccgcgccgggcccwtgttttghtttctagattgaagaaaattttttctcagaagttatctagaatttacaccgatttggtaaagca

SEQ ID NO: 26879 - DNA, 289 bp, Homo sapiens
  misc_feature 120: r=a or g
  misc_feature 128: k=g or t
  misc_feature 270: v=a or c or g
  misc_feature 286: d=a or g or t
  misc_feature 288: m=a or c
tttctttgagatggagtctcgctctgtctcccaggctggaatgcagtggcgcgatctcggctcactctgacctccgcctcccaggttcaagcaattctcctaccattgcttgaacatttratcgcgckattgcattccagcctgggcaacagagtaagactccatctctgaaaaaaaaattgaatacgacttacacatataactatataattcgacagaatttgtcttcattacatttaaatccatttggaaatctctcactaaagcgavacaaagacaaccatadgma

SEQ ID NO: 26880 - DNA, 181 bp, Homo sapiens
tataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttttttttttttttttttttt

SEQ ID NO: 26881 - DNA, 97 bp, Homo sapiens
agttctcattttgtgtgctcggctgactgcacgtccagcctcgggccagctcgagacggccacattgtgagtctgtgggagggattctaccgtgaca

SEQ ID NO: 26882 - DNA, 147 bp, Homo sapiens
ctttattgagggatactttactctatgaaattcactcattttaagtgtacaattcggttattattactatatttacagaatcctgtaaccatcacaattttatttttaatcgtttccatggccctgaaaataaaccacatacccaag

SEQ ID NO: 26883 - DNA, 241 bp, Homo sapiens
aagatcagtccactgcagcaggagtttcaagaacagcagcacaaaaataatgacttaactggatagaaaaaaaggcacatattttcaggaaggcctctttattcttagaagttacccttcaagatgacaagtggtgcaaactcttcaggatcttacctgccctcagaaataagaagttctaaaatagatgacaactacttgaaggaattgaatgaggacttaaagctaaggaagcaggaac

SEQ ID NO: 26884 - DNA, 264 bp, Homo sapiens
  misc_feature 4: k=g or t
tctkttcactctggtggatatggccaggatgccttgggtatggaccccatgatggaacatgagatgggtggccaccaccctggtgctgactatccagttgatgggctgccagatctggggcatgcccaggacctcatggatgggctgcctccaggtgacagcaatcagctggcctggtttgatactgacctgtaaatcatcctttaggagtaacaatacaaatggattttgggagtgactcaagaagtgaagaatgcacaagaa

SEQ ID NO: 26885 - DNA, 336 bp, Homo sapiens
  misc_feature 22: k=g or t
  misc_feature 133: k=g or t
  misc_feature 315: k=g or t
atattgatttgcacatgttgakccagccttgcatcctagggatgaagccgacttgattgtgatggataagctttgtaatgtgctgctggattcggtttgccagtgttttattgaggattttggcattgatgtkcatcagggatattggcctgaaattttctttttgtgtgtgtgtctctgccaggttttggtatcaggatgatgctggcctcataaaatgagttagggaggattccctttttttctgttgtttggaatagtttcagaaggaatggtaccagctcctctttgtacctctggtagaatttggctgtkaatctatctggtccagggcat

SEQ ID NO: 26886 - DNA, 185 bp, Homo sapiens
  misc_feature 119: w=a or t
ctttcctctcggaatcttccagaagtaaaaggaacagtaaataagttatgtgtgaaagtgttactgggggaaccctacctgggaggtagggttacgtgggaacagtgtggttgatcttwaaagactattacgaaggctgtttaacaagcatgcgttagagctccgtgtgcggatgtagaggggca

SEQ ID NO: 26887 - DNA, 338 bp, Homo sapiens
  misc_feature 226: k=g or t
atattgatttgcacatgttgaaccagccttgcatcctagggatgaagccgacttgattgtgatggataagctttgtaatgtgctgctggattcggtttgccagtgttttattgaggatttttggcattgaatgttcatcagggatattggcctgaaattttctttttgtgtgtgtgtctctgccaggttttggtatcaggatgatgctggcctcataaaatgagtkagggaggattccctttttttctgttgtttggaatagtttcagaaggaatggtaccagctcctctttgtacctctggtagaatttggctgttaatctatctggtccagggcat

SEQ ID NO: 26888 - DNA, 377 bp, Homo sapiens
  misc_feature 250: d=a or g or t
  misc_feature 302: d=a or g or t
cacagtgtaggtatcaaaatcaggaaatttaacattgatacaatactcttatctaatagcccagattcgaaatgtcttcagttgtcccggtgatgtcctttgtggctatttttgtttctggcccaggatgtgattgaggatctcacattgcatttagttgtcctgtttccataatctcttctaatttggaacaagtcttcggtccttgtgttctggaccttgacatttttgaggaatatataggccagtdattttgtgaatcatttttaaatttggatttgtccggcatttcttcgtgattdtggtttaggttataaatttttggcaggaataccatggaagtgatgttgtgttcttctcattgaatcctatcagga

SEQ ID NO: 26889 - DNA, 130 bp, Homo sapiens
  misc_feature 7: k=g or t
  misc_feature 105: k=g or t
  misc_feature 106: y=c or t
gtatgtktagtagagacgggggtttcaccatttggtcaggctggtctcaaactcctaacctcatgatctgcccacctcggcctcccaaagtgctgggattacaakygtgagccaccgcgaccggcccaac

SEQ ID NO: 26890 - DNA, 176 bp, Homo sapiens
cacaagcatttattgaatggattagattactgcagtcagaaaggtctttttatacactgcttctgtcaaatgtgtttttactcacaagatttcaatagtttcttaatttgtacacgttaaatcttatctcacctgctcaactcataaggtttggctccacctagcttctcccacat

SEQ ID NO: 26891 - DNA, 263 bp, Homo sapiens
  misc_feature 218: m=a or c
  misc_feature 219: r=a or g
catttgatctttttttaaagacggagtcttgctcttgtcatccaggctggagtgcagtggcgtgatctcggctcactgcaacctcttcctcctgggttcaagcgattctctgcctcagcctcctgagtagctgggattacaggcacctgccaccacgcccagctaatttttgtatttttagtagagacgggtttcaccatgttggccaggctggtgtmraactcctgaccttgtgatccacccgcctggcctatttgatgttt

SEQ ID NO: 26892 - DNA, 139 bp, Homo sapiens
  misc_feature 119: w=a or t
catgtattggctaactttcaggggcctcagattccatatgtcttcagtggattgatgaatatcaggttaatttgtgcctgccccagccatctctactttattctgaggtattccaacawtcctcttgttgcaggtgcat

SEQ ID NO: 26893 - DNA, 239 bp, Homo sapiens
  misc_feature 15: w=a or t
  misc_feature 71: k=g or t
  misc_feature 205: n=a, g, c or t
aataatcacagtcawaattataataatgaaaaagtttgaaatgctgtaagaatgatgaaaatgtgacacakacgtgaagtgagcacatgctgttggaaaaatggcaccgatagccttgctccaggcagggttgccataaaccttccatttgtaaaacgtgcagtatctgcaaggtgtgataaagcaaagcacaatagaatgagtnattcttggactcacagagcataacacggggaact

SEQ ID NO: 26894 - DNA, 136 bp, Homo sapiens
  misc_feature 38: s=g or c
  misc_feature 102: r=a or g
ggcggtgaatcagagccacaccgagaaccgccgcggascctcatccctaacggtgaaagtctcttgaagcggtctccgaatgtggagctctccttcccacarcgatcagaaggctcaaatgtctttagtggtaggt

SEQ ID NO: 26895 - DNA, 185 bp, Homo sapiens
gcaatggcatgatcttggctcaccgcaacctccgcctcctgggttcaagcgattcccctgcctcagcctcctgagtagctgggactacaggggcatgtcaccatgacaggataatttttttgtattttagtagagatggagtttcaaccttgttggccagtatggtctcgatctcctgacctcgt

SEQ ID NO: 26896 - DNA, 253 bp, Homo sapiens
  misc_feature 35: k=g or t
  misc_feature 49: r=a or g
  misc_feature 86: v=a or c or g
  misc_feature 112: s=g or c
  misc_feature 114: s=g or c
  misc_feature 201: w=a or t
actagcaaccactttcagcgtttctgcaaagctakagaagggttcccartgccgattccgacactgtgaagaggcccttggcagtvacactgtgtgctcattatggagagasasgaaatgtttagatccactttgcagatttagacacatggaaatgcagcaaaactgcagcatttcatgcttctgggaaactcagcctcwtggttgtgtgaagatcagctgtatcttttatcacagcaaacctcgaaataat

SEQ ID NO: 26897 - DNA, 90 bp, Homo sapiens
agctgtaagaggctgttagaaaagtcatgtcatgtcatgccacctgttacgttttattttttgatgccttttttttcctttttttttttt

SEQ ID NO: 26898 - DNA, 364 bp, Homo sapiens
  misc_feature 363: m=a or c
gggcaatgtagtccagtcatgtggctagcaggaaaatgcagggggcttggtgaaaatttgctctaggtcccagacttggcaaatgatacaagatttaactcacacagtccggcttccaagcccacactcttaaccactgtactctcagtcagggattgagtgggcaagcactgtgggctgcagacaccaagctccaccatgattccccctccactctcagaggctccatccagctggcaggctcacagcactgcagcccagcatctgaagtgattcttaatacttgaattaaaaggagaatggtcattaaacagaaactgctgctaaaagtgacaagcaacttagcaatacacattaggagcma

SEQ ID NO: 26899 - DNA, 239 bp, Homo sapiens
taacgaatgaatgttgcttgcttactctatatgctgggcagtattgtaggcacttggaatacattagtgaacaaaacacagggaagtttctttcccttatagacattacattctagcagaggtacacagacataggtgagtaatacagcatattataaggtgatacgtacttagggaggtaaaaagcagtataaggaggatttgggttataagtatggtcagggttttgctgagaaggt

SEQ ID NO: 26900 - DNA, 156 bp, Homo sapiens
  misc_feature 137: n=a, g, c or t
  misc_feature 138: n=a, g, c or t
gacttgactggatgtgttttttcttgttaaaatctatgctagtctaggtttttacattttcaaacacacttagaaaaatttgaagttatctctacttaaaaaaatgtattggctgggcgcggtggctcacgcctgcnntcccagcgctttgggagt

SEQ ID NO: 26901 - DNA, 96 bp, Homo sapiens
gtgagggaaaagccttttgttacagcacacagtgtacgtccataaggctgggttgtggactttggttgtttttttttttttttttttttttttttt

SEQ ID NO: 26902 - DNA, 314 bp, Homo sapiens
actgaggcaagaggattgcttgagcctaggagttccaggttacagtgagctatgattgtaccactgcactccagcctcggcaacagagtgagactttgtgttgaaaagagagagagaaaaaaatgtcccagcaactgagcatagggtatgactttaggaatatatatttttgttcagtatatatttatttagtatacagtccagtcaatccctgctctaaggttaggataattctgagtggctctgggatcccacaattagcaatcgtgcttagatacaattagcaatcttgatgctctgaatttgtgtgtgat

SEQ ID NO: 26903 - DNA, 115 bp, Homo sapiens
cattcttaatttgagtgcatgaaccactgcagatgagctgataagcagaaattctcaagtgggtttcactaataaatgtttttttatatgatttgaaatcaagtaaagggactcg

SEQ ID NO: 26904 - DNA, 175 bp, Homo sapiens
agcgcggcttcggcggttgtcttggagaagcaagatggcggcgacggcggccgcagtggtggccgaggaggacacggagctgcgggacctgctggtgcagacgctggagaacagcggggtcctgaaccgcatcaaggctgaactccgagcagctgtgtttttagcactagagggc

SEQ ID NO: 26905 - DNA, 181 bp, Homo sapiens
  misc_feature 138: d=a or g or t
  misc_feature 139: w=a or t
taatcagattctggattaatggagtaaatgccagaaaacctgaattagttatataatcccgggcaagtcactttccttttaatttttctgccctgtaaaatgaaggactcagctgggtgtggtggctcgcgcctgtadwcacagcactttgggagaccgaggcagatcactggaggtcaga

SEQ ID NO: 26906 - DNA, 424 bp, Homo sapiens
atttgcttacttcagagaactcccaaccctcacaaaaagaggcaactcaagtctctaggacatcaaaatgctgatgaaaatctcagatatttattcaaataaggtaacaaaaaattgagttttgtggcctgacatttcgacgttgtgtaattagaaaagcacagagttttaaagcatccctggcatgacctatggtcattgcttcctgactattgctccgtgcaagtaagaatacagaacagaaacagcccgggactaaatgtcaaaggccagaggttatgtaccatgtggctctcagcaaggtcttactctctctccacatatgaagcaggcacagtaactcattttccttttatctcatacattaaacaaatcaaataaagcaatgaatttataattctttatttttttaacctttgtttaa

SEQ ID NO: 26907 - DNA, 237 bp, Homo sapiens
aatagaatctggacagggatgaggcaaggagacaggagtgatctctccaccctgggcccagtgcctccagaaagaacgcagccctactgacaccttggttttggcctggtgagaccaactttggacttttcacttccaaaactcaatgattttcagaaatgccttagttctggagttgaagcggctgtggtggatgggattctggatggcgacgtagcggtccagcgagatggcgca

SEQ ID NO: 26908 - DNA, 246 bp, Homo sapiens
gtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgct

SEQ ID NO: 26909 - DNA, 292 bp, Homo sapiens
  misc_feature 123: m=a or c
  misc_feature 124: v=a or c or g
  misc_feature 230: m=a or c
  misc_feature 234: s=g or c
  misc_feature 243: m=a or c
  misc_feature 259: m=a or c
  misc_feature 261: m=a or c
gtgtctcctctgctcatgcagcctggagggacctctcggtgatccccggccgacccctccccagcactcagcccaagaaccagcctcaaccacctcccttcccagctcagcctcacctgctgmvcaaactgcaatacctcctcccatctcccatcctcagacagcccatccctcctgcaaggtccagtccgaagtcgtcacctcccccaggaggcccacccgtcctcctmagcscagcctgamtctcaggatcaggctmamcctgcggaggctgaagccaccaagtcatagt

SEQ ID NO: 26910 - DNA, 198 bp, Homo sapiens
  misc_feature 133: s=g or c
  misc_feature 184: d=a or g or t
tgaggcgcggcccagccgcagccgcagtcacagcctcagccgcagcggccgtgctacctaggtgatagcggacgactgggtaggaagcaattgttctcaaacttcactagccccgtcggcgcggacgcttgtsgagaatgcagattcctgggtactgccagatacgaattgagcataccacaadaaagttctcatttt

SEQ ID NO: 26911 - DNA, 202 bp, Homo sapiens
  misc_feature 93: w=a or t
actaccgtgattcaatcacctcccaccatgcccctcctccaacacatggggattacaagtggacatgagatttcgcagaagtgcatctgcgtwatgaagaatgcacaagaaaggagaacacatcattttccacaatcacagctacctatgtgacagtgagataacagtgatttttgaaagcctctgttgtttttccggctgc

SEQ ID NO: 26912 - DNA, 302 bp, Homo sapiens
ctatcaagagaagcatgcaaagttgttaaccaccattagcaatgactagatggtaacttctgggtcatttcagaacacttcttacggactttggaaaacctggcactgctgccactttttgaaggctctggactttgtctaaagaaccaacctgtgccccacaaagcatgcctaaacttacaagtacagttgtgcactcaaagcaaccctgagactgtatttagtaaacatggaggggaagttcatactgtccaattaatatgaaactataaaaaatgggcaatccataatatgacacaagc

SEQ ID NO: 26913 - DNA, 237 bp, Homo sapiens
tgctttgtcatccaggctggagtgcagggcgcaatctcggttcactgcaagttccacctcccgggttcacgccattcttctgcctcagcctcctgagtagctgggactacaggcacctaccgccatgcccggctaatttttgtatttttagtagagatgggctttcaccttgttagccagaatggtctggatcatgaggtcaggcgatccagaccattctggctaacaaggtgaaag

SEQ ID NO: 26914 - DNA, 168 bp, Homo sapiens
  misc_feature 104: s=g or c
aaaccagctcgggtccccttccacaccgtggaagctttgttctttcactctttgcaataaatcttgctactgctcactcttcgggtccaggctgcttttatgasctgtaacactcaccgcgaagatctgcagcttcactctagagccagcgagaccacgaacccacca

SEQ ID NO: 26915 - DNA, 231 bp, Homo sapiens
  misc_feature 4: r=a or g
  misc_feature 9: w=a or t
  misc_feature 29: v=a or c or g
  misc_feature 36: r=a or g
  misc_feature 59: r=a or g
  misc_feature 98: r=a or g
  misc_feature 100: r=a or g
  misc_feature 103: r=a or g
  misc_feature 109: r=a or g
  misc_feature 201: b=c or g or t
  misc_feature 202: v=a or c or g
  misc_feature 205: r=a or g
  misc_feature 220: r=a or g
  misc_feature 231: s=g or c
tatragcawaattataatattggaatatvatatctrgaacttatttctttataggctartaaagaaatccttttggctttttcacgagatttcctaartrgtraaggtracctttcccgtcaccttggcttattgggattacctgttaaccatgttcagacaccatttgatgaatttgattttgccgttacaaatcttgcbvtaracttgcaatgtggartgcgccttgts

SEQ ID NO: 26916 - DNA, 203 bp, Homo sapiens
  misc_feature 18: r=a or g
  misc_feature 155: n=a, g, c or t
aagaacttcggagctcaraacaggtgatactcactcctcctttggggagaggccgtgggcatggcttcacttttcagctggattataaaggatgtgaagttagcctgactgagcagaaggggagggaagacagcactccaggaaagtggaacganacaacagagtccaaagggccctccagcctacccactccccaagtacct

SEQ ID NO: 26917 - DNA, 172 bp, Homo sapiens
  misc_feature 136: m=a or c
aacttggaacagcaaagttcaaatgaacggatagacacaaactgtgaaagagtcctgaacccattacaaggtgaatctttacagcacaattgccctctgaagctacttgaaacagggcatgggacttaaaggagamaaaaaaggaaatggaccatctcttctaacacctggc

SEQ ID NO: 26918 - DNA, 100 bp, Homo sapiens
  misc_feature 37: s=g or c
ctgaggcaggagaatggcgtgaacccgggaggcggastgcagtgagccgagatcccgccactgcactccagcctgggcgacagagcgagactccgtctca

SEQ ID NO: 26919 - DNA, 91 bp, Homo sapiens
gaacccgggaggtggaggttgcagtgagccgatatcacaccactgcactccagcctgggtgacaaagtgagactccatctcaaaaaaaaaa

SEQ ID NO: 26920 - DNA, 270 bp, Homo sapiens
  misc_feature 127: s=g or c
  misc_feature 252: n=a, g, c or t
tccttatttcaaattgaacttaccctgtctcctcttccccgtgtcccttttataatcttccatatctcagtaaatagcagcttcatctttccattttctcaggtcaaaacctggagacattcttgastcttctcacccattacatctgatcccttaggaaatcttagcagctctgtttaaaatatatccagaatctgaccacttctcatcacttgcactggcataagcctacattaccttctccaaattatngcagtaatccccccctag

SEQ ID NO: 26921 - DNA, 75 bp, Homo sapiens
agtctggcttccgcggtcggacttctacacccgcctccagacaggagaagggcacgtaccggcgctacggcttcc

SEQ ID NO: 26922 - DNA, 252 bp, Homo sapiens
aaaaagatcagccacgtggcagtcaaccatgtctatctgaccaagttccaatgaaaactctggacaccaaggcttgggagatatttctcaaaagactcctctgcgggagaggagaatagctgtactctaagcagttcgcagggagcatctttcagcagctgaaacagctttgcggccttgctgtaatgaagatctgccagcacccggtgttgtttcctaaggtgttcatcaccaacctagaaccaaaccaaa

SEQ ID NO: 26923 - DNA, 218 bp, Homo sapiens
  misc_feature 15: s=g or c
  misc_feature 205: k=g or t
attctcctgcgtcasctcccgagtagctgggggctcccgccaccacgcccggctaattttttgtgtttttagtacagacggggtttcaccatgttagccaggatggtctctatctcctgacctcgtgatccacccacctcggcctcccaaagtgctgggattacaggtgtgagccaccactccctgccgtaaaaggcctaatctktaatgaccctcct

SEQ ID NO: 26924 - DNA, 246 bp, Homo sapiens
  misc_feature 112: k=g or t
aagtttaaattccgctccctccacgaaagagttgtagtgagtgaaaataaatattaaaacacacggaaatgtattttcctggctgcagcacctgccatcttgcctcggtaakgactcattttcaaaaacagcagcttcttgaagccccagaacgcattcctgtgctacggaagacggaagagtagctctcggggtcagaaggcgaaggatcccaagtatcctgtagagaacttgctaaacccagat

SEQ ID NO: 26925 - DNA, 351 bp, Homo sapiens
  misc_feature 115: s=g or c
  misc_feature 118: k=g or t
  misc_feature 265: n=a, g, c or t
  misc_feature 282: n=a, g, c or t
aacaataaaaactcttcgccggaaaacgacctttccccgcccactgcgctgacaccggaagcgaggcgtgtctgggagatcactccgcgctccggcggcgaaggaaagaacggastckgatcatagaagcctagtaaagtagtacacctctctcctttcgtgaggccataagaacaaactccttttctcgtcacagctacgccctgggcataaacggttggggcgtcaaagggagggagggaagggagcgggcgggaggagacgntcacgtggtcgcggcgnaaggatgcgtctgtgctgcgtccccatagagacgaagtctataaagggccggcgggcggccacggcagg

SEQ ID NO: 26926 - DNA, 168 bp, Homo sapiens
aaaggtgacataatgtctttcccatcattaggttacattataccttgctggctttgaagaagtaagctgctatattctgagagaggagaaatgtcaaggagcctgtgggagctcagagcagaccttgatcacagccagcgagaaaatgtggcccgtagtcccacagac

SEQ ID NO: 26927 - DNA, 241 bp, Homo sapiens
  misc_feature 88: d=a or g or t
  misc_feature 222: r=a or g
  misc_feature 223: s=g or c
ggttttcataacttttgtggatcatctttggttcccaggactcatgctgttcaaataatgcttaatttgtcataacttttaattaatdtttatttagaaaagcttattgttccttagcatatgctattaaatattaatagatgtcttaagagaaatattgatgtttttcatttgacacatacatatatgtgtcaaaagtgtgtgtgtatacacacacacacrsaaacacagcacacacccc

SEQ ID NO: 26928 - DNA, 78 bp, Homo sapiens
cccatagtaaaacttgtaaataaggaactatatcatattcagtagctgtgttctgttccatctttttttttttttttt

SEQ ID NO: 26929 - DNA, 291 bp, Homo sapiens
  misc_feature 11: r=a or g
  misc_feature 41: r=a or g
  misc_feature 75: k=g or t
  misc_feature 115: r=a or g
  misc_feature 127: s=g or c
  misc_feature 128: s=g or c
  misc_feature 139: r=a or g
  misc_feature 151: k=g or t
  misc_feature 154: k=g or t
  misc_feature 254: r=a or g
agaaactggartacatggcaagagaaaagcataggctgaargtagagatacagtaacgtcttcaaataatctgckctttctacccatcaaagacagaaaatagctggatggagaraataccactgassctaacccaggrcaatcctcctgkctktgaatgtctccatgctgctcacttgcctccttgcactcaaccaagactgcgaagtgtacctgaacaccaattaggaggtctcccacttccacacacaaaraagggaatcccatggtaataaaatgctttccagagat

SEQ ID NO: 26930 - DNA, 392 bp, Homo sapiens
  misc_feature 118: n=a, g, c or t
  misc_feature 130: k=g or t
  misc_feature 365: w=a or t
aaccttgttgctagggaccgggcggtttgcggcaaccgtgggcactgctgaatttgaattgaggggcgagggaaaagttttcctcaggtgtggtggggagagggaggcggatgccggngaaaccgtaggkacgcggtcagaaaggcgacgggctgtcggagttggaaagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggccwcccacacccggtccgcgctccccgccc

SEQ ID NO: 26931 - DNA, 268 bp, Homo sapiens
agaaacaccagtgcgagaacactagtaagagcaagacctcacatttgtgttgttttacagtttacaaagcactttcatatccattatctgattgacttccaacagccaccctatgatagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacaa

SEQ ID NO: 26932 - DNA, 354 bp, Homo sapiens
  misc_feature 150: k=g or t
  misc_feature 151: k=g or t
  misc_feature 324: r=a or g
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgackkgcttattatacttagcatgatctacgttgtagcaggtgtcagaatttcgttcctttgaaaggctgaataatattccactgggtttagatacaccacgttttgttgacccattcacccatcaagggacccaagttgcttccacattttagctacagtgaataatgctactagaracataagggcacaaagctgggtctgtgaca

SEQ ID NO: 26933 - DNA, 199 bp, Homo sapiens
  misc_feature 10: b=c or g or t
cgccattttbctgcctcaacctcccgagtagctgggactacaggcacccgccaccacgcccggctaatttttttgtatttttagtagagatggggtttcactatgttagccaggatggtctcgatctcctgccctcatgatccgcctgcctcagcctcccaaagtgctgggattacaggcgtgagccaccgcacccggc

SEQ ID NO: 26934 - DNA, 353 bp, Homo sapiens
  misc_feature 311: n=a, g, c or t
  misc_feature 312: d=a or g or t
agggatagtgtctgcgcttctaccctgaatagggctcccttggaaaataatatctctttttaaatacccccttggaccacttttaatagttttctgatagaactaaacagtgatcattctcttaattcatgtttccattaagtttttcaggttaagtactgcacgactactcgcttctgaaactgatagacactgcctcagctccgtgcagggcagacgcacaagagcagaatctccgtgggacatctctctggagcatcaatattactgcagtatttggaagaaacaaatttaaataagttctaagtaandatgataaatcatatcaagtcaattgaaagtcctgcctgcat

SEQ ID NO: 26935 - DNA, 317 bp, Homo sapiens
  misc_feature 217: d=a or g or t
  misc_feature 218: r=a or g
atttgagtataagcagggtaaatactcactggaccctgtccagaccatggattacatggtggctcacacctgtaatcccagcacttcaagaagccaaggaggatagcttgagcccaggagtttgagaccagcctggacaacataggtgtggtgtctatctgaagaatattttactttcaaaggaaagatgctgtctccaaatgataaaatgttaggdraactggatccattttatcaaccttcagtgtccaagcagaagaccagtgcagaaatcataagtgaagcaagaaatgcattaagaacagttagaacccaaa

SEQ ID NO: 26936 - DNA, 182 bp, Homo sapiens
gccattacaacaaaaactggcggcgaggaactgcggagaaccgttgccctgcaccgcttcattttgtgcagcctgaaaggggcaatcacataaggacatgtacttgtagacaggattcaaagcagttaagaatgtctctgccaagtcgacaaacagctattattgttaaccctcctccaccc

SEQ ID NO: 26937 - DNA, 422 bp, Homo sapiens
  misc_feature 6: n=a, g, c or t
  misc_feature 358: d=a or g or t
tttttnctgagacggagtctccctctgtcacccacattagagtgcagtggcctgatctcggctcaccacaacctctgtctcctgggctcaagcaattcttctgcttcaatctcctgagtagctggggctgcaggcatgggacatcatgcctggctaatttttgtatttttagtagagacagggtttcaccatgttggccaggctggtctcaaactcctgacctctggtgatctgcctgcctgggctcccaaagtgctgggattacaggcatgagccactgcgcccagtctggtgtgtcttataaaaagctgcttctgccctgccctgttttagccagtcctgtttggtcccagctccdagccctgcctctggagtcaagtcctgcctcctatctcaattgtaataaatgttctgcaccagca

SEQ ID NO: 26938 - DNA, 372 bp, Homo sapiens
tactatgatggggggaccctcatcctaggtaaacagagacactgaagcaaaattaggtgtgattaaacagaaacaacagatggtatctttctattgggaaactaatcgtttgtgtaactggcaggatgaaacatcagaaaatacttgacacattttgctagagtcctaaagggcacctaggaagactgactccaaaatgtcaaaataaggaaaatacataactcagactagagtcagacagaagggagttccattcccagcccaccacctgtcagatttggggcaagttatttaaccttttttgctcctcagttttttttaatccctgaaatggggattggaattggaacattataggattgtcatggctgg

SEQ ID NO: 26939 - DNA, 184 bp, Homo sapiens
tatgaattttaatctagttcaacagtaataatttagtagtgtttcagtctagaatttatactgcaactattattgtactcattgttaggcaaatatgaataagtgtctcctaagatgaaaatctggcaccaaattgtaagttgacatctaaaacactggatcagcaagcttttaaccgcaccgt

SEQ ID NO: 26940 - DNA, 373 bp, Homo sapiens
  misc_feature 132: r=a or g
  misc_feature 291: r=a or g
tcccaaacttaaagtgaaagccatagagtcctttggtgactcccatgttctgtgctggttctagaacatgctggtaaatatcagagtttctatgcttattgctgataagtagacatttttaaaaatcataaraactgtattttctatatagttcagctaagtttatgaaaaagatgcagactcagtatttggagcattgctatcgctccatgatgtgtttaaaaattatttttaaattgacaaaattttatatctacatatatatatatcttgtaacacatgatgtttgaratgcttaattctagccaattaaaaatgctttacctcaatagttatttttattgtgagaaaggtcaacatggtcttggcactt

SEQ ID NO: 26941 - DNA, 428 bp, Homo sapiens
  misc_feature 150: d=a or g or t
  misc_feature 372: k=g or t
agtggcaacccgcttgggtccccttccacactgtggaagctttgtgtcttttgctctttgcaataaatcttgctactgctcactctttgggtccatgctgcttttatgagctgtaacactcaccacgaaggcctgcagcttcactcctgdagccagcgagaccatgagcccgccgggaggaacgaacaactccagatgtgccgccttaagagctgtaacactcaccgcaaaggtctgcagcttcactcctgagccagcgagaccacgaacccaccagaaggaagaaactccgaacacatccaaacatcagaaggaacaaactccagacgcaccaccttaagagctgtaacactcaccgcaaggtccgcagtktcattcttgaagtcagtgagaccaagaacccaccaattccggacacattttggcga

SEQ ID NO: 26942 - DNA, 279 bp, Homo sapiens
agaacttgaatgtcttctcaaaatcgggttctgtcactgcagtcttgtggcattaccaatattttgatagatggtgtgagctactgagctgaaaataagtttatttttattttttattttttattttttgagacggagtctcgctctgtcgcccaggctggagtgcagtggcacggtctccgctcgctgcaaactctgcctcccaggttcatgccattctcctgcctcggcctcccgagtagctgggactacaggcgcccctcaccacgcccggcatga

SEQ ID NO: 26943 - DNA, 199 bp, Homo sapiens
  misc_feature 104: s=g or c
agcagatcggccaagtacgcggaggccgcgcggtttcaccattaatactcctgaaggacaatagctcatcaagccccaccgaaagccccggacccgtcgcggasctgggctggcgggggatgaggctgagcaactcctcctagaggtggttatgtggagaaggagcaatcccttctccctcctcctcctccccccgcca

SEQ ID NO: 26944 - DNA, 167 bp, Homo sapiens
aatggaacgtggccagagatctgtacagaggctgtgggcgctcctaggaaagtctggccaagtgcctgagagttggaagtgcttcaccaataaacatttgcccagggcattgtaggatgggcacgggttcggcagaagaactttccaaataaagataacacaccacc

SEQ ID NO: 26945 - DNA, 161 bp, Homo sapiens
  misc_feature 105: w=a or t
  misc_feature 106: w=a or t
ctatagagttcttcattaacatttatacgagttttttgctgagtcagatggacagttgggttctgatgctttttccttctcctttccttttattattattatttwwttcttttaagaactaaggtattgcctgaaaaacaagtgatgtctgtgcagccacg

SEQ ID NO: 26946 - DNA, 296 bp, Homo sapiens
  misc_feature 114: r=a or g
  misc_feature 117: r=a or g
  misc_feature 119: d=a or g or t
  misc_feature 121: r=a or g
  misc_feature 125: r=a or g
  misc_feature 129: r=a or g
  misc_feature 130: r=a or g
  misc_feature 149: r=a or g
cgaagtatgtaaatctccagtttctcatctgcctcttttcatgcggaattcaagtagctagtcattagcagtacagcttggtcctggtgagtagatggttcttctgtggagatrctrgdarggtracarrcgagaacattctctgggtrggccgggctcagagcctctaagagcagaccggtctgagtatttgtgttgcagatggaactgccagctgccctctgttgcccccagcccctcataaagtcagctctaccttagaaacacacacacacacacacacacacacacataca

SEQ ID NO: 26947 - DNA, 224 bp, Homo sapiens
  misc_feature 103: r=a or g
  misc_feature 122: k=g or t
catgttgtagttatgtcagaatttccttcctttttaagtctgaaaaatattccattgggtgtatgtatatctacatatgtatctatatctgtctgtttcagartctgattagtcacacctakaacaaaaattttcatttaccacatcatcttttaatatctaatgttggcgtccttcatgaaaatttttttatattaaggaatacatttttttgagtctgccat

SEQ ID NO: 26948 - DNA, 85 bp, Homo sapiens
ataagaaggtaagaaggctgcagcttccaccgggcctcttgggctgtgtactcttgacactcttgctctgagaactaagcaggcg

SEQ ID NO: 26949 - DNA, 170 bp, Homo sapiens
  misc_feature 160: d=a or g or t
aacaatttttcattctccttgaaagcgagtcttctttatacacagatgacaagttcactaactcagtagaaataagacttcagaaagaaatattaaattttaatgtttcctcagagtgatgtaaacctaaagacatttttttaggatgaatgaatgagtdtatgctcact

SEQ ID NO: 26950 - DNA, 136 bp, Homo sapiens
ggagatagcctcgtagaaatgacaaccacaatgttaatactaacatatgtattacatggtttgtttgttctttcgcttaatattttcagagcacctacctattataggcactgtcacttctcacaaaactgggaca

SEQ ID NO: 26951 - DNA, 272 bp, Homo sapiens
aagaagggaaagacgcagggaggcgttgacagcgcttcgctgaaggacgaataaaaaccttgaaaagggacttaactgcgaggttaaatcgtggaggtgagcaaggcccagtgtgtgcggagaactcacatttaagaaggagtccattgagccggacgcagtggctcacgcctgtaatcctaacactttgggaagtcgaggcgggaggatcgctctgagcccacaagttggagactagcctgtctctataaaaaataaacaaaatgagcctt

SEQ ID NO: 26952 - DNA, 149 bp, Homo sapiens
aggattcagtcggctgagctgccacctatcaacttagcactcaagcaaagcacttatcttctgagttaggcattacttcagttccctaaagatgctgtccagggaaacatttggccctccagcctactgcatgggacatacccagcaat

SEQ ID NO: 26953 - DNA, 319 bp, Homo sapiens
catatgttgtcttcgtcatcatctaattatagggtgttaactgggtttttctcatcttttccaatcaaagatggtcagtcggtacaatttcttgactcttagagcctccccttcctgcccctttatttagatcatgtctgcacttacgtcccaagggaatctccacatcctttctaatgctgattgtcagctttgcttcctctttgacttggagtggaagtctgcttgtgcacatgtggacgtgaagtgggcagcaggaattcttgccttgatccttccttcttctaaccagctgtcatttagatgagcatggcccttc

SEQ ID NO: 26954 - DNA, 210 bp, Homo sapiens
  misc_feature 150: k=g or t
  misc_feature 208: v=a or c or g
atactctttctacattctgctccgctttagctgcgagagtttaccaactcaaatctggcccaagcctggacagtctagataaggaagcggatcacaaaaacaaattggtctgtgtgtgtgtgcgtgcgtgcacgcgcctgtgtatgtttkatatgattttactttgttttttggcagtttcgaattttaataaacttttatggggagvaa

SEQ ID NO: 26955 - DNA, 130 bp, Homo sapiens
aagccctgactgatggggtccccatggcagacggaggccttcctctctcagtccacccaggtgctttcttacctgcacgatgtagtcacaatcttccacctcgaacgcaatgtccttcactccgtcaccg

SEQ ID NO: 26956 - DNA, 289 bp, Homo sapiens
gtagctgggactacaggcgcccgccaacatggccggctaattttttgtgtttttaatagacggggtttcgccatgttagccaggatagtcttgatagtgtttttaatagacggggtttcgccgtgttagccaggatggtcttgatctcctgacctcgtgatccgcccgccttggcctcccagagggctgggattacaggcctgagccactgtgcccggtgcgcccctctcttgttctgcagtcaaatgctctacccctgagctatatccccagttatagcgccccgcat

SEQ ID NO: 26957 - DNA, 414 bp, Homo sapiens
catctgcattaaaaaaattgtaaatagagccaggctcagtggttcatgcctgtaatcccagcagtttgggaggccgaggcgggtggatcacgaggtcaagagatcgagaccatcctggccaacatggtgaaacctagtctctactaaaaatacaaaacttagctgggcatggtggtgtgcacctgtagtctcagctactcggaggctgaggcaggagagtcacttgaacccgggaggtggaggttgcagtgagccgagatcgccccactgcactccagcctggccacagagtgagactctgtctcaaataaatagatagataaatgatagatagatagatagatagatagatagatagatagatagataaagggtaatgtgagaaacctggggtgctgcttaagtggatgatca

SEQ ID NO: 26958 - DNA, 305 bp, Homo sapiens
agcaacccgtttggttatctttctgtgctgaggaaggtttgttctttcactctgcactattttgcaataaatattgctattgctcactttgggtttatattgcctttatgagcttgtaacactcaccatgaaggtctgcagctttactcttgaagcttagcgagaccactaacccaccagaaggaagaaactccggacacgccgcctttaagaactgtaatactcagtgcgagggttcacggcttcattcttgagggagtgcagaggaggagtccgtttggtgagtggaatttgtgacgtcccac

SEQ ID NO: 26959 - DNA, 451 bp, Homo sapiens
  misc_feature 184: n=a, g, c or t
aacttcttttccggcagggctgtggctgcagacagcatctcctgctagttcacaggctggagtgcagcggcacgatctcggctcactgcaacctccgcctcccgggttcaagcaattctcctccctcaacctcccgagtagctgggattacaggatttagcacacaaatgtccatagagcattnggaaacaagcaatgagagcagaggtatccggtgtatcccaaccaccctcctgcggatccccacgcctcccctgcgcatcccatgcgggcagcagcacacaggagaccacaggctaagcctgaaccacaggcagactcaccaggcacgccccatggcctgtgctcatgccctcaggtggtgacgaaaggtaggggaagctcaggccggggaacgtgtggggggtgagtgcttcctgcagaagcccctccggactgcagcacaggtggt

SEQ ID NO: 26960 - DNA, 165 bp, Homo sapiens
  misc_feature 53: r=a or g
  misc_feature 54: s=g or c
  misc_feature 131: k=g or t
tctgatcactagatttaatgctctggtaacaactctctgacaactcattattrstctagtattagattccattggattctttatcttccttgtttctaaaaaaatgcctttcctcattatgcaagtaattkttctttatttcaccatttatacagttggccagcg

SEQ ID NO: 26961 - DNA, 182 bp, Homo sapiens
ataatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaagggggatg

SEQ ID NO: 26962 - DNA, 239 bp, Homo sapiens
ttgcttgaggacaggaattcaagaccagcttgggcaacattgcaagaacccatctctacaaaaatttaaagaacaaaacttagccaggtatggtggtatgcgcctatagtcctagctactcaggagggagaggagggaggatcacttgagcccaggagttcaaggctggtgctaagattgtgccactgtactccagtgtgagcaatagagttagaccctgtttcttaaaaaaaaaaaaa

SEQ ID NO: 26963 - DNA, 265 bp, Homo sapiens
  misc_feature 137: w=a or t
  misc_feature 139: s=g or c
  misc_feature 155: v=a or c or g
  misc_feature 156: n=a, g, c or t
  misc_feature 216: d=a or g or t
  misc_feature 217: k=g or t
cagctatgtgactttaggcaagccagtcatttcattagtacaaattgagccccagtgcataatgtagggttaccctggaggattgcaaatgcatggaatattaaataggattggaaaaaatagctaatggaagagawascattaggtcatatgtvntaagttctaataaattgtacagacatagtagtctttaaattcataatggtgagctcatgdkcagtggttaggaaagactggtcaaagatgtggaatatgagctggaccg

SEQ ID NO: 26964 - DNA, 85 bp, Homo sapiens
  misc_feature 8: s=g or c
  misc_feature 16: k=g or t
  misc_feature 21: s=g or c
  misc_feature 30: s=g or c
  misc_feature 32: b=c or g or t
attcctgsatattttktattsttatttttstbagctaaatctttttgtctccttttttttctttctttttttttttttttttttt

SEQ ID NO: 26965 - DNA, 79 bp, Homo sapiens
tcttcctccgcctcctccttcgcctcttcctgcctcctcccggcttccgccgccgccactccagcctaatcccaaccgt

SEQ ID NO: 26966 - DNA, 304 bp, Homo sapiens
aagatacaaattttaggtgaccaaactgattttagtgacctcaatcctaaaatctaagccatttgtttagcttttaatgacattttataatgttaaagggaggactttggagctgttatctcatctagagattgtttggaacatatgtcttccagaataggttgataagctcacaatcatttattgctacgtttttgtttttgttttgagacaaggtctcactccgtcacccaggctggagtgcagtggcatgatcatagctcactgcagcctcgacctcccgggctcaagcaatcctctcacc

SEQ ID NO: 26967 - DNA, 219 bp, Homo sapiens
gttgcttctctgccgcgcaggcagctttcttctttttccccttgatcacagtgttactaacatttcatatcctgaagaacagaagaaagagcgaaatctacttccctcatcaagattaatctttactttaattataaaccaagcatgcagatactatgtattaatacttttgcaagagcattaattatttcagtgaagaatcatttttgtaatgacccc

SEQ ID NO: 26968 - DNA, 315 bp, Homo sapiens
  misc_feature 21: s=g or c
  misc_feature 38: r=a or g
  misc_feature 138: m=a or c
  misc_feature 293: h=a or c or t
tcaccttcttctccatccttstctgggccagtccccarcccagtccctctcctgacctgcccagcccaagtcagccttcagcacgcgcttttctgcacacagatattccaggcctacctggcattccaggacctccgmaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgahcgctccaaagtccccccgactt

SEQ ID NO: 26969 - DNA, 104 bp, Homo sapiens
cactcactaatgttaataatctttaaaaatgtcacaaatataaggattcagtcttttgttacttgatttttttttcaagtttcttcttctttctttctttcttt

SEQ ID NO: 26970 - DNA, 160 bp, Homo sapiens
aactgtgcatatgaaatgggagaggagatgccaaaacgccagatgaaagcaatcaagtttcttcttttccacttttacttatgagcgggatattgattacaaagtttttcttctttaaccaaaaaggaaagacaacggtttgtgtgcacttcccgacatc

SEQ ID NO: 26971 - DNA, 218 bp, Homo sapiens
  misc_feature 9: k=g or t
agggggaakacagcccatgtgaaggcagaggcagagactaaagtgatgcagctatgagcctaggaacgccaaggattgccagcaacttccagaaaccaggaaaatgcgtggaaggatccttcctccagagactttggagggagagtgaccctaccaacacattgattttggatttctggcctccagaactaagaggagattaggacatacagagacaa

SEQ ID NO: 26972 - DNA, 281 bp, Homo sapiens
  misc_feature 128: r=a or g
agtcccagcgcggggagggtactatcgcagcttctccgtcaggccttgggccatggcctcgctacgcaatgccaacccgaggctgaagaactacttcaaggagaactacattcctcaggtctgcgagrgcactgttatgtggtatacttgttacatgtcctgaggatccgctgaggtatttagagggaatgatcatggttataatcaaaagtggtcttcagaatcttctttgatgactccggaattgatgataaaagcctgtagcttttatactggacaca

SEQ ID NO: 26973 - DNA, 189 bp, Homo sapiens
  misc_feature 112: k=g or t
  misc_feature 120: k=g or t
  misc_feature 122: k=g or t
  misc_feature 125: r=a or g
caatattgtgttttaagtctcttgaaataattgtgtgtttataacaccaactggatacacacttatgttgtttaggtcattaattttattgatttttaaaaaattaaatgtkctgaggtkgkagratcacatgcagttgtgaaataatgtagagtgagcctagatatcttttacctgttttgccccagc

SEQ ID NO: 26974 - DNA, 252 bp, Homo sapiens
  misc_feature 18: r=a or g
  misc_feature 32: r=a or g
  misc_feature 109: r=a or g
ctgccgccggccagacargaatggactgtgtractgaatgaaatggcggggccataagccatccaaggagccgcctccgtgaagttataggctcgcggggtacaaggaraaaaaaacaatccagctccaacggtactgatgtgacaggaggttgtcacagcagagcggaagatctggcagaaagacgctgggaaagaagacactaggggaaaacatcagaaagttcggatgatgaaaactcacctcacgcca

SEQ ID NO: 26975 - DNA, 379 bp, Homo sapiens
  misc_feature 117: w=a or t
  misc_feature 301: r=a or g
  misc_feature 302: r=a or g
  misc_feature 339: m=a or c
  misc_feature 358: w=a or t
acttgaatcagaacgttgtttcctcattcctactgcttaaacaccttgacaagtcctaggggttaacaaaggttagcatggctatggtccatccctgtgctctagttagagcgtgawagacacctgactttccagttgtctctctccatgaccagcaacaggaaccactgacgctgaactttggacagtggcctcagactctggctgccagcacacaacctgccatcatcgatgttaaacatgctgacatgtgcagaggagtttcctccctgaaatgctctgaaattcacttctctgcctrrggattctgttataaaccttctgcctacattggctttmactgtggaagttgatttcwaaactctgatgagctcacaac

SEQ ID NO: 26976 - DNA, 192 bp, Homo sapiens
  misc_feature 116: w=a or t
  misc_feature 121: m=a or c
  misc_feature 126: r=a or g
agttgtactctaagtttacccttagaacagtttttctgggctatgcttcttcaagaaaagaatgaaagagtggtttctagattgaaagagtccactgagagcaaactacaaggaawaagamaggaragcaagattctgttacctgtatggtcagaatcagagaactacaatcactagaatcctcccacccat

SEQ ID NO: 26977 - DNA, 176 bp, Homo sapiens
  misc_feature 55: k=g or t
  misc_feature 104: r=a or g
acagaaaaaatagccagcaagtgttcaaactactgaggaaaaaaaaaaattagakatgctgcacttaagaatactagggcaggttaaaagagctgtttaagtargtatcagagtgctgtggagactcggaagtgtttaagctgcttaagtaagtataagtgctgtggagacccggg

SEQ ID NO: 26978 - DNA, 70 bp, Homo sapiens
attccttttagttattgggtattcgttgtatggtccagcaatttgacccctgatctctgctttttttttt

SEQ ID NO: 26979 - DNA, 228 bp, Homo sapiens
  misc_feature 13: m=a or c
  misc_feature 67: y=c or t
  misc_feature 68: y=c or t
  misc_feature 69: y=c or t
  misc_feature 70: y=c or t
acttgtatgaggmcaacagttgtgtgaatctaccctggtccttctgattattttttatttttttatyyyytattttttttgagacggagtctcgctttgtcaccaggctggagtgcagtggcatgatctcggctcactgcaacctccgtctcccaggttcaagagattctcctgtctcagcttccttagtagctgggactacaggcatgtgccaccatgccctgctct

SEQ ID NO: 26980 - DNA, 258 bp, Homo sapiens
  misc_feature 89: w=a or t
  misc_feature 153: y=c or t
  misc_feature 251: w=a or t
caaggaagaggaccatggcctggaacatcctggccctatccactatagcttgaccgagtgggctctaaggctggtttatagggaaggawagaggaaatggggtagtaattattgtgtcataggcaaaagcctcacactggctgtccccttccyctgggaaaaaattctttagcatttctctgtaaatttcattgtgattttagagcatgtgtctgaatgattacatggagtaaacgtatttcacttttttwttttttt

SEQ ID NO: 26981 - DNA, 173 bp, Homo sapiens
  misc_feature 72: s=g or c
  misc_feature 84: h=a or c or t
agatcatgagcaaacagtcctgggaactggccctctcggcacccgcccctgacccagcgggcaagagcgtascccacgtctaghgcagcctcaccttccccttcttcagactgctgaagagctccttgttctgcaaaaacttttccatctcggccttcaccagcacaccagcg

SEQ ID NO: 26982 - DNA, 259 bp, Homo sapiens
  misc_feature 199: k=g or t
  misc_feature 228: w=a or t
  misc_feature 258: m=a or c
aaccagctcttgtcaggctctccctggagtactgtgggttaccactggaggggtttgagcagagccatggcatatactgatctacgtgtatgtgtttctaagcaaaacttcttggaagaaaaggaaattcttagaagcaattagagtatcacacccatgctataccctttgattcattagcttgctctgtttttctgtkattttgaaattacccaagtggaagcagawaaactgccaggaaaatgtcacagccaccamt

SEQ ID NO: 26983 - DNA, 163 bp, Homo sapiens
taaggtgtaaggaagggatccagtttcagctttctacatagggctagccagttttcccagcactatttattaagtagggaatcctttccgcatttcttgtttttgtcaggtttgtcaaagatcagatggttgtagatgtgtggtattatttctgagggctcaa

SEQ ID NO: 26984 - DNA, 365 bp, Homo sapiens
  misc_feature 139: r=a or g
  misc_feature 141: r=a or g
  misc_feature 149: r=a or g
  misc_feature 154: m=a or c
  misc_feature 291: r=a or g
  misc_feature 314: y=c or t
atttaagaatgaattttcacttttaatacttgagaagtcaagtcaatttttgcagttgctgatttgtctgtgatgaccatggcttgatgaggccatgcctcctgggaaaaaatatacaattatttcagtttaactttargraacaaagrttgcmacctcctctctccaaagaaaacaatagaacctttagagacgtaattgccctgactaggctaaaaataccttttcctgaaagatgatgtggctaatcttttttttttctgtgtttattccaaataattatttacagarctgttgtttgagttctgtttgtyctctgtagtaaggtgtatgccaccccatattaatttctccaaacactcagt

SEQ ID NO: 26985 - DNA, 86 bp, Homo sapiens
ataccgtccactagagagcaaagcgtctctggagtctgcagcagcaggtctgacgaacgaacaagggaaggagagagcctgcacgc

SEQ ID NO: 26986 - DNA, 187 bp, Homo sapiens
  misc_feature 3: s=g or c
aasggaataaacgcacaatggcaacctgcttggggcctcttgcacacggtggaagctttgttttttagctctttgtagtaaatcttgctgctgctcgttgtttgggtccacagtgtctttatgagctgtaacactcactgcgaaggtctgcagcttcactcctgaggccagcaagaccacgaacccc

SEQ ID NO: 26987 - DNA, 426 bp, Homo sapiens
  misc_feature 122: r=a or g
  misc_feature 165: k=g or t
  misc_feature 231: d=a or g or t
  misc_feature 252: r=a or g
  misc_feature 261: k=g or t
  misc_feature 263: w=a or t
  misc_feature 276: w=a or t
gtgtgcctgaggagaaaggggtgctggttcttccttatatcccctgcctgcctcagctgggctctgacccagccagcagactggagtcctcttctgcatggtaaggaaactgaggcttagargagttatgaaattgcccagggtttcacagctgaaatgtataakgacctggacttgcaaatttggcacaaagttcttctaataagaggccataaaataaccaaatgattdtttatgtgcctatagaaccaraagaactaktwcagaatgtcagawgaaaagcacgatattccagatagcttagaaaccttggcatagtgccttcctggaaatcctggattgcatctaaaaccatgtggcagagggagaaacaacaggcaggacatcctgagaagactcaggctgggacgaaagctctgctctcca

SEQ ID NO: 26988 - DNA, 123 bp, Homo sapiens
gaaccatctgcaccacaaaaaggttaatctgataaattcaccatcaatttggtaagctttaatataactaccctgttttttgaatacagataatgcaaaagaaaaccattttatactcggcca

SEQ ID NO: 26989 - DNA, 296 bp, Homo sapiens
aagtgtagaacacggacctctgagttatgctcttgagaggtgccaaagctgggctgtttacctaccttatccacagagctctgaaagtcaagccagaaaggaaggattccaaattcttggaattttatctagaaaagaagactaagcagcttttgttcttctgtgacccagttgctggcccaagacatggacaatgaccccctggtgtttggcgtgtctggggaggaggcctctcgcttctttgcagtggagcctgacactggcgtggtgtggctccggcagccactggacagaga

SEQ ID NO: 26990 - DNA, 104 bp, Homo sapiens
cttgagaaattgggggtgggagtcctacacagaggctgcccctaccctcacctgagttgtacatttttttgtgatgggttttattttttattattttattttat

SEQ ID NO: 26991 - DNA, 128 bp, Homo sapiens
aaaataatgttgtaatgccgggcacggtggctcacacctgtaatctcagcactttgggaggccaaggagggcagatcacctgaggtcaggggttcgggagcagcctggcccacatgatgaaacccagg

SEQ ID NO: 26992 - DNA, 418 bp, Homo sapiens
  misc_feature 3: n=a, g, c or t
  misc_feature 4: r=a or g
ggnrgctcaggactgcgagactggacacgtcgggggcccagatgtttctagggagaggagcctcccagctcaggctagggaagggacaccggagcccagctcttcctgagctgacgaggcgccacccggcctttattcattattcataataaggtggggctgtggtaggcggcagtttttttgcctctttcgcacctggtccgctgaaggttctcggcttgtgaattattcacgaggggcggatcagcgtgccgaaggacgtgctgaaggggcgttctgaagtctgccgcgcaaacgagttcattgatgattcgcaaaagatgtccagctcgccgctgtccaagaaacgtcgcgtgtccgggcctgatccaaagccgggttctaactgctcccctgcccagtccgtgttgtccgaagt

SEQ ID NO: 26993 - DNA, 128 bp, Homo sapiens
ggaaagagagagaagaccaaccaaggggtggctggagtcccaaggccatgaactttcaggaaaatgtgaccctggccatggccttgttcaccatcctgacctccatctatttcttcaacaaggctcag

SEQ ID NO: 26994 - DNA, 297 bp, Homo sapiens
  misc_feature 25: r=a or g
gcatgatctgaggactcctgcacargtgactgcaggatgagtacagaatttttctataaatatactaaaataccaagtaagccaggagcagccactaggcaaacaccaaaccttgcattcctggccaaacctatcacagagctcatcagatgcagtggatccccaggttgcaagtcatataacctgagcatgcccagatgaaccaagtatgcctgattggtgaacctggaactggccagaacagaaaatgtcaaccacatgtggaatctaagtattcagattgagaaatgaggagcc

SEQ ID NO: 26995 - DNA, 174 bp, Homo sapiens
ctaccctaaatacccacaaggcttgcttctccacctttttcaagtctttgtcgcagtctcaccctcattgagattccctgatcactgcctccatcttggtcctcttgccctgctgtatttttatgaaagcctaagtacatatcttacttgattattttattttctatcccacac

SEQ ID NO: 26996 - DNA, 201 bp, Homo sapiens
aatccgggcggtgagaccacgcacgggccgggagccaggcctgcaacttaaagatgctcccggggaggcgaccagagatgtcccttcctgaccccgcttccctactccaggtagcaaaggacgtgacacttcatcaggccttgctgaggctgccccagtaccagactgatctcttgcttaccttcaatcagcccccccaac

SEQ ID NO: 26997 - DNA, 308 bp, Homo sapiens
  misc_feature 35: s=g or c
  misc_feature 129: b=c or g or t
  misc_feature 130: d=a or g or t
agccgggcgcgcgccgccacttttgcgacgcgcascatgatggtgggctccctgctggccacctatggctggtacatcgtcttcagctgcatccttctctacgtggtctttcagaagcttccgcccggbdaagagccttgaggcagaggcagctggaccgagctgcggctgctgtggaacctgatgttgttgttaaacgacaagaagctttagcagctgctcgactgaaaatgcaagaagaactaaatgcgcaagttgaaaagcataaggaaaaactgaaacaacttgaagaagaaaaaaggagacag

SEQ ID NO: 26998 - DNA, 114 bp, Homo sapiens
ttagtagaaacgaggtttcactgtgttggtcaagctggtctcgaactcctgaccccaggtgatctacctgcctcagcctcccaaaatgttgggattacagacatgcgccaccac

SEQ ID NO: 26999 - DNA, 187 bp, Homo sapiens
atacaccatggaacactacacatccataaaaatgaaatcatgtcctctgcggtaaaatggatgcaactggaagccattatcctaagtgaattaacacagaagaaaactaaatacagcatgtttctcacttataagtgggagctaaatattaggtactaatggacataaagatgggaacagtagacac

SEQ ID NO: 27000 - DNA, 408 bp, Homo sapiens
gcactggtcatgccagcctctacagatcacatctctgtctataattgggtctccatggtaatgagaagcagaaagtgctgaagtagcgcactatgtaaggactggcaagagaaaatactgtcgcggcctctacaggcatagcattgaatccccatggtgcccaagaagcccgagagaagcacgctgtggtgtagagcaggagactgaggacacggacttggcagatttattagcagcaatattctaagatgaaccaaatttaagagtttgtaagtgctcttttcaattggaaaagacctttgaaatttttttttcttttcttttaggaggccagatgctccagtgcctgatggcgaaagtgagaaaactgtagaagaaagttcagatagcgaatcttcttttagtgat

SEQ ID NO: 27001 - DNA, 80 bp, Homo sapiens
aatataaatgtactggtcaatgatacatatttttttcaaaatgaatagcgaatacatttatgtgaccaccactcagatta

SEQ ID NO: 27002 - DNA, 209 bp, Homo sapiens
  misc_feature 114: b=c or g or t
  misc_feature 115: s=g or c
agtctttagtctgaacgatgaccaatccaccacacgcacctacagtctagagacatgacctaacaccctgatgaccactctcagggaccttgagtgactggccggtgcaccatbsaacttaaagtatgggtggatggagttcagaggattgtttgtggagtcactgaagtcacaacttgccaggaggttgtcatagccttagctcaagc

SEQ ID NO: 27003 - DNA, 197 bp, Homo sapiens
  misc_feature 111: k=g or t
  misc_feature 129: r=a or g
  misc_feature 138: r=a or g
aactttggggcaggggcaagaggatggttagctgcagcaaagagagagccaaagagaagtgggattgagagcacaggggacagctggagacaaaatataaacgccgggcakgggaacagccaagaatargtgcaggarggatggggaatcacagaaacttctcaggaacccagtgaaatgagctgcaccaggaacta

SEQ ID NO: 27004 - DNA, 242 bp, Homo sapiens
ccttttcccctccggcctctgccggtgctgctgcgccctgcggagctccgaacacgtgcgcagaggctggctgtggcagatgcaactgcaggatgacttgaaagtagggcatccttcacccatctgaagggaggaaatagtggcaggtgacagtctacatgtgcagttttcagatgccttcacctgaatgacatctacctccatcaggaccccagatgtctgacagccctgtgtgacaccct

SEQ ID NO: 27005 - DNA, 285 bp, Homo sapiens
  misc_feature 150: r=a or g
aatggtgagttctcggctcactgcaacctccgcctccggggttcaagcgattctcctgcctcaggcgctggagtagctggattacaggcgctcgccatcacgcccagctaatttttgtatttttagtggagactgggtttcagcatgttrgtcaggcaggtctcgagctcctgaccttgtgatccgcccgcatcggcctcccaaagtgctgggattgcaggcgtgagcaccgcgcccggccttgtcctcatcgtcttcttttccaccctcctttctcctcctcct

SEQ ID NO: 27006 - DNA, 422 bp, Homo sapiens
  misc_feature 13: s=g or c
  misc_feature 324: d=a or g or t
  misc_feature 325: d=a or g or t
agactaggcgcasacacacgggagctactgggtctgtggaactacttggtggtcatttcccagtccctgaatatgtaattagaattattctacttagtggtaggtgcaacctctactttgtatccttggcctgtgaggtaagaaataccataatggagagagccgaggggaagccactgaaatatctctttttattgtccaaaaaagttaatcaaaacaatatctcataatcgggggtgtgtaagggagacagaaaatagtgccacctcaaagggagtaaaggttgccagggtaaatatactcctttaattcagtcaagtgttddtgtataagccgctagctgtccttgtgctactcatgtagtaagctgcattttggaaaaattttttctgatagtttttgtcatcagacaaatggtgcat

SEQ ID NO: 27007 - DNA, 83 bp, Homo sapiens
ccaactttcagaccatagcccagggcatatctcattgtgattgtttcaaaatttttaaatgtaggtgtgtttttttttttttt

SEQ ID NO: 27008 - DNA, 157 bp, Homo sapiens
  misc_feature 109: r=a or g
tttttttgagatgaagttttgctcttattacctaggctggagtgcaatggcgcaatcttggctcactgcaacctccgcctcccaggttcaagcgattctcctgcctcarcatcccaagtagttgggattacaggcgtgcaccaccatgaccagctta

SEQ ID NO: 27009 - DNA, 198 bp, Homo sapiens
actttctgagttggagaatttgtcctctgccttgactcaaatatgttagtacaaagaaaacaagaggatacttatagaagggactttttctcaattgcttaatgagttttcacaatggaaaagaaaatatttttgtttgtttgtttgtttgtttttcactggttttcttttggtttattttgttcaagatgggtccgt

SEQ ID NO: 27010 - DNA, 212 bp, Homo sapiens
aaagtagtagactacacaacagcgaaggtatgtttaaagtttaattttcatactgaatttgaaggtgttgaattatgtatgggttctgcagtaacagtaaggccacagccttttaaaaatatgtgcactagaatactgtgacagtgacaatttgtgtagcatctgtttggatccaatgaacttagttcctcacgcttcattatggatgatag

SEQ ID NO: 27011 - DNA, 81 bp, Homo sapiens
attcctggatattttgtattgttatttttgtgagctaaatctttttgtctccttttttttctttctttttttttttttttt

SEQ ID NO: 27012 - DNA, 450 bp, Homo sapiens
  misc_feature 285: n=a, g, c or t
  misc_feature 286: n=a, g, c or t
attctggcccagcttcttccccagctctatcctgcttccctccatctcctataggattctccttagagttctccctccattagtagttgtcttagggtctgtttctggggagccctgcctaagactcatgctacaagaagttaaataagtttcccgaagtcacacagctagcctctcatcccttttctactgagaggaagtggaatgcactccgacaaggataaggttttattgtgagctggccttggaattaaaccaccaccaacacacttttggattatcagnnggtggaaggagtgcaaatgccagttacggtgatgcgttcaacatccttatttccagttcagaatttccctggagctccaaatttttatgtttaatttcttactgggcaattccagttgtgtatatcaaaggcccatcagattaaaactcattatcttcccatca

SEQ ID NO: 27013 - DNA, 358 bp, Homo sapiens
gagattctcgccctgagcaacgagcgacggcctgacgtcggcggagggaagccggcccaggctcggtgaggaggcaaggttctgaggggacaggctgacctggaggaccagaggcccccggaggagcactgaaggagaagatctgccagtgggtctccattgcccagctcctgcccacactcccgcctgttgccctgaccagagtcatcatgcctcttgagcagaggagtcagcactgcaagcctgaagaaggccttgaggcccgaggagaggccctgggcctggtgggtgcgcaggctcctgctactgaggagcaggaggctgcctcctcctcttctactctagttgaagtcacccc

SEQ ID NO: 27014 - DNA, 179 bp, Homo sapiens
tataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttttttttttttttttttt

SEQ ID NO: 27015 - DNA, 313 bp, Homo sapiens
  misc_feature 25: w=a or t
acacacatccatgagggaagaatcwttcccatttaacagacaatgtaactgggcctgaatatagctcagcgacttgccccaggcccaccaggaagtggataaagccatgctcaacccagcacttcttctctctaccttccaccgatcctgcctgctcatcttccctccttggtgaagaactcaaccatctcatgctcctactaccatggttgacgaggaagctgagccaccagacagagcagtggtgacctacagagccgtgctttcatgaccatatggcctctcagccgcgggacttgccacactgtccctg

SEQ ID NO: 27016 - DNA, 189 bp, Homo sapiens
  misc_feature 173: s=g or c
  misc_feature 174: r=a or g
cagcctcacaagtagctgggattacaggtgcgtgccactaccgcctggctaatttttgtatttttagtacagatggggtttcaccttgttggccaggctggtcttataactcgtgacatcaaatgatccatccgcctcagcctcccaaagcgttggaattacaggcgtgagcsrccgctcctggcccat

SEQ ID NO: 27017 - DNA, 209 bp, Homo sapiens
acagggagattggtacattgagtccagttgttgtgttgaaacttctgtttaaaaacctccctactaagtcccagctactcaggaggctgaggcctgagaatcgcttgaacacctggaggcggaggttgcagtgaatcgagatcgagccactgcactccagcctgggcgacagagtgagactgtctaacaacaaaaacaacaccccccat

SEQ ID NO: 27018 - DNA, 198 bp, Homo sapiens
  misc_feature 109: d=a or g or t
  misc_feature 110: w=a or t
  misc_feature 111: r=a or g
taatgatgataatattattttaggttaaaaacacgtataatcacatagtcaccatgagctttaaatttgtaatccttagaattcctaagaatttagtactttgataagdwrgtttttgagatggttttcagtaaatcaactgaagatggtgattcaaattcctaggtagctgacgttacagaccctgtcctgcagtcc

SEQ ID NO: 27019 - DNA, 356 bp, Homo sapiens
aaataaacgtcagcttcctttgtggcttaccctcccgcctcctttcacattttattgtgtattctagaatgcagaaggggaatgcagaagggtaactactagaccttttcgctgctgggaaatctagttagccttgcctttttagggtataacttaaggattatttttaaatgctttaacttttcttaaatgtttcaattacatttggaatagaaacatattttaaagatcattttttatacttttaaactatagcattttagaatggaaaacaaatatttggtttttttcctaagtcatctgataattatggtaaaaatgtttaccttcatagtatataaatgaatacacacgcg

SEQ ID NO: 27020 - DNA, 217 bp, Homo sapiens
  misc_feature 129: k=g or t
  misc_feature 142: w=a or t
  misc_feature 150: w=a or t
  misc_feature 158: r=a or g
actagagaggtacaactgtgtttgagggtttgaaggcgtgcgcgcgtgtgtgtgtgtatgtgtgtgtgtgtgtccttctgaaaacatagagctattgagtacaaaaatatggccatttcctctaaattktctttcccctgtwtttttttwaaggtctraatttcctgctgctgttcacaaagatgctttttatctttaactttttgttttccccacc

SEQ ID NO: 27021 - DNA, 156 bp, Homo sapiens
agaaaattgtcaagtggcatattcaccctcctatccttttctctgatggacagggatgggctaccatccagtttaggcagtaagttctactggggatagttaggagtccgtcgggtttctgaaatggcttagaatagtaacccctctgcccccacc

SEQ ID NO: 27022 - DNA, 443 bp, Homo sapiens
catgtatgaactgaatttaaaaaaccactaaagtgatactttatacttctgttttactccctagtgggttttctttaatttggatttttgttgggatgtagcttttcctagactgtatttctgtagctctttttctctggtgtattcatggaaagcatctactgccgcacgacactagtactgtgccttctttcactgccttctgctctgcagctctcacccagcttggctgcttcaagtctgtgcagttgacttggctgtactgaaaagtgaacagcatggattaactcatcctgctgctgagggcagtgcaaacaggtgcttattagaggtagtgacttgcttaattagtgacactcttaatttctactatggataatttcaaagtagaatcactctatgcttagagttttggcaccaatgctgtagggcagcagaatcta

SEQ ID NO: 27023 - DNA, 299 bp, Homo sapiens
tatgagggaggttaatccaggaaaacaaaaagtagtacaagaaaagaaatgttaagcacagtataccacatgagcaaacctatgtagataatctaatagttccgtcagttgcagacccttccatgtgtttcaatttggactagttcctatttttagatcccatgtattccttgcgtgtttgttttagtggaacacattctataacatcctctgaggatgttttcatgggaattaagtttcttttaaatgcaagccagtatttctatttagtagggtttcccatttggtgatgagcagct

SEQ ID NO: 27024 - DNA, 394 bp, Homo sapiens
  misc_feature 342: r=a or g
  misc_feature 343: n=a, g, c or t
caaagctagtttctgcttctgagacattttagtgtctgccaggaactcagaatttagaagagaaaaaagaagaggaaaggaaaaaatcgacaatggagcagtctgcgcgggcggtggggagaaagatgagagtctttgaggaattgggatttttctgtggactttggagctccttggggcccaccacaaagaccaacatgtggccggcggcacagggaataacacccctgggaggcccttagaacacagctcaggttacccacatttgaggagagacaatgggagggacggcctgcgatcccttgggccagctgagggacagggctggaactgtggttccarnccctggctgcataatgcaatcgtcaggacatttcaaaaaaatgcagatgct

SEQ ID NO: 27025 - DNA, 170 bp, Homo sapiens
  misc_feature 162: s=g or c
  misc_feature 170: s=g or c
agtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagctascgcgccas

SEQ ID NO: 27026 - DNA, 245 bp, Homo sapiens
  misc_feature 88: r=a or g
atagttttaggaggagtgaaggtggccaaaaaaaattttttggagttatacattgaaatgtttgtaaaagaaatgactgacgtctgaratttgcttcagagtaatctgggatgagggaaggggaggagggcgtggatggaataaggttggctgagacttgactgctgaagccaggcttattgtaccacacgctccgttcctatgtgtgcttgaagcttttcacaataaaaagaaaaaagaggcaa

SEQ ID NO: 27027 - DNA, 120 bp, Homo sapiens
  misc_feature 13: s=g or c
agtctcgcgagcscggagcgtggcacgtgggttggtaactgtggcgctgctccctccaccacagacccctgtcctcctcaggccccctccgcctccacccctgccctcctcaggccccag

SEQ ID NO: 27028 - DNA, 354 bp, Homo sapiens
  misc_feature 12: s=g or c
  misc_feature 347: k=g or t
gacagagtctcsctctgttgcccaggctggagtgcagtgatgcaatctcagctcactacaacctccacctcccgggttcaagccattctcctgcttcagcctcctgagtagctgggattacaggtgcgcaccacacccagctaatattttgtatttttagtagagacgggtttttcaccatgttggtcaggctggtctcagactcctgacctcatgatttgcctgccttgggcagattataggcgtgagccactgtgcctggcctgtatactatagttctttgaatgactcctttcaatagttgtgctttgccattggctctgattcagttttctttttcttctctkttccttt

SEQ ID NO: 27029 - DNA, 299 bp, Homo sapiens
  misc_feature 12: s=g or c
  misc_feature 243: s=g or c
  misc_feature 244: m=a or c
caatataacaastggataaaacagcctctcctctcaagaagcttataaaccagtagaggaaaaatagcagcttcactatatgtggaaatagcggcttcactcttagagtcaattgtcataattccctaaactagaaaagaagaaggcaatgattcttacaggggtaatctgtaaaggctttatcaggaaagatttttgctaggccccgaagatcgacactgtttcagtaagtgaagatagagsmgagagcactccagggaaaggtgttgccaggagcaaagcacctgtccgtgaccgtc

SEQ ID NO: 27030 - DNA, 161 bp, Homo sapiens
tataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttt

SEQ ID NO: 27031 - DNA, 444 bp, Homo sapiens
  misc_feature 12: m=a or c
  misc_feature 387: k=g or t
  misc_feature 389: b=c or g or t
  misc_feature 401: r=a or g
  misc_feature 425: m=a or c
ttattgttgggmcaggtgccatttaaattgcctccatgctccccatttgcacctagctggatcaagttgggaggctgagcaaactcatattccagttagttggagtttttaaaggctctgtttgcctggagaagcaaggaggttagaatgtaatttttttaagcgtttgcactatttagagtcctaagcccctcatgttcagctgtgctgtgtttctactgaccaagcaggagagccagcagcacttccagcatttgggaatggaagagatttcttctgtagtggataattacagcctcatagcccctgtgcagccttcgtcatgggactcagtgactcatggatatagcatcagccatggcaggaatgcacaggactgtggcattkgbggcatcaaatcrccctagtgccatgtttggttatgmgattgtaaattattcgctc

SEQ ID NO: 27032 - DNA, 406 bp, Homo sapiens
  misc_feature 12: y=c or t
  misc_feature 17: v=a or c or g
  misc_feature 61: s=g or c
  misc_feature 70: s=g or c
  misc_feature 71: s=g or c
  misc_feature 208: s=g or c
  misc_feature 209: m=a or c
  misc_feature 263: w=a or t
  misc_feature 350: m=a or c
  misc_feature 366: m=a or c
  misc_feature 372: s=g or c
tctagtgtgtgyttttvctgtgctttattacagtactcacttttcagttatcaagccagtsagcagatassagatcctgccattaattaataaagtataccaaaaaattagttgctataaagacacaataattggccaggtgctgtggctcacacctgtaatcccagcactttgtgaggctgaggcagatggatcatttgaggtcagsmgtttgagactatcccggccaacatggtgaaacactgtctctactaaaaatacawaaattagctgtacatggtggcgagcgcctgtagtcccagctacttgggaggctgaggcacaagaattgcttgaacccagaaggcggmgtttgcactgagcagmgatcasaccactgctctccaacctggatgacagagcgaga

SEQ ID NO: 27033 - DNA, 324 bp, Homo sapiens
attttttcctgatgtagacaaaattccatcaactgagttttgcttctgggcccagacttcagacttcctgctgagagaaataccaggggctctgattcttcctcaaactcaccaccactaaactgaaatgcttgcttgaggcttcacaattgttatttcctgcctcaggttaaaatgtgtgaattttttcatttttaaaaggacacattcagaacatagagtgtgtagataacctgcactgcaagagaataatcttttgatacttttctggtagatcttataaattctgatccaaaaatttgatgtagcaaagatatgaggcac

SEQ ID NO: 27034 - DNA, 253 bp, Homo sapiens
  misc_feature 21: s=g or c
  misc_feature 41: y=c or t
  misc_feature 43: s=g or c
  misc_feature 85: s=g or c
  misc_feature 87: s=g or c
  misc_feature 88: m=a or c
  misc_feature 122: k=g or t
  misc_feature 210: r=a or g
  misc_feature 215: r=a or g
cttttagataaatcaaatgasccatcagtgaggcagcagtyasttcaaggatatgatatgttaatgaatccaaagaagatgggasasmgatttaacttttttgccttgctacctcatcagakacttcaaggtggaagatatcagaggaatgcacgtcagtcaaaaccctttgcatccgttgtagctgggtttagtgaacttgcttggcartgatrtttcagcttggacattttacccttcagtcggccccaaa

SEQ ID NO: 27035 - DNA, 458 bp, Homo sapiens
  misc_feature 1: h=a or c or t
  misc_feature 280: s=g or c
  misc_feature 281: m=a or c
  misc_feature 371: b=c or g or t
  misc_feature 389: w=a or t
  misc_feature 405: n=a, g, c or t
  misc_feature 407: y=c or t
  misc_feature 424: s=g or c
hgatgtctcagaaaaagtgtttctttagccctctccctgacttgcatcctcatgagactcttaaaccccctcctgaccttcagagatgtttatcatcagagatgggttatggaagtgatcctatagaacctgagagattgcttaactcaaactctgcttctacattagagtgtcttctgaaaaatgacctcaacaaaatttgctatctacctatttactaacataaatgaggaaaccaaaaaggtcaacggtgaggcaggaaggtttcagttcagtggasmaaagaaaatcttgatgaaatgtcattaacttccatatttggaataagctataaaagcttgtcgaaggtctaatttatgtgcaagactgabagctgtttaaacggatawtgcctccttcatgagnaygccacccctttatgctscattaagttcagacgttgactctataagctacgt

SEQ ID NO: 27036 - DNA, 279 bp, Homo sapiens
  misc_feature 12: s=g or c
  misc_feature 174: m=a or c
  misc_feature 177: b=c or g or t
  misc_feature 196: m=a or c
  misc_feature 213: m=a or c
  misc_feature 271: m=a or c
aaattcttccasaatgctaatgtaaatctaatcagcctttagaatttaaaggcttaaaaaagactaaagaaaagtaacaaccaaatgcaatatgtagaacttatatggagcctgattcgaacatcaagtataaagagatatttttgagaaaattgagaaattttaaaacatgamatbagtattatatgatattgamgactgctgctttttcamgacatgtcctcaaatttattttacattccttccatactaactcttctccttgcatgtmgacagaca

SEQ ID NO: 27037 - DNA, 189 bp, Homo sapiens
  misc_feature 12: s=g or c
  misc_feature 164: s=g or c
  misc_feature 173: b=c or g or t
cagcctcacaastagctgggattacaggtgcgtgccactaccgcctggctaatttttgtatttttagtacagatggggtttcaccttgttggccaggctggtcttataactcgtgacatcaaatgatccatccgcctcagcctcccaaagcgttggaattacasgcgtgagcbaccgctcctggcccat

SEQ ID NO: 27038 - DNA, 222 bp, Homo sapiens
  misc_feature 4: y=c or t
gatyttataatcttgctacaaagaaagtaggacagtctcagcctttaagaatgtcactataacagttttttttttccttaaggatattttaaacaggaaagtagacaaccgggtaagcatggagtttgctcatgctgccgaatgtgtgtcttttgccctaaatgaaacgcacgttcttctaaatttagccctatcacattttaacaattgtggcctcgcagt

SEQ ID NO: 27039 - DNA, 233 bp, Homo sapiens
  misc_feature 4: s=g or c
taastaatttgactgtttttgaagtatggaattggttcttgtattctcatgaaatatggaaaaagatgtttcaacttctgacaaacatgatggaaagctgctagaagttttcatgcaattcctttagccataaattttgaatcagtgtagggccttgaaagccactgcaaaattttaaataaagtcaccagaggaattatccagtagatactgattcctcttttttttttttt

SEQ ID NO: 27040 - DNA, 141 bp, Homo sapiens
  misc_feature 40: n=a, g, c or t
  misc_feature 65: r=a or g
  misc_feature 91: r=a or g
aactttctataaatgccacacaacatgttctgtgcagccncgtctcccaccgttgtgtcagcggrtaagttgccgtgttccgagacaccarcctcacatggccgcacggaaagggagcacccatttgcggcttgtgcctgc

SEQ ID NO: 27041 - DNA, 215 bp, Homo sapiens
agcctgagtgctggctgaactgagaggaacagggttggtgcctggcactggtgttgctccattcatctctgaggtctcacagccccagcatgagtccatcagcaaagaagaggcccaagaacagcagggtttccaagatgcaagatgagaaactgcgggacgagacagagcagcctgtgagcaaagtaattgagcggaaccgtctgagaacggcg

SEQ ID NO: 27042 - DNA, 182 bp, Homo sapiens
taagaaacaaaagcaaggtagaggactaggaagtgtttgagagtttgcgattttagacagggcagttaagagaagacctccctgaggaggtgcatgttaggtaactatctgaaggaaatgaattagtgaaccatgcagatatctagagaaaagcatcttggatagagataatagcaggtaca

SEQ ID NO: 27043 - DNA, 305 bp, Homo sapiens
actctttctttacgtagggtataaagattttacaaaataatgaataaactgtactcatcattttgaaggaaaaatctggtctattcatgaatattttaagatttaaaaatttttcactcttttaaacctttctgaaaataccaatttctgttcagtagaaataaaaattctccagcctggccaatatggtgaaaccctgtctctactaaaaatacaaaaaaaaaattagttgggcgtggtggcgcacgtctgtggtcccacctgcttgggaagctgaggcaggagaattgcttggacccgggcat

SEQ ID NO: 27044 - DNA, 360 bp, Homo sapiens
  misc_feature 20: r=a or g
cttaattctcttttgctgtrcaatgtaacattcacaaattcaagggattaaaatgtggacatcttggaggaccattgttccatgtaccatagctaagtaaatgctagtttattactttttatttgaaaatttctttttctagacctccatgatacaatactgttctctctttctatcacagctacatactacttcattcaccccatcaataaaggttggaagtctcattaggctcagtcctatatcttctccttttttttgctctgtattttcttcctaggtaatcacattcttatccattgctcaaactactctgtgttcatagatgactcacagatttatgtcatatctccaaaccag

SEQ ID NO: 27045 - DNA, 208 bp, Homo sapiens
tccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccagg

SEQ ID NO: 27046 - DNA, 315 bp, Homo sapiens
  misc_feature 66: w=a or t
  misc_feature 67: w=a or t
tatgcgatgattgttgtaaatgcaatgccgtagtttggattaataagtggatggtttttgtttctwwaaagaaaaaaaaatcagtgttcacccttatagagacatagtcaagttcatgttgataataatcaaaggaattactctcttcttgttaaattagctaaatcatgtaaccgcagataggaagggctcgcctggggaaactctggtttccgatgggacaggaaagtcatacgggcaacagtatgcggaaagtacgttttttaagtaaaaaacaaaggcaaactttgtactctccagttatctaaggaactc

SEQ ID NO: 27047 - DNA, 136 bp, Homo sapiens
  misc_feature 30: y=c or t
  misc_feature 40: d=a or g or t
caacgggggggatgaactgttggtgggatyaatgggagtdcccagtgttggggctcatagtaggttgaatgccatctacaatgaaaaaacattcaccaaggcctccagtacatcacaaaccttttttttttttttt

SEQ ID NO: 27048 - DNA, 122 bp, Homo sapiens
taaatcatgctgctataaagacacatgcacacgtatgtttatttcggcactattcacaatagcaaagacttggaaccaacccaaatgtccaacaatgatagactggattaagaaaatgtggc

SEQ ID NO: 27049 - DNA, 154 bp, Homo sapiens
  misc_feature 136: w=a or t
tcttctgatggcagggcgcccctgtcccccagcttgtggttctgtgggtctctcctggtctcggcctcagctgctgccctgagtctctgtccctgccctttctaggtctccgtctccctttctctgggtctctgtwgccctctctctgagcctt

SEQ ID NO: 27050 - DNA, 243 bp, Homo sapiens
  misc_feature 148: b=c or g or t
agagggactcctgagctgcccacatggcctaagatgtgggtcctggatccttcccccttctcaccataaccccctctcagtgtttccccaacttctcccttttagcagggtccctttagagcccaactccaggtcaaatctggagctbaaatcccagtgctccctccccaggagtggggccccaactcttccaagataccagcattcctcaagtcctcccaaaacttcctacccacaccctgt

SEQ ID NO: 27051 - DNA, 333 bp, Homo sapiens
  misc_feature 16: y=c or t
  misc_feature 27: w=a or t
  misc_feature 50: k=g or t
  misc_feature 67: w=a or t
  misc_feature 83: w=a or t
  misc_feature 84: w=a or t
aaatgtgggggaggaytacaaagtcawagtcatctgtattaataatcctktagccagcaggtctcawagaaatatttctggawwggatagggaagctgatgtcagggcggggcagtcctcagagcagtgagtctaagtggatattgcttggctgaggctataggttaaggggcagccttatcacctgggaacatctgcagatgaactaaagccaggaggatgcctaaacccaggggctaggagcagagaagagatgaggaaacaggagaggaggcaaagggaatttttcagttaaatcagtcagggaatcatagtggtgctgatttttttttt

SEQ ID NO: 27052 - DNA, 220 bp, Homo sapiens
aagaaggaatgattcatatatttttgtgcatacacattttaaatcctgattcccatgatcaggtgggaaggtaccattttcaattcctactggaagggaggggttcttaatatggtcagaatcctttgttgaaatgaccttggttaccttgggtatcttctatggtaggagtacaaagtagtatacatgggattaaattttaaaacaattaggcccccaa

SEQ ID NO: 27053 - DNA, 406 bp, Homo sapiens
cattgaagtctctttggaaccataaataatatagctgactgggtggtattattttaactgggctctcataagcttcactaggaaatgccacaaatgatttaactttttcacacaacctgtcctgtaagttctcagccatgtcgtcatcttgttgagcaaccagcgtttctgtttagtcttccatttgcaaatacttgtttttgttcaaggtatgaatttctctatcctcagtagattctcttttgtaaactcaccattaataaaaggtttcaatgcatgagcaatattttctccttctccataacttcatttcacagttgtgtcatttgttttatttgctttgaaaaataaaacatgttaaaacatcagtactttcttttagatcgttaagtttcctaccagccgt

SEQ ID NO: 27054 - DNA, 171 bp, Homo sapiens
  misc_feature 16: k=g or t
aggagccgccggcaakggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaaccgg

SEQ ID NO: 27055 - DNA, 149 bp, Homo sapiens
  misc_feature 17: w=a or t
  misc_feature 85: k=g or t
atagaaagttgggagawaggtctactccaggatcaaggaactggaccaacaggacccaagggagagtatcaaaggcaaaacaaakgaaaatgaggacaacccaatactcagaaaaaaaaacgagtaattcatggattcacaacggcgcg

SEQ ID NO: 27056 - DNA, 216 bp, Homo sapiens
gaagttgagtggatcaagaaggctggacctgcttggcgaagaccgcgatgtcctcgttgaaggagtcggaggagcagacgtctccgccagccactccaggttcccggggagtgcaggtcgccagctcgcacttctcaaagaccagagctaacagaggaaacaacgggtgcctaacgggcagcgccacgcagagacacacacacagagacggggtcg

SEQ ID NO: 27057 - DNA, 117 bp, Homo sapiens
attttttttgtggcggagtctcgctgtgtcgcccaggctggagtgcagtggcgcgatcttggctcactggaagctccgcctcctgggtccatgccattctcctgcctctgccccccg

SEQ ID NO: 27058 - DNA, 147 bp, Homo sapiens
cacaattaaataaaatagcacatgtaaagtgcctgatagttggtgcacaataaatattaagtttcattacgccttgatgctccaaatcagaaaactcaaaaggccttgacctcttccagcccttgtggtcagcagttctctccaccc

SEQ ID NO: 27059 - DNA, 165 bp, Homo sapiens
atgagctggatatggtggtgcatgcctacatgggaggctgaggtgggaggatggaacgagcctggaaggtggaggctgcaatgagctgagatcacatcactgcactccagcctgggcaacagagaccccatctcaaaaataacaacaacaacaaattctagcgag

SEQ ID NO: 27060 - DNA, 175 bp, Homo sapiens
taatgtaaatatttgctttattacacatgtcagtcctgtgtgtccattatatcttttgccatttaatgccataactctttcatcagagatggcagccacagtcacagaggaaacttgtggaaaacccaagatctgtcatctgcaaatagaatgctttctcttgaggcacctggac

SEQ ID NO: 27061 - DNA, 173 bp, Homo sapiens
tttgctcagtcgatcacgaccctctcacgtggacccccttagagttgttagcccttaaaagggacagaagttgagcacctgaggagctcagattttaagacgctaggctgctgatgctcccagctgattaaagccactcccttcactatctcggtgtctcctgtccgcggctc

SEQ ID NO: 27062 - DNA, 295 bp, Homo sapiens
  misc_feature 97: k=g or t
  misc_feature 98: k=g or t
atttgctagccatatttttaaatcagggttgaactgacaaaaataatttaaagacgtttacttcccttgaactttgaacctgtgaaatgctttacckkgtttacaatttggcaaagttgcagtttgttcttgtttttagtttagttttgttttggtgttttgatacctgtactgtgttcttcacagaccctttgtagcgtggtcaggtctgctgtaacatttcccaccaactctcttgctgtccacatcaacagctaaatcatttattcatatggatctctaccatccccacgcc

SEQ ID NO: 27063 - DNA, 296 bp, Homo sapiens
  misc_feature 276: k=g or t
taactttatctctttactatcagttcatcaaaaatattctgtgaaaaaacattttatacttttactgtactaaagttaagctcttcttattctgagtcacaatctggacccatttaactactttagctttattttctattgtgctatattctctagctgttttttctcctcctgtgctggagaaactttttactccttgtttcagagcaagtcaaacttccacttcctggtgtcatgccttggtctctgagctccaatctcatgaatttctgagtkatttctgttttccacctgca

SEQ ID NO: 27064 - DNA, 200 bp, Homo sapiens
  misc_feature 12: w=a or t
acctaatggtgwtgcagtcttagatcatagttttatttatatttattgactcttgagttgtttttgtatattggttttatgatgacgtacaagtagttctgtatttgaaagtgcctttgcagctcagaaccacagcaacgatcacaaatgactttattatttattttttttaattgtatttttgttgttggggaaggggt

SEQ ID NO: 27065 - DNA, 213 bp, Homo sapiens
tgtattttttgtttgtttgtttcaaatttcatgtagttctgctctgatcttggtaatttcctttcttctgctgggtaatttcctttcttgtgtctctagctccttgaggtgtgaccttagaatgtcagtttgtgctcttgcagtcttgttaaggtaggcatttacggctataaattttcctcttagcactgcctttgctgtatcccagaggtc

SEQ ID NO: 27066 - DNA, 98 bp, Homo sapiens
  misc_feature 15: w=a or t
  misc_feature 74: s=g or c
tgttgtttttctggwacttacttatggtaaccttttatttattttctaatataatgggggagtttcgtactgasgtgtaaagggatttatatggggca

SEQ ID NO: 27067 - DNA, 184 bp, Homo sapiens
ttgtgtttttagtagagacagggtttcaccatgttagccaggatggtcttgatctcctgacctcgtgatccacccgcctcggcctcccaaagtgcttggatggaaagtttttttaaattaactttcttttcttatgaaaaattatctgtcgtttgaaaagtatataaaaaagcaggaaggaaat

SEQ ID NO: 27068 - DNA, 159 bp, Homo sapiens
aagaatggaaatagggccaggcatggtagctcatgcttgtaatcccaacatgggtggattgcttgagcccaggagttcgagaccagcctgggcaacatagtgagacccctgtctctgcaaaaaaatacaagaatcagggcaatggtggcactagcctgt

SEQ ID NO: 27069 - DNA, 220 bp, Homo sapiens
ccattccattccattctattccaattctcttgattccattccattccattgcattccattccggtccaatccattccactccactccaattcactcctctccactccactgcattccatttcactcctctccattccattacattcatttccattctacatcactcaattatatttcactccattccattccaccccattccattcctctccactccctc

SEQ ID NO: 27070 - DNA, 243 bp, Homo sapiens
  misc_feature 134: m=a or c
gtagacactatcctgtgtcattaaacactaaaagcagtgttttgtaaagcaatctcaggtgtatcaatccctcatcggctggcgcagacctccagccatccatttcctaagtttaacagaggaactaaaattcmaagacccaattccacagtcgttgctgagcataagcacttcagccatcatctcctctgcgatgaagtggtcattctctgagggtcacgatcaagcaaaaacttcctattt

SEQ ID NO: 27071 - DNA, 176 bp, Homo sapiens
  misc_feature 123: r=a or g
  misc_feature 126: w=a or t
tacagcaataaagagatgagctcaaaaaagaattggctatttgcaagtagaaaaggaatttaattatttaatttgaaaggaaattaagagagcacagaaattcagtacttgcaggtttggaargawacaagtgattctcatttccagatggtaaaagagaaaactgagaaggcctt

SEQ ID NO: 27072 - DNA, 225 bp, Homo sapiens
  misc_feature 53: w=a or t
  misc_feature 215: r=a or g
acagtcgatcctggactcatggtacaagactctttccactctctgagagcccwgagtcctgagaagatggaaacaaggaggccaaggcaggtgaattgcttgagtccaggagtttgagaccagcctgagcaacatggtgaaactctgtctctacaaaaaacaaaaaaaatccagcgtggaggcatgcacctgtggtttcagctactcaagaagtraggcaggaag

SEQ ID NO: 27073 - DNA, 159 bp, Homo sapiens
  misc_feature 155: n=a, g, c or t
gtaactggggaagtttctgggcccagaagaaaatgtaggtagtcttagggttaggtagcagctgtcaggaacttgcccctgcccataagatcctaaagggcccccatttgactctcaccagacagttagaacttgtttcctcctccgtgtcagcnagag

SEQ ID NO: 27074 - DNA, 88 bp, Homo sapiens
atgttggagctttaaagatacagctgtatcaggccaggcgtggtgactcatgcctgtaatcccagcactttgggagaccgaggaaggc

SEQ ID NO: 27075 - DNA, 182 bp, Homo sapiens
aaaattatttctttcaggttcctttcaaatgaccgaactaagagaactccaaaaggaagctattaacatttactgaaatagtctgtggttctctatacaacatggacaaaacatacaagctgttgtctaagaaatgcaggtcatggtgcacattaatcaacaggttcttctccccccgcccg

SEQ ID NO: 27076 - DNA, 107 bp, Homo sapiens
aacatttgcatttgctggacaattgcaattttttttaaaaaattcccctacccctgtttaaagctgaaaaatacatttggttcatgtgcattgtttacaaagcgcaa

SEQ ID NO: 27077 - DNA, 53 bp, Homo sapiens
ctatactttaagatttttgagttagtaagttacctttttgctttttttttttt

SEQ ID NO: 27078 - DNA, 242 bp, Homo sapiens
ccactcttcttccatcttgtacacaaggatatcatgagttttgtttaaagcactactgaaaccaagataaactctggcttagcatgcccctgacggatcagtgtagtaatcttatcaaaaccaagattacctaaaagcactaaccaaaggaaaagctccctcacctcaacctatgactgctcacatttttcagattgaatcatttcaattgtattttaaggttcattgactctttaccacct

SEQ ID NO: 27079 - DNA, 180 bp, Homo sapiens
attctgtttcaggaatacgagaagattcgatggcctatgagagtcctcacagaatatttttatgaaaaggtgcgttataaaggctattatcgtattttgttctcagcggaggggttccgaaggttatgaacctttattaactaacgcaagaatggtttattcctaaaaagtagtcccatg

SEQ ID NO: 27080 - DNA, 182 bp, Homo sapiens
  misc_feature 131: m=a or c
actaaaaatagaaaaattagctgggcgtggtggtgcacacctgtgatcccagctgtgtgggaggctgagatgggaggatcacttgagcttgggaggcggaggttgcagtgagctgagatggagccactgcmctccagcctgggtaacagagcaagactgtcttttttctttttttttttttt

SEQ ID NO: 27081 - DNA, 248 bp, Homo sapiens
acagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagctcaaagagagcaacggcacaaaactagaagac

SEQ ID NO: 27082 - DNA, 219 bp, Homo sapiens
taaaaaatattggcaactaagttaaaattcaagtgaatttagacccagcagaagacatggatggacctgatttggtccactgactaccagtttgttaacctgtgctttataagatttgaaggaaaggcattcatggtaattacagacggtgccaccagaaaatgctcttgctaaatgcagccagtagttagattgcttctttctccagtctcccccggc

SEQ ID NO: 27083 - DNA, 214 bp, Homo sapiens
gatatggaggcggggaacccaaaacaccaagagcagtgggtgcttaggaagccacagagctgggagtagagccccagcagcctgatccagagcccctgttcttcaccaccaccctgccctcctccagggagcacaatgggggtcccggagcctctttccatctgttggatctcggtgagaggtgtaccttgaaagacttttaacatacgcagag

SEQ ID NO: 27084 - DNA, 280 bp, Homo sapiens
actcaatgtcatacaaatgccctgctttctaaagcagcacatggtttaagggatgggagaagagagattctggaaagggttaaatccctgtgcctgtggacactgcctgcacctgcagaccacctccatctgaagacggagtctcgccctgtcgcccaggctgagtgcagtggcgtgatctcgggtcactgcaacctccgcctcccaggttcactccattctcctgcctcagcctcctgagtagctagaactacgggcacctaccaccatgcctggcaat

SEQ ID NO: 27085 - DNA, 122 bp, Homo sapiens
cagatgagaccccagccccagctgacaccttgattgaagccttgtgagagaccctgaagcagagaaaccagctaggccttgcctggattcctgatccacaaactgcttttgtgatgccccaa

SEQ ID NO: 27086 - DNA, 166 bp, Homo sapiens
  misc_feature 107: k=g or t
aaaaactccttaacatggatgaacataatcacttcgcttcttgatttcttaatacctgctttctttctcccttgttaatcccaatagaatatcctgcaaagccagtkaaagctcctcacttgaagaatcactgattagcagatttcactgtgtgcttacttcagaa

SEQ ID NO: 27087 - DNA, 280 bp, Homo sapiens
  misc_feature 38: d=a or g or t
  misc_feature 90: w=a or t
  misc_feature 95: w=a or t
  misc_feature 96: r=a or g
  misc_feature 107: m=a or c
  misc_feature 115: k=g or t
  misc_feature 116: w=a or t
  misc_feature 117: r=a or g
  misc_feature 119: w=a or t
  misc_feature 226: r=a or g
  misc_feature 236: r=a or g
gcgtcgcccggtgtccgggccttcggggcggggggcadcgtccccgctttccatctactcaatcctcgggcccgtgggcagaagccattwctttwrtttgtgggccmgggcacckwrcwgggcctttctctattccccaccggctcaggacccctccagcttgtccttgctgactcgggacctagggccatgctgggagagggcatggctggatctgggaggcgargggcggggargtgttagagagttcctccttccccaccctcgcccgactcgcccc

SEQ ID NO: 27088 - DNA, 154 bp, Homo sapiens
aaaaataggttcttactaactataatgtcagtgattggaaataagggctggaaggcaaagaacatataattttaagctaaatccaatcctgatttattactacaccaattaccagagagcttgcaggctcctgcattatgccaacacagggtgg

SEQ ID NO: 27089 - DNA, 349 bp, Homo sapiens
  misc_feature 18: r=a or g
  misc_feature 27: r=a or g
  misc_feature 69: r=a or g
  misc_feature 134: d=a or g or t
  misc_feature 135: d=a or g or t
  misc_feature 136: s=g or c
  misc_feature 140: n=a, g, c or t
  misc_feature 148: r=a or g
  misc_feature 149: k=g or t
  misc_feature 225: k=g or t
  misc_feature 226: k=g or t
  misc_feature 244: r=a or g
  misc_feature 348: m=a or c
  misc_feature 349: m=a or c
taaacaaaggaatctcartcacaccaraccaacctttttatttcctgctctctcccctcttttgtgaaracagcgggtccaaatgtgattcaaacaactgtacggagtggcatattagaattgccctaaactgddstgcnaataattrkgtgtgtatgtatatgtgtgggaaagagaatgtactgtatatgtgtatgttatacagacatatacacatacatacakkgacccacaggacattgtraaatattatcacatgacatcttaagtagaaataagtagggacttttattccatcctttttttcacgtttacattttaattattacaagttgctcctgccccctmm

SEQ ID NO: 27090 - DNA, 279 bp, Homo sapiens
aacttactgggaatgcagaccagcaggtctcagccttattttacccagcccccattcaccatggagttgctctggttcacatgccactgacgaggtggtcagggaaggcaattcctggaaagaattttggagaaaataatagaagaaagccagagctccaataatttaccctcatctcgtgaagaaggcagggctgagacccgaaagcccacacagggaaaacgacatgcctaaaattttctgcctgttgcggacagatcaaagattagaacccacgcc

SEQ ID NO: 27091 - DNA, 157 bp, Homo sapiens
aagactatactttcagggatcatttctatagtgtgttactagagaagtttctctgaacgtgtagagcaccgatacctagctgcagatagctcccaaagagaaatcagtgtgtctctttcaccatcagctcctcccctttcaccaccagctcctctcc

SEQ ID NO: 27092 - DNA, 277 bp, Homo sapiens
gtataccatattactgtactgaatactgcctggtaactgtaacatggtgcgtctgagaatatctagacatagaaaaggtacagtaaaaatacagtataaaagattttttaaaatcatatgcctatatagggcacttactatgaatggagcttacaggactggaagctgctctggacaacaggaaaccactgaaagctttgataagaatggaggacgatattaagaaattaatgttcttgaagaatgaatgtgatctcaaaaagcagaaacaacccct

SEQ ID NO: 27093 - DNA, 419 bp, Homo sapiens
gataaccacagtgagcaccaaagccaaatgccaaaaaccaaaaaggatggcaagaatcaaccacaggggacatcagaggaccacaggtggaggagaagaggcgaaagtggaagcaacacaggattactctggatgctatgctgagaagaaactgaagacaatggtggaagtgggaaagcttatgactcagaataactatttctaataacaaattttaagttctcttcatggtattaagaagagagaaagaatctgagaaattatggcgtactcaactgtggacagctgaaagtctggcatagcgtgccctcatcatcacaaatgggctcgcattacaagctacacttatttgacaactatcagcatttgtcaaccggcactcagatttgaagactcatttcacagctggagcaagagaa

SEQ ID NO: 27094 - DNA, 274 bp, Homo sapiens
aaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctc

SEQ ID NO: 27095 - DNA, 181 bp, Homo sapiens
ttcaagatggaagagtaatggtcatatgtatcagatgtcaacagaaagagccaaactttgtaaaataattgaagaggtttattctgagccacatatgagtgaccatgacctcaagagatcctgagaacctgtgcccaaggtggttgggttacaacttgattttatatttttaaggagcgta

SEQ ID NO: 27096 - DNA, 89 bp, Homo sapiens
acttcttgttggagccggcaataggcaaagtgtgttctgtgaaatccgcagagccgagattgactacgttccgggaatgagagggctgt

SEQ ID NO: 27097 - DNA, 161 bp, Homo sapiens
aaaaagtcacagaagaatgtggagacacttagcaaaacggactctcataaggaacttccattttctcaacaactgctcttccaagatgctgcctcatttcagagccatgttttactcatgagctggtcctgtccagaaaacagccaatgctcattcccgac

SEQ ID NO: 27098 - DNA, 277 bp, Homo sapiens
aagcactcaggaacaggatcatgtgaaacaataccttgcccaggtcacggctacgtcaggtatcagcactttgcttatttccggccgaagcccaggatccaagtaaattctagtgggcaagaggaagagaagagaaactacaacatcattatcttactgctggaggcagcagattacggacccctgactgtgatgtgtcaaatgcactgtgtgacaaccaagaccctacacatctggggggcacttcaggattcctccaggcggcagttgctggcca

SEQ ID NO: 27099 - DNA, 206 bp, Homo sapiens
catattttgatatttttacataacagtattccatcttgtcttaaccaccacagagccctataaaatataatggtggaaatattacttgccatgataaaactggtgaaaaataggaattgagaatttaggtggttttcaaaactgtgtgcatattacaaagcttgtatacaactgtgtctcttggagcaccatttttctgccagcgg

SEQ ID NO: 27100 - DNA, 425 bp, Homo sapiens
  misc_feature 73: v=a or c or g
  misc_feature 162: w=a or t
  misc_feature 163: w=a or t
ggcggtccgcactggcgggtgccctctcccgaggggaactgaggcggggcgcctgccaccattcgtgattttvcgtgactcaccctctcaacagtgtcccgtcagcccccgctttctggaattaagatgattttccatgggcattatagtcagaggaggttwwctgtgagacatctgggaaaggtgactcaatgatcactcatattgttctatgatgttatacatttaaccggaatactggtgaacagcttttatatcttggaattttttcccatttttgaatcagaaatttaggaccaagaatcttctgtcacagaacctattactttgaggagtgaacttatattaacggtgctaaaccgtacatgaacgacttggtagatgaaaactttggaaaataggaacatttcatgtcatcacatgta

SEQ ID NO: 27101 - DNA, 139 bp, Homo sapiens
atttagttttctgagattgcaaatttaaaaatttttaggctttaatctttgaatcacaaattattctaacataatgtaccttatctaggaaaggaagaaaatgttgtttgtttttactttctttttatataaaagctgc

SEQ ID NO: 27102 - DNA, 175 bp, Homo sapiens
acaaaaaatacaaacattagccaggtatggtgctgtgcacctgtagtcccagctactcgggaggttgaggtgggaggatcacctgggcctgggaggtctagactgcagtgagccatgatcatgccactgcattccagcctaggcaacagagcaagaccctatatcaaaaaaaaaa

SEQ ID NO: 27103 - DNA, 200 bp, Homo sapiens
  misc_feature 119: s=g or c
aaaggatgaaacaaaagctcatgtagttgatgtgtaaagagatatccaagtggagatgccaaaatattcctctttaatggcgtataagttacctgtggaggatgtccaccctctatctsgggcctttttcaagttagaggcgatgaaacagaccttcaacctggaggaatacagcctctctcaggctaccttggagcgaa

SEQ ID NO: 27104 - DNA, 288 bp, Homo sapiens
  misc_feature 200: r=a or g
  misc_feature 201: k=g or t
aatctggatgcatatacatacagaaggaagattatgtaaggacacaggaagaagatggccatcctgtggctaagccaacaggagagaggcttgagagtaaatggaaatagaaaaggaaatggtcttggaatactatgcagccataaaaaatgatgagttcatgtcctttgtagggacatggataaaattggaaatcatcrktctcagtaaactatcgcaagaacaaaaaaccaaacaccgcatattctcactcataggtgggaattgaacaatgagatcacatggacc

SEQ ID NO: 27105 - DNA, 273 bp, Homo sapiens
  misc_feature 80: m=a or c
  misc_feature 92: m=a or c
  misc_feature 270: m=a or c
caacggacaattgactgaacttggtgggctgggccttcgagccttcgaagcccacgtgcaagcgcctcaaaccaagtcamgcttggcgaggmcccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcmccc

SEQ ID NO: 27106 - DNA, 289 bp, Homo sapiens
caggatggtgggaaagctgaggtgggagaatcactagactagagcctgggagtagagcctgggaggtcaaggcttcggtgtatagttaatatgatttgttgactcttcaaagatttgtgcatataaagttttatctttatgcaaaatttagtaaaataaatgttgtttaattttagagctatactacaaaattcctggacagaagtcatggatttaatattgaaaccccgctctggaggtgagaataaaattcatgttaagaaaataaatagaatgtatggctaggaaa

SEQ ID NO: 27107 - DNA, 320 bp, Homo sapiens
aaattctcgtcaccctattggttgagttaaccagcattcaaaagcagtcagcgaaccaactacgactgggcccagggatttcgggaaatgtagtccactctgcagcttccgcatcccaggacgatgtcttgcatttggaacctacaaaattttgatttgtcgtttaatatttattgaattagttgattcgctgggtgcaacgaccaagaaaacaaatgtgaggacattcctaaactatttccaagtggctctgaattttttattaatttagttctctaacattttgttgtcaggcggtgtgctaggtactaaagacacga

SEQ ID NO: 27108 - DNA, 171 bp, Homo sapiens
ataatgaatgcagcatccctggggagtgatctgaagctggcgaggcaatgagaacaccctggcagggcagctgagctgggtggatccttgttctgtcaccaagcctttaagtcatatgctgacatgttacagtcctgcctgggaccctgcccacaaatacttaagatgcct

SEQ ID NO: 27109 - DNA, 118 bp, Homo sapiens
agagtgggatcccaacgggtaacccccctgcagggagtaggggcgcactgaggggtcaccaggagcggcgcctggaacgaagtcagtgtggattatgggctggccacaattaagacac

SEQ ID NO: 27110 - DNA, 405 bp, Homo sapiens
  misc_feature 118: s=g or c
tgtttaattttttgtagagatgtggtcacactgtgttgcccaggctggtcttgaactcctggcctcaagtcattccccaccttagcctcccaaagtgttgggattataagcgtgagcsaccatgcctggccccaatttaaaatgtggaattcagttggtgtccaagacttatcttgagactcttaaaagcatcagtctgtaactagaacaaatacagtcttagatttacccaagtgcctagatatcattttataatgattagaattgagtattgtgggtcccctaattctgtgggtgccttaagtgagaatttctaaatgattttcacattctaaatgactttgggttttgaactctccatctagtttacttctaaaatgggaacttgaggcattcaggtatcca

SEQ ID NO: 27111 - DNA, 276 bp, Homo sapiens
  misc_feature 34: m=a or c
  misc_feature 122: y=c or t
attatttcttagaataccagataagagtccagcmaacccaataccttaatttcagttttgtgagtccctaagcaaaccatccaggctgcccagacttttgacctatagaactgtgagataayaaatcggtattgttataagctgctaagtgtgtggcaatttgttatacagcaataaaaatctaatataactatctataaggaggtgccttaaataaactttggcactacaagcatctgaacaaacaaaaggatctgtatggaataaagcgaaagt

SEQ ID NO: 27112 - DNA, 241 bp, Homo sapiens
  misc_feature 13: y=c or t
acgcgcagtgttyaacggccggtcaggaacccaacaattagtcccttctcgtccgagaggaaactctgtgagaagatgggaccgtgagcactctctttaacaaggacatttccttttcagcgaaagcagcgctctgatttaccaagtctggcggaccgcagcgctttaaaggaatgaggttccagcggtcgcgccaagcagcgtacgcagcctattttaagttatgctaccttcgccaaag

SEQ ID NO: 27113 - DNA, 59 bp, Homo sapiens
catttcaccatttccttttttcttttttttctttcttttcttctttttttttttttttt

SEQ ID NO: 27114 - DNA, 244 bp, Homo sapiens
  misc_feature 129: r=a or g
  misc_feature 135: r=a or g
  misc_feature 137: r=a or g
agatttcaagcatcatggaataaatactcagaacaactccctgctgacccataaaatatgggaattgcagatgctacccataaaaatgctactttgacatcacttctgcaataggtctgagacagagarctaaargrcatttcataaaatgggcatgaaggattccttcaaatgaagacgtggacaaaatgattggtcaggtcctttgctctactgttgaatggaggaggattttttttttttt

SEQ ID NO: 27115 - DNA, 251 bp, Homo sapiens
  misc_feature 138: y=c or t
agacacactatgcgggttgcggggcctgggggccggacggctgtttcctgtcctggtgcatggtggtcggacgaaggaattgttggaaaattttctcggaggtagaagatgttgttagcccaaataaatcgagattcycagggaatgacagagtttcctggaggagggatggaggcgcaacatgttacgctgtgcttgacagaggcagtcaccgtggcagatggtgacaacttagaaaatatggaagtgca

SEQ ID NO: 27116 - DNA, 123 bp, Homo sapiens
cttcaggctaaaagctacaaaaaggggaaacttttgttttttgtagcttttcgcttttgtagcttttagcttttagtgctattcccatctttttaagtactgacaattcccctaagtaaatga

SEQ ID NO: 27117 - DNA, 330 bp, Homo sapiens
cattgtagttttctatcaatttcactggattaaaagattgagggaataagattggcagactaccccctagtggctaacttgaagaaagttgtgcacaaattgtaaagaactactgcattaaggtaacagtaattgtttatttccattatatttattaaatatacttattaaatctatgtcccaggcactggatcaggtgcttggaataaaaatccagtaaacaaaaaaaaaaattaatccagtctttcagtcttagcaatggctttaccttctccttcaaaggaaaattgaaatgatgagggagtagttgtctgtacgtacgatgaatgc

SEQ ID NO: 27118 - DNA, 62 bp, Homo sapiens
gataatatctaaggaataaaactttgaaaaaaactcaccaaacttttttttttttttttttt

SEQ ID NO: 27119 - DNA, 413 bp, Homo sapiens
  misc_feature 135: w=a or t
  misc_feature 296: w=a or t
  misc_feature 348: m=a or c
  misc_feature 369: y=c or t
  misc_feature 378: y=c or t
  misc_feature 385: w=a or t
ccttcagtggctccaaacaatgtatggcagggattggtaatttttttctatgaagggccagataataaatattttaggctttgcttgatatatatgatttttgttacacattgccttttttttttccagctcttwaaaaatgtaaaaataagtatgagctcatgaatcatacagaaatgccttggtcaagatttggcccatgggtcatagtatgctagtcctatagtcagtgtgcagagtaagcagaggtctgtgaagtttctcatagccaaactctaatccatcttttgcatctwattgccccttttttctcttacccgggaagaaattattcttctggcgcatgcmatcctctctgtgaataatttyctttctttyctttcgwctatttatttaaaatagtgattggggtc

SEQ ID NO: 27120 - DNA, 147 bp, Homo sapiens
attaatattaatgaaaaggaatacgaagagtggtttatggatgggatgagaaggaagccagtgagtactgagaaggtgacccctagggatttggcctggaatggcaagagctcagacatgtcagaggaagaaatttttttttttttt

SEQ ID NO: 27121 - DNA, 208 bp, Homo sapiens
  misc_feature 120: y=c or t
agtgggggagccggcagccgctcctgacccagattagctgtgagtccttcggctgcaggaaacctctctcccgagagcaaagcccacgcataacttatggttgctgagctgccccatgcyttctgaaacagcttgttggttgcccctctgatcctgtagggctctccccgtgttctgcccctcctaaaactgagtggtgtataattct

SEQ ID NO: 27122 - DNA, 315 bp, Homo sapiens
  misc_feature 116: m=a or c
aacttgttcgcgttttgttctgtactggaagcttttttttcttttggtctttgcaatgaattatgttgctgctccctttttgggcctacattgtctttataagctgtaacgctcamcgctggaaggtctgtagcttcacttttgtaagctagcgagatcacgaacccaccaaaaggaaaaaactccagacgcgccaacttaagatttgtaatattcattgtgagggtccgcagcttcattctttaagttagtgtgagaccaagaacctactaattcggaacacagtctcagctcattgcaaccttcacctcccgg

SEQ ID NO: 27123 - DNA, 118 bp, Homo sapiens
  misc_feature 3: m=a or c
  misc_feature 4: s=g or c
  misc_feature 80: s=g or c
  misc_feature 113: m=a or c
agmsacagcaactccctcccgtaactcaggctgagaaggaaccagccagctcttacctcctcctggttgcttttcttgcscccaccccaagtttatttttgttttcccccgcmccccg

SEQ ID NO: 27124 - DNA, 229 bp, Homo sapiens
attctcctattctcctgcctcagcctcccgagtagctgggactacaggcgcccgccacctcgcccggctaattttttgtatttttagtagagacggggtttcactctgttagccaggatggtcttgatctcctgaccttgtgatccgcccgcctcggcctcccaaagtgctgggattacaggcgtgagccaccgtgctcggctgatgtgtttcttataaatggcacaga

SEQ ID NO: 27125 - DNA, 255 bp, Homo sapiens
  misc_feature 119: w=a or t
caaaataaaaaattaagtatgttctgtgttttcattttaactttttttatggtgtttaatttgtggttggctgcaactgtgtatcatgtatatggaacttgtaaaaaagttctcggacwttcagatcttaagagatgaaatcacttttacctataaaaaccacttttattgcggtttgactgcattgagctctaggatattaaatgatatcactaatattttgcatgtaatttgctcatttgagtgagggcacat

SEQ ID NO: 27126 - DNA, 185 bp, Homo sapiens
ttgcaaaggatacagatgaagagacacataggacaaggtatgggagtggggtacgaagcttccatgccttccctgggcgcaccaccctccaggaacctccatgtgttcagctgtcctgaagttctctgaacgcagccttctggggtttttttgtgtgtgtatttttttttttttttttttttttt

SEQ ID NO: 27127 - DNA, 79 bp, Homo sapiens
ccaactttcagaccatagcccagggcatatctcattgtgattgtttcaaaatttttaaatgtaggtgtgtttttttttt

SEQ ID NO: 27128 - DNA, 128 bp, Homo sapiens
  misc_feature 109: y=c or t
ccttcttctgctggtagatatctaggctatttccatttttttttttaagtcatgaataaagcaagctactgctaaaattcactggcaagtctttgtggatatatatttyctttttttgggggaggggc

SEQ ID NO: 27129 - DNA, 168 bp, Homo sapiens
aggtggaggttgcagtgagctgagatcacgccattatactccagtctaggcaacaagagtgaaactctgtctcaaaaaaaattaatgataataatgttacaataataataatgttagtgatacatatcattttgaaaccagttcttaagcaattaaaaaaaagcagca

SEQ ID NO: 27130 - DNA, 182 bp, Homo sapiens
  misc_feature 46: k=g or t
  misc_feature 88: r=a or g
  misc_feature 89: s=g or c
acactgcctttatgagctgtaacactcactgggaatgtctgcagcktcactcctgaagccagcgagaccacgaacccaccaggaggarsaaacaactccagacgcgcaccttaagagctgtaacactcaccgcgaaggtctgcagcttcactcctgagccagccagaccacgaacccaccgt

SEQ ID NO: 27131 - DNA, 329 bp, Homo sapiens
  misc_feature 9: m=a or c
  misc_feature 132: r=a or g
  misc_feature 228: n=a, g, c or t
  misc_feature 289: r=a or g
  misc_feature 327: m=a or c
  misc_feature 328: s=g or c
tgttaaagmtgtatcgtggtaaaaaatttactctagcagccatgttgaacaatgtatttaaaaattgtaaactcttggaatactgtatttatctgctatttcaatataaagtcctttgacttagtcctggtractgtacagtaatttggtttactaatgaaagttgtgaataaaactgtgaaactagaagggagactttctggactttaatagaaaaatgtgattttnagattgctttttcttttgttttagcgtaatttttccctttatattcccctcatcaatgtarataaacacacacacacacacacacacacacacacacgmsa

SEQ ID NO: 27132 - DNA, 307 bp, Homo sapiens
  misc_feature 176: v=a or c or g
  misc_feature 177: n=a, g, c or t
  misc_feature 178: h=a or c or t
taatgatgaatctagagggaattggcgtattcatgaagagaactgggatgcaaaaataacagagtttaaagttttattaaatatagaaggcatatgaattactgtgctttatgatacagtgaagagaaggataactttctttgccccaagatgcacacagacaggagagagaaagvnhggagagaaggtctaccagcaatgacattgcaaaatgagtcaatgtcaggcttatggaatatccaaagcctctgttgagcctacagagcaaggtggggtcggggggttgattttcaatgagtgggaatgc

SEQ ID NO: 27133 - DNA, 174 bp, Homo sapiens
  misc_feature 34: y=c or t
  misc_feature 142: k=g or t
taaactccttagtttcttggcctggtgtggtggytcacacctgtaatcccagcctttgggaggccaaggcgagtgaatcacctgaggtcagtagttcaagaccagcctgggcagcatgacaaaaccccatttctactaaaaktacaaaaattagccaggcatggctgggtgctc

SEQ ID NO: 27134 - DNA, 85 bp, Homo sapiens
ggtggaggctgcagtcagctgagattgagctactgcactccatcctgggtgaagagagagactctgtctcaaaaaaaaaaaaaaa

SEQ ID NO: 27135 - DNA, 142 bp, Homo sapiens
ttctgaagctgaataaaatgtgctgttggggcttttctgtgcctcaggtgctcattcacatgaagccacacttcatttgatagtgccaatgtcagctgggcacggtggctcacacatgtaatcccagcacttttggaggcct

SEQ ID NO: 27136 - DNA, 183 bp, Homo sapiens
tgcctatatccttattatgttaacctattttatttttctatatttcgtacatatataagtattattatggttccaagcaatgagtgtaatgtattttctcccaatagtaattgtttatattcatattattcagctctgctgctaaacacgtagttccacttcgtttttttcttcttgctatct

SEQ ID NO: 27137 - DNA, 224 bp, Homo sapiens
  misc_feature 16: s=g or c
tgcagcctctgcctcscgggtcccagcgattctcccgcctcagcctcccgagaagctgggattacaggcatgtgccaccatgcccggctaatttttgtgtttttagtagagacagggttttgctatgttggccaggctggttttggaactcctgacctcaagtgatccacccgccttggcctcccaaagcgctgggattacaggcatgagccactgtgcccgac

SEQ ID NO: 27138 - DNA, 197 bp, Homo sapiens
  misc_feature 110: r=a or g
  misc_feature 114: r=a or g
  misc_feature 121: k=g or t
taattgaactgtacccttaacatacctgtactttttttatgtgtgtttttggatacttagataaaaatttacccaattaacaaaaatgcaatagaagctaatttaaccargttrttgcagkatttaagaatttgaggatgagggagtgtatatggaatggctatcttatactccaggcacataaacaaattcaagaa

SEQ ID NO: 27139 - DNA, 119 bp, Homo sapiens
aacctttagaaaagggtagggaggatgaaagatgaaagtccacaaaaatttatgatagaccacttaaggaacctgagtcctagacctggactcaaggaatcgtccaaagcaccgtacct

SEQ ID NO: 27140 - DNA, 81 bp, Homo sapiens
  misc_feature 52: y=c or t
tgtgtgttactaggctgtgttttgggatgtcagcagtggcctgaagtgagtygtgcaataaatgttaagttgaaacctcaa

SEQ ID NO: 27141 - DNA, 371 bp, Homo sapiens
  misc_feature 18: w=a or t
  misc_feature 131: m=a or c
atccaaaatattagcgtwttaataggagatccatatgaaaaactactgatgagttattttacactctgttttcaacctcagtctttgaaagctggcaagtatcgtacatgtacagcatgtctcttttcagmgagtcacattttaagggctccattgccacatgtggcagtggtcaccctgttggacagcccaactctaaacatcttaacagaccctaggcaaagcaggcctggcctattgctaagcatcagggagatccaagtttccatccatcagacattctggagcaaagctggctgatgtatcaggaatggcatggaagatctgactgtcttccctgctccccaaatgtccattttttactctgtgat

SEQ ID NO: 27142 - DNA, 243 bp, Homo sapiens
  misc_feature 119: d=a or g or t
cggtgcagggcagagaaggagcagccttggactggggatcctgagtagtcctgtctgggaatggagggcactgaattggcaccctccttggaggccacatggcccaaacatgggcattdctgctggtgatgggatctctcccttctgccagctggtctctgccctgtttgagctgggaaagtttgctgaaggctgcagcctgttctgagttggatggtagaaatgtaggaaatacaccaactc

SEQ ID NO: 27143 - DNA, 187 bp, Homo sapiens
  misc_feature 13: k=g or t
  misc_feature 21: v=a or c or g
  misc_feature 22: w=a or t
  misc_feature 63: k=g or t
  misc_feature 112: y=c or t
tagagtaaatatkcattttcvwctgccttttgtaaattataatggataattgaagcaaaaatktaacaccaaggccaggcacaatggctcacacctgtaatcccagaatttygggaggccaaggtgggaagatcacttgagcccagcagttcaagaccagcctggagaacatagtgagaccccacaa

SEQ ID NO: 27144 - DNA, 283 bp, Homo sapiens
  misc_feature 270: y=c or t
tctaagtactttacatttttgtcttatgtgctttatggtatttctctgttctgtttccttatgattgacattgctttcagtcatgttattcttttgctacttctaatgtggttttatttttaaataatttcatctttttccttaagttcctctaaattccagctcttttttttttcttttttgttggggggactttatctaaagtttttggtttcctgaaatttctttcgaagtatattttctttatgttgtatacccccacttccatgyctgtacaggcata

SEQ ID NO: 27145 - DNA, 470 bp, Homo sapiens
  misc_feature 129: m=a or c
  misc_feature 274: n=a, g, c or t
  misc_feature 275: n=a, g, c or t
  misc_feature 292: y=c or t
  misc_feature 308: y=c or t
  misc_feature 310: h=a or c or t
agtagtctagtgtctcgagaagctgttgtggcgctcagcttccttattgaaggtacaataagtagagccaggaagatctatccacttcatgaacttgcactgtggcaaccactgcatgcagatagtggmttctcaaagatctctaagactttctctttctacaaactggaaacctggttgaggtcctgtttgactgggaatccatttggtacatcagcttgcctcaagtctggaaagaaattggcttgggctcatcaagttgaagggaccaccnnaagagctaagattgctygtaatactcatgtggychctaggatgcaccgactggtagtgatgagccaggtttacaagcagacactggctaagaagctcagacactctggcgggggcacatgtaaagattcatcgttgcaacgaatcttttatatatctgctctctcccttacgatctgtgacaattgagaagtgca

SEQ ID NO: 27146 - DNA, 326 bp, Homo sapiens
  misc_feature 241: k=g or t
  misc_feature 264: r=a or g
agataaagactcccctgttgagtacaaatatttcctccatgaagatactcttgaaaacacactctccccactgagacttctcttcatgatatccgaaatgagagaacatccggggtcaagcatgaactgcactgtgttgtctttatgaaagagaaacaaaaactcaggaccccaattcactgtgacagaaggaaaaaaaaaaactggaagctgagtcatgcaagaaactgcctttcctttkgttcctaagcagacagctacagrgaaacggctaagtatttccttaggatctttacaggccttcgtgtactgaccagaggagcatt

SEQ ID NO: 27147 - DNA, 336 bp, Homo sapiens
agatccaaggtgactgagacaaactgccggctgccactggcttatcaggagcacctgaatctgctgacacatcaaggccacttttcttaggagccccctgacttccaaaatcagtgcctttggattcatctcttccgggagagttcagtgtcttctgaaatgttacaaaacgtccttcagagcaagaaggcgtacacgaggagctcgactctgtagaaaggagatggacgacatgtctcccaggctgagagccttcctctccgaacccattggagaaaaggatttctgctgggtggatggcatcagccatgagctcgcgatcaatttggtcaccac

SEQ ID NO: 27148 - DNA, 85 bp, Homo sapiens
aagactatactttcagggatcatttctatagtgtgttactagagaagtttctctgaacgtgtagagcaccgataaaccacgagga

SEQ ID NO: 27149 - DNA, 202 bp, Homo sapiens
agcaacccgtttggttatctttctgtgctgtggaaggtttgttctttcactctgcactattttgcaataaatattgctattgctcactttgggtttatattgcctttatgagctgtaacactcaccatgaaggtctgcagctttactcttgaagcttagcgagaccactaacccaccagaaggaagaaactccggacacgca

SEQ ID NO: 27150 - DNA, 277 bp, Homo sapiens
agctactgatagcattcttcagggcttctaagctgtcaaaagcaaaagggggcagggggagaataaggggtaaataaaaatgttggaaatgaggccaggcgtggtggctcacgcctgtaatcccagcattttgggaggctaagggcggcagatcacttgaggccaggagttcaagaccagcctggccaacacagtgaaaccccgtctctactaaaaatacaaaaattagctgggcatggtggtacacgcctgtaatccaagctgctcggggggcgca

SEQ ID NO: 27151 - DNA, 420 bp, Homo sapiens
  misc_feature 362: s=g or c
  misc_feature 363: h=a or c or t
cataccataagtgagtgtaacagctcaaatccctcagttgtttgaggttatgacatttgtgttgagttcctaaaacactagccctctgaacagggctaggaggaggtatcacttgcggggttgagtaagtatgttcaagtacttggccttgagagtggtgactcctaaaattttgcaccataggtggtttgcttgtctcaccctaaccaaggtcctgcctgtaaaacaattataataataaacattcctttagaataagtttgtattatcatcaactaagttgcaaacataattttaaaaagcaatactcccatgagactttcaaagaaaagcaacagtctcctgaccctatcccagcttgshtcccatttctactctatagaaacaatgtttttcagctctttcagcttcccccctact

SEQ ID NO: 27152 - DNA, 204 bp, Homo sapiens
tgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgccttg

SEQ ID NO: 27153 - DNA, 449 bp, Homo sapiens
  misc_feature 245: r=a or g
  misc_feature 246: n=a, g, c or t
  misc_feature 247: h=a or c or t
  misc_feature 334: n=a, g, c or t
  misc_feature 335: n=a, g, c or t
atgctccccactggactgtatactccatgaagggaggaaccaggcctgtttggttcattaatacatccttacctctgagcagagtgccttacctttagtaggtgcttcataaagacttgtctagaaatcagtggattaattatttaacagtgtgagtgctgtgaggaaaaaacataatttttatatcctcaaagcctggtacaggccaggaagaaaatcagtattcaataagaaatgtcttagcrnhtaaaaagaatcttctagttgacagcagccggagaagtagaaacagagagaacaagagcaagacaagaggaagataaggagcaagagnnaacctgcagcaacagggaaccaggcagaggacacctagctcttcctgagcattttagaagcctccgtggccttcaaatctggtgcattggtgacctctagaggacagaatctca

SEQ ID NO: 27154 - DNA, 218 bp, Homo sapiens
  misc_feature 131: v=a or c or g
  misc_feature 132: d=a or g or t
  misc_feature 140: s=g or c
  misc_feature 155: v=a or c or g
aagtgtctctacaactctgcttatcttttgtagagacgggtgtattttttgtagagatggtggccaggctggtctcaaactcctggactcaggtgatctgcccaccttggcctcccaaaggctgggattavdagcgtgascaactgcatctggcvagttgctacatttttaattggtcaaaaagaaattttgtaaaaacgtatttcacatcatgcgaa

SEQ ID NO: 27155 - DNA, 60 bp, Homo sapiens
tctttctgagtaatagtcgcttcctctattaaaatctttttttttttttttttttttttt

SEQ ID NO: 27156 - DNA, 197 bp, Homo sapiens
  misc_feature 143: r=a or g
actctcatggcaaaactgctggtgagtgtaccttttctacaggaagtaaaaatggccttactaaataaattaaattatgtccaagtgctatttctttatggcaccgggagcaagcatttaaaagacttccatgtcacaggaargaattgtgcttgagaaacaatcatcaagtctgttggtccacatctcccgcgcgt

SEQ ID NO: 27157 - DNA, 146 bp, Homo sapiens
  misc_feature 121: k=g or t
ttcgccccttttccatgtggtgggaggaaaaactttttcactactttctttaattcaatgcttggggactgctgaattagaataacagaagacagattaacaggataaaagttacacagtktttattaatatttacatacgtgggc

SEQ ID NO: 27158 - DNA, 298 bp, Homo sapiens
  misc_feature 231: m=a or c
tattaagtattattttctaaaagaaataggaggcattttcatctttattattgtacttttggttatgcaaacactttgataatataaacagttatgtcccctataaatctggtcagcaacctcttttgattttgttgggtaagttaaatagtctgtagtaggtagagtactgggtacaagtggtccaaactaagataagagactaaaataaaatgctaaatcttaaaagamactgggtttatgcactaaacgttttgtgccttggtctaatattaacatgatgtatgtgtaaactgac

SEQ ID NO: 27159 - DNA, 157 bp, Homo sapiens
  misc_feature 139: s=g or c
taatttataatggcaaaactcagccagtgggaggtgcatgggtccttgctgcttattttgctgattgacagactgaggcccaggagagggatggcttcctcgagaccctgactctgtgagttagggacaaagctgagastcagtcctggcttcctcc

SEQ ID NO: 27160 - DNA, 152 bp, Homo sapiens
agcgtccggagtagctgggactgaaggcgcccgccatcatacccggctaattttttgtatttttagtagagacggggtttcaccgtgttagccaggatggtctcgatctcctgacttcgtaatccgcccgcctgggcctccgcccgccagac

SEQ ID NO: 27161 - DNA, 334 bp, Homo sapiens
  misc_feature 128: m=a or c
tcttccttaaaaaggaaatacagtgatttgagctagatgaatccagctacattttacttttttttttgagaccgagtctcattctgttgcccagggtggaatgcagtggtgcaatctcggcttactgmaatctccacctcctggggtcaagtgattcttgtgcctcccaggtagctggggactataggcaccaccacacccggctaatttttggtgttttttgtttgtttgttttgtatttttagtagagacgggtttcaccatgttggccgggctggctgcaaactcctgacctcaggtgatcagcccgcctcagcctcccaaagtgcatggg

SEQ ID NO: 27162 - DNA, 99 bp, Homo sapiens
gggcccgggaggcggactttcagtgggccgagatggcgccactgcagtccggcctgggcgaaagagcgagactccgtctcaaaaaaaaaaaaaaaaaaa

SEQ ID NO: 27163 - DNA, 120 bp, Homo sapiens
  misc_feature 86: k=g or t
cactactaaaaaaaagcattcttaatcatttccccagttatgatgtacacaagcataaataaagggaaacatttataaattcagtkcttggcactaacacttcttatacaggcagaaccg

SEQ ID NO: 27164 - DNA, 238 bp, Homo sapiens
ttcttggcaatacagtctgtcagtggcataatggtaactatcttggatgatttcttttacagattggttttgagaaatatatcctgaatgtggattactatgtacatgagactttaagttgaaaattactcatttttattaatataaagtaaatttccctttgcttttaatcttcgtacatccttttcagtagggtgtgggattagaggaggggaggtggaagaattataatggtaca

SEQ ID NO: 27165 - DNA, 142 bp, Homo sapiens
ctcctgtgtgtgttaacagatcatggatgttttatgttttcactgatcatttaaagagtttgacctcagagctccaggatcatcagtaaatttgtcatgttatatatttatttttttataaatcaagacttctgtgtgcacc

SEQ ID NO: 27166 - DNA, 104 bp, Homo sapiens
cagtaccacggttccctcaaagtttgttgaataaagcaacttttgtagatgctgtttcatacagcacttagatgaattattgatcttcctaatatcaggcgcgt

SEQ ID NO: 27167 - DNA, 292 bp, Homo sapiens
  misc_feature 37: k=g or t
  misc_feature 38: r=a or g
agcagggatgctcccagcatgcaacttggcttcacckrtcaaaggcgcttttttcgaagacgcccgggagctcttgcttttgcttgagggtctttggtgttgactgagagcgaattaaaaggttctcagctttcgctaaggaacgcattctggagtctagaacaggcgaagatgggactggggtgtctggggacttagacgtgagcgagcaagggaatccgggatgttgtaaaagttgttgagttctggatttgattctcagcttggtcgctgttggtgcatagaagagcag

SEQ ID NO: 27168 - DNA, 79 bp, Homo sapiens
  misc_feature 9: n=a, g, c or t
caagggatntgtatacatgattagggtaagatagaatgtattatatatatatatatatatacacacacacatatatata

SEQ ID NO: 27169 - DNA, 339 bp, Homo sapiens
  misc_feature 3: m=a or c
  misc_feature 9: k=g or t
  misc_feature 37: d=a or g or t
  misc_feature 38: w=a or t
  misc_feature 55: y=c or t
  misc_feature 56: m=a or c
  misc_feature 57: s=g or c
  misc_feature 58: s=g or c
  misc_feature 74: v=a or c or g
  misc_feature 85: s=g or c
  misc_feature 108: m=a or c
  misc_feature 117: m=a or c
  misc_feature 118: m=a or c
  misc_feature 122: m=a or c
  misc_feature 132: r=a or g
acmaatatkacagcacgcaatgagggcccagaggaadwaagaaagattaaaggaymssagagactacttttgcvttgaggggaasaaagaagtcaggggctggctaamaggtcccgmmagtmaaatccagcrgactgcaaaaatactagactttctccactgaagagtcaggtaatgccagaagagtattatggcacagcaatactcctcagagcaaacgttggcttttcagctaacttagaagttccctggaaaatgcttcttaagccttagagaagagagacagtctttttcatataacatagccaaaccaagggcgtgacactccgtcaccgtccc

SEQ ID NO: 27170 - DNA, 212 bp, Homo sapiens
  misc_feature 69: n=a, g, c or t
  misc_feature 71: w=a or t
gatggcctgtttgagtaagcagtggggaagaaggtcaataatacatcagcatgcagagtctccgctaangwttcctgagattcttctgggctcagaggtgggactgggggtcacagcaggcatccttgtaggaatgacagcagaagggcagaaaccacccacgtgaggaagcacgtgcctccccatctcatatgagccagtaagaaaaggcc

SEQ ID NO: 27171 - DNA, 127 bp, Homo sapiens
agcctactttgacactcatttaaagatgacagggaacaatagagatttgttctgtgcaaccctttcttgtatgccggcgacatcagctccgcacatgaaactgcccgatatttcattccacctgccc

SEQ ID NO: 27172 - DNA, 95 bp, Homo sapiens
  misc_feature 67: y=c or t
  misc_feature 68: m=a or c
  misc_feature 70: r=a or g
  misc_feature 87: m=a or c
cttgttgagcttctttaagatgattatctgaaattatctgttgagcagattgtggtttggtttggtymtrtcttttggtttggttamtggagcct

SEQ ID NO: 27173 - DNA, 145 bp, Homo sapiens
attcgatccgcggcgctgccttccgtcgagcattccggttcagacgctttcggttgacactgtaaccaaacttctgcctccgggttttgcccttggccttgggcatcgcgctgaccaccgcaccagcagctcaaacacgcagccc

SEQ ID NO: 27174 - DNA, 262 bp, Homo sapiens
atttattttatcacaattctggaagttagaagcccaagattgcgatgccagcaaggttttggcagaaatgtgaatataagcaagcatactatgagatacatgatccagtcactgtaaccttctttggaactagtattgatccagcagcagctttcagtactgatcctaaaaacaaataatatgatcggatcagatcatcacaaagggagcaggaatttgaaggatgtatctgggttattcaaaccgaaaacacctaactccc

SEQ ID NO: 27175 - DNA, 224 bp, Homo sapiens
  misc_feature 221: r=a or g
atactacttctgtcctatctaatctactgttaatctcatctagtgtatttttcttctcaaatattgtatttttcaccttgataatttaatttaggttttcttacatttctcacacctgtccttaatatgctaatgttttcctctactttcttgaacatatgaaatatagttataactgtttttaatgttcctgtctataaatcatctttgtcatatccggrtca

SEQ ID NO: 27176 - DNA, 250 bp, Homo sapiens
  misc_feature 17: m=a or c
tacctaattttaatgamaatacaatgaccctagaacatcctgcccatgattctgcccaagtttatgcaaacagaaaaaatttattttggaaaaaaccggatcttaaactgaaattcattaagccaatttttccaaaataaagtaccagcttagttaaccaaattgtgctttttcactttttccttccctcaaaaggaaatcccttattcaacaaaaatttgtggaacactcatatgtttcaggcacccgg

SEQ ID NO: 27177 - DNA, 178 bp, Homo sapiens
atccttgtggcagagaggtctagaggaggatatagtgaagggcaggctgcctatgttaagacctcaagctgcggctttgtttatgtaaggaagtgctaaaattccagttctaggttaaatgggtagctgactcattattagtgggtcaatgaacccctttaggtcccctaagagagac

SEQ ID NO: 27178 - DNA, 287 bp, Homo sapiens
  misc_feature 125: s=g or c
atactgattcttgggaataagatcgacagacctgaagccatcagtgaagagaggttgcgagagatgtttggtttatatggtcagacaacaggaaaggggagtatatctctgaaagaactgaatgsccggacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataact

SEQ ID NO: 27179 - DNA, 324 bp, Homo sapiens
  misc_feature 130: r=a or g
  misc_feature 161: n=a, g, c or t
  misc_feature 183: n=a, g, c or t
  misc_feature 215: v=a or c or g
  misc_feature 216: m=a or c
  misc_feature 217: v=a or c or g
  misc_feature 235: d=a or g or t
tatgagattttgaggatactttgcttatttcggtgttatgtcatatacataatagggtaaggaacatggctgtgctttggtcaatgataggccaaagtatgacatttacgtcttgcgtgactcagagaarattaaataacaaatcatttaatgtggaaacnagatagaatgtttcaatttgcntgatgctacactttactcagccttcgtttgtvmvtttttaggaacaggagcdactactaaaagagggatttcaaaaagaaagcagaataatgaaaaatgagatacaggatctccagacgaaaatgagacgacgaaaggcat

SEQ ID NO: 27180 - DNA, 380 bp, Homo sapiens
  misc_feature 133: m=a or c
cacttagaataatggtctccaattccatccaggttgcagtgaatatcattatttcattcctttttatggctgagtagtattccacagtatatatataccacaatgtattttatccacttgttgattgatggamatttgggctggttccatatgtttgcaattgtgaattgtgctgctataaacatgcatgtggaagtatctttttcatataatgacttattttcctctgggtagataccagtagtggtattgctagatcaaatggtagttctatttttagttctttatggaatctctatactgttttcatagcggttgtactagtttacatttctaccagaggtgtaaaagtgttctcttttcaccacatccccacctgt

SEQ ID NO: 27181 - DNA, 283 bp, Homo sapiens
  misc_feature 125: m=a or c
atgtttaagatctgttttaaatttaaaacaatgaattgaatgctctaagaggctcctacaggcgctccaggccactctcagagactcccaggagttgttgaactatatttggagaaaacagccamtgaatattatcatttctcctttaaagagagtttgtaaggggggaacatgcattttatcagacaatttatccaaagcatttcagaacatgagtgctgatgagggcacctcttgtgctgagtcccctcagctatcagtgttcttctcaaggacacatttg

SEQ ID NO: 27182 - DNA, 90 bp, Homo sapiens
gaatagaggaaacaccctcactgtatgatataaagttatagtcatttaaaaatgtgtgatattagtacattagtaggtaaatgagcagta

SEQ ID NO: 27183 - DNA, 398 bp, Homo sapiens
  misc_feature 343: r=a or g
acttaatttgagttcagggttcaacatggcctggacctgaccatctggagttgcctgccagccccaaagctttctttgggctgctagtgtcctcttcccttccttgacctgggttccccctctcctgcagaacgattccctgatgaggcagatgcgggaattggaggaccgatttgccagtgaggccagtggctaccaggacaacattgcgcgcctggaggaggaaatccggcacctcaaggatgagatggcccgccatctgcgcgagtaccaggacctgctcaacgtgaagatggccctggatgtggagattgccacctaccggaagctgctggagggagargagagccggtgaggggccaggcaggagcccgagtgggaggtgcggggtgctgggt

SEQ ID NO: 27184 - DNA, 386 bp, Homo sapiens
gacaggcctggtctaccactccaggtgatggctggagaaaccacggtccagagaagtcagtgatttgccagagattacatagtcaaaggcaaagctgaggtccatgagccagaaaggaagccaaggccttgcacactttctctgagaccctgcccagcccggcctaccttatgcatgacgatcttccgctggcctggctccgccacgtcaatcatcttctggaccacgtagttggcatactggtccttcatcatggtgtataaggcactgtggggaccgtcgttcatggtgcacacctcatcgatgagcacagcgcgctccgtacgtgaggcgtgagtaacacacttctccacaacattgctgtaatgagataaaaccaggaggac

SEQ ID NO: 27185 - DNA, 289 bp, Homo sapiens
agggagagctgaaatgttcatgaatatcaagcagaacagaagttaactgcatggactaaactagcaaaagtctaacgtgtaaaatgttttctccctaaaacagaaaacttgagagctgatgggaccgctggaaaagatccttcacaaccatcacgtggccacctgaactgttcagtgtcactgcaacgggtttaggatcagaatgttccagcagggagcactacagctgtttcaatcttcagggagactactcatcttgggaataattccttcctttgtcccgtcagcc

SEQ ID NO: 27186 - DNA, 370 bp, Homo sapiens
  misc_feature 14: m=a or c
  misc_feature 128: r=a or g
taattcttgatagmagtaaaatgaaagctatatctattctaaaccttatttagacattggtaccagttacccaggtgaaaatatggagtaactttgttttgtatggtaaggtttaggaatggtggatraagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccac

SEQ ID NO: 27187 - DNA, 237 bp, Homo sapiens
  misc_feature 10: k=g or t
ggaggccaakgtgggcggatcacggggtcaggagatcaagaccattctggctaacacggtgaaaccctgtctctactaaaaatacaaaaaaattagccgggcatggtggcgcacacctgtaatcctagctactcaggaggctgaggcgggagaattgcttgaacccttgaggcagaagttgcagtgagttgagattgcaccactgcactccagcctaggtgacagagcaagactcca

SEQ ID NO: 27188 - DNA, 242 bp, Homo sapiens
  misc_feature 228: y=c or t
atagtgaaagtagtatccaataaatagttttcccttcccttcctcctcccttttggagttaccagtgtccattatttcagtctttatgtccatgtgtacccagtattccactcccacttataagcaagagcatatggtatttgattttttgtttctgtgttaattcacttaggaaaattgcctccagctgcatccatattgctgcaaaggacatgatttcattatttyttatggctgcatag

SEQ ID NO: 27189 - DNA, 348 bp, Homo sapiens
  misc_feature 100: w=a or t
  misc_feature 103: r=a or g
  misc_feature 165: r=a or g
  misc_feature 198: s=g or c
  misc_feature 199: m=a or c
  misc_feature 240: m=a or c
  misc_feature 261: m=a or c
  misc_feature 295: r=a or g
  misc_feature 311: k=g or t
  misc_feature 323: y=c or t
  misc_feature 328: r=a or g
aacagaatatcaatggcagatataatgtgatcctgtcatgaccagaaaggaggaaaaacagcaaccacccacctggactctccaatcaaaaacaacaaawaaraacccaccctggaaggctgaggagccagctaattcccatctgctgctgtgtgccactctgcrttcacccttccgcccaatgcctggactggagtsmagaataagatcctagtagcaagcagattaccttcccattgmcaacagtagtttacaattgamgagcactgtacggtgtagacctgtaaactttaaraattatgacccatatkaacaactatgtyttatrttgtacctagtccccctccc

SEQ ID NO: 27190 - DNA, 177 bp, Homo sapiens
  misc_feature 12: y=c or t
  misc_feature 13: y=c or t
  misc_feature 161: y=c or t
  misc_feature 162: y=c or t
tataaataattyyttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttyyttttttttttttttt

SEQ ID NO: 27191 - DNA, 358 bp, Homo sapiens
  misc_feature 49: b=c or g or t
  misc_feature 299: s=g or c
  misc_feature 300: r=a or g
  misc_feature 303: r=a or g
  misc_feature 304: r=a or g
  misc_feature 310: r=a or g
gacaatgggtgtcacggcagccagcgaccgtttgtcattcacagctgcbtgaaaggaggaccgcagtattcccacgcaggaagcttggaccaaaagcaggaatgcttaagggcgcatatgacttgccatggtaaaaaacaggatgccaacccaggcctgatgacatccacctcactaaaagctaaggactaggactttctgctttaaacaaggatccacatgtgggtgttttctgtgggagagggagagaggacattcgaagggcagaagtctgacctttgcaagcacacgtgaaccasrccrrtgagaratgaatggacgagccagatgccaatttataaatttcctactgcacacc

SEQ ID NO: 27192 - DNA, 340 bp, Homo sapiens
  misc_feature 64: s=g or c
  misc_feature 215: k=g or t
gcccgaaaaaaccgtgagtcagttcggaggagagaaagctccaggaacccgactctggcggcasagccagagcgctgggatcccggacccagcgtccagaacttcattcaagcgcccagaccgccctccagaaaggggaagcccagatggcccggcgaggatgggaactggctgcggtttgtcactaggaattgttacgaatgtcgcagactggkgaagccctagctgaagtcctaacctctaccagagcggctgctatcaaccaaagtgacaggagaaccatcacgagtcgagttcactttccaactactgggcaaagcaaatgcccagagcaaaccca

SEQ ID NO: 27193 - DNA, 394 bp, Homo sapiens
  misc_feature 44: k=g or t
  misc_feature 45: k=g or t
  misc_feature 381: w=a or t
acatacgtttgggtcgtgttttttttcttggatgcttggtgctkkccttcttcagactaaatcttgctgctgctaactctttgggtgtgtgccacgtttaagagctgtaacactcactgtgaaagtcgcggcttcgttcttcagttgcagtgagcgagactgtgaacccaccaggaggaaccgactctgaactcgatgttacagacacctctaccgtggtcagatgggatggtgtcgtgaaaaatcaggacttccatcactgcccaagggtaataatcacagaacatctcctgctccatggtgccactggctgccacgtgggtagcagtaaaggcactcttgggtccagccagggtgctatcagcagcctactctacccawccattagtaacaa

SEQ ID NO: 27194 - DNA, 346 bp, Homo sapiens
  misc_feature 14: y=c or t
  misc_feature 326: m=a or c
  misc_feature 327: s=g or c
aacttctctctgtyatcaaagcccaaactcctactcttgctacttcgctgaatctacatcatctcataacaacttgatgagaagtcatgactgcatctgaacagaaagatctggaagcataaacaccaaactgtcctcactggctccttctaggaagaaaactaagaagctgatggtggaagatgggctttcattttattgttgttatttattctgcattgcttgattttttatttttattttttaatggagtctcgctctgtcacccaggctggagtgcagtggcatgatttcggcttactgcaacctccgcctcccaggttcamscgattctcccacctcagcc

SEQ ID NO: 27195 - DNA, 280 bp, Homo sapiens
  misc_feature 91: k=g or t
gttagagccacttcagcaggaaagtttcctttcccttttttgcaaaccatgagaatttgcttcagattgccttgattacagttttactatktctttgcaactgcaggccattcagatactaacagtctttctttaacattatatttttaggtaatttgaatcttcctgacgagtccagtgatagttgatcacttactatttgtattgatatatacatatattcatagcaaattcttttcttctaaaagttacataagcacaggactgaaaatttgtatta

SEQ ID NO: 27196 - DNA, 179 bp, Homo sapiens
  misc_feature 144: m=a or c
ctcactgcaacctccgcctcatgggttcaagtgattctcctgcctcagcctcccaagtagctgggattacaggtgcccgccaccacgcctggctaatttttttctatttttagtagcgacgaggtctcactatgttggccaggmtggtcttgaactcctgacatcatgatccgcccaca

SEQ ID NO: 27197 - DNA, 333 bp, Homo sapiens
  misc_feature 102: s=g or c
  misc_feature 105: v=a or c or g
  misc_feature 195: r=a or g
  misc_feature 196: s=g or c
  misc_feature 225: h=a or c or t
  misc_feature 231: m=a or c
  misc_feature 232: m=a or c
tttagtccagggacccagacgctactggataaggggtgaaatttgaggtcatatcccgggagagaggaagaagtgtcgtgagtcaccgaacccgaaggagasgavaagatgtggaggcagcggtctatggcctcttccagctccggacgggggatggggacgctctgggcaatacgggcctcagttattgtcccrstgtcctttcaacccttaaccaacccagthggaggmmgcctggaagaatgtagccttggaactagggcctggaattggggctcctaccggttgtgtgggcttgggcaagtcacttaaccttcccgcatgctcccttca

SEQ ID NO: 27198 - DNA, 298 bp, Homo sapiens
agacaactgatgctgaataacacagctaacataatagatggctgagtctctgcctgcaattgaggttggcttaaaaggctgactaagcaagcacagaaaactgaacgtggccaagagctcctgttattccagttgaggagagaccatatcacattctagagatggctgcatgcaagcatttgaaacctttgagagaatacagtgcaccctggagactattattatgactattgggagaataatatcaagagtttggaatatgctccttcctcaagatccccataaaacaaacctccta

SEQ ID NO: 27199 - DNA, 434 bp, Homo sapiens
  misc_feature 114: r=a or g
  misc_feature 381: b=c or g or t
caaagttatttgtttacaaacagcgaccatataaaagcctcctgccccaaagcttgtgggcacatgggcacatacagactcacatacagacacacacatatatgtacagacatrtactctcacacacacaggcaccagcatacacacgtttttctaggtacagctcccaggaacagctaggtgggaaagtcccatcactgagggagcctaaccatgtccctgaacaaaaattgggcactcatctattccttttctcttgtgtccctactcattgaaaccaaactctggaaaggacccaatgtaccagtatttatacctctaatgaagcacagagagaggaagagagctgcttaaactcacacaacaatgaactgcagacabagctgttctctccctctctccttcccagagcaatttatactttaccctcaggc

SEQ ID NO: 27200 - DNA, 288 bp, Homo sapiens
  misc_feature 128: m=a or c
  misc_feature 129: w=a or t
acttgaccactgtgaagactggtgtgggaagaagggtcgtttctgatgcacttgagcaggggtccccaacccctgagccatggagccgcaaggagccacacagcaggagctcctacctcccggcagcmwctccaggcccagaactttctccagtcagcctctacagaccaagctcatgactcacaatggcctatttaggcccataccctacctcacggcagtctccgcagatgagcctactgcctcacaacagcctccacaggcacagctccatcgttacaatggcct

SEQ ID NO: 27201 - DNA, 340 bp, Homo sapiens
aattacaagcacacgccaccacgcccagctaatttttgtatttttagtagagacggagttctgccatgttgcccaggctggtcttgaattcctgacctcaggtgatcgccctgccttggcctcccaaagtgctgggattacaggtgtgagccactgcgcccagctgaaacttgactgcagggaacattcttgtacctgtgttttgttcacaagtgattattcaaaagaatcaactcctagacatggaattgctgggtcgaaggctattgaatgtaaaatttccatagatactgccaagttgtccttggaggctgtgctgagttcttccttccccacaaac

SEQ ID NO: 27202 - DNA, 180 bp, Homo sapiens
  misc_feature 42: w=a or t
  misc_feature 43: y=c or t
  misc_feature 123: r=a or g
  misc_feature 139: w=a or t
  misc_feature 140: w=a or t
  misc_feature 176: m=a or c
  misc_feature 177: m=a or c
ccatgtcattgcacttttgatttacattgagttttctttgawyaaaaaaacccatgtattcgtttaactcattgaagcgtttgcaaaattcatcttgtacttgtgtcatttttaagacctaartaataaagctttatawwtatctcttctaaatgtcatcttctaagatttacctmmtgt

SEQ ID NO: 27203 - DNA, 147 bp, Homo sapiens
gtatggagacacgtttaggaggttagagcaaggctctaggtgaaagatgatgtgggcttgagtttgggcagaggtgttgggagcttatgaggagtatacagtttgggtgttatggtgggtaggtggtgctgataaggaaggaggcat

SEQ ID NO: 27204 - DNA, 147 bp, Homo sapiens
  misc_feature 33: m=a or c
  misc_feature 43: m=a or c
gttatgcaaataggcttcccacttggcaggggmcgtcttgtcmactcgtttctgtaaacatgggtggcaaaaagagaagatggagctgccatttagaacatgcctaatcccagcttcatcttgctgagcaaaaatgaagaagcctgg

SEQ ID NO: 27205 - DNA, 106 bp, Homo sapiens
ttgtcccaggctggagtgcagtggtgtggtcttggctcactgcagcctccgcctccctccaacctcgcctcctgggttcgggctattctcctgcctcggcccctga

SEQ ID NO: 27206 - DNA, 456 bp, Homo sapiens
  misc_feature 112: d=a or g or t
  misc_feature 119: r=a or g
  misc_feature 293: s=g or c
cttaaagattgattttatcatcaagttatgacgaacttggggaagaggaaggaaccaggcaaaacaaagaggataaacacacagccatactcctgggccagagggcccagadacaagarcaacattgaaaaagtccaggaaccagttcctgtgcccaaaggtacgaatgtgtcttttcgaattcccttgataaagaagcctcagacaaggaagaaaatagaaatgaaattggacacataaataggacacccagcaaaggccagaagagaggcccttctaggagaagggacatstgtgcttccagctgagatcagcccatgtctctggtcgctctcttgcctgtggatcctgtcttctttcatgtttactacgaggcatgacattcatggcaaaacagggatgccgtttccaagagcagctataaaacaatctgttttcctaaagacagcactctga

SEQ ID NO: 27207 - DNA, 114 bp, Homo sapiens
  misc_feature 41: s=g or c
  misc_feature 47: s=g or c
gacacctgaggagggaagaaaaggagaaggacaaagtggasagggasgagatggagcaatctcttatgtgatcattccatcaactcacaaatttttcacctaacacctggtggc

SEQ ID NO: 27208 - DNA, 99 bp, Homo sapiens
agaaaaatggcgactgtggcagagttgaaggctgttttaaaggacaccttggaaaaaaagggggtattagggcatttaaaagcaaggatccgagctgaa

SEQ ID NO: 27209 - DNA, 306 bp, Homo sapiens
  misc_feature 16: w=a or t
cactacgcctggctawttttttgtatttttagtagagacggggtttcaccgttttagccgggatggtctcgatctcctgacctcgtgatccgcccgcctcggcctcccaaagtgctgggattacaggcgtgagccaccgcgcccggccgagcatctttttcaagtgtttatttgaagggttcaggccttttcccacattttaattgagttgtgtttgttatttcattttgatcattttaaaatatattcttggtacaagtcctttataagacgcatgctttgcccatattttctccaggcccatac

SEQ ID NO: 27210 - DNA, 242 bp, Homo sapiens
  misc_feature 98: w=a or t
tgtaattttccttgccaaaaagcttagtttcatcttttataaatatcctataatgccaagttgattgcatggtcagagtgaatctgtgctgtacccawattcagtagccttctcctatccaacaaagtgttttgtaaataggaggtaaatgaatgagtggatggatggagggatgaatgaatggaattttcttgctcttgatctctgtcttaacagtgatttggttttggaagacacacccg

SEQ ID NO: 27211 - DNA, 226 bp, Homo sapiens
  misc_feature 32: w=a or t
  misc_feature 33: w=a or t
  misc_feature 122: w=a or t
aggattaatgcatggttatttggaccagaaawwagtgccatagaagaccaataactgtttagttgaggctagtctggaacctttcattagagcaatatttggttattgcacttcatttttawttactaagaaatgcaatttgggaatttttaatctgttatgctttgtttatcaaccttgattttaattaagacttttataagactagcttaaaacaccaacccac

SEQ ID NO: 27212 - DNA, 183 bp, Homo sapiens
  misc_feature 16: k=g or t
  misc_feature 66: w=a or t
  misc_feature 67: k=g or t
atctagcggccggcakttccgagcgacttggggtccttgtgcctcggagtggcgtctgggagcaawkgcggcggaggcaaccccgcagttgaggacagtagggatcggtggctttggaccctgcccacggatacctggggccccatgccccgaaggaatggtgccttctgccctcccccgcgc

SEQ ID NO: 27213 - DNA, 299 bp, Homo sapiens
  misc_feature 21: n=a, g, c or t
  misc_feature 57: s=g or c
  misc_feature 99: s=g or c
  misc_feature 129: r=a or g
  misc_feature 132: s=g or c
  misc_feature 134: r=a or g
agttccaccccttggcctgcngggtcctctcaggcacccagcggagtttcgagtcasacttgagctcgggcgtacggctagaccgggctgtggcgatasagtccaaagatggaggaaggaggtcccaarccsarggaatgcagcatgggcctctagaagctggaatgaccctcacctcacggccagcaagaaatcagggaactcagtcttacccgagtgagcaggaaatcgattctcctctgcagcctctatagagaacacagcctgtcaacaccctgattttggcccaatgagcccgt

SEQ ID NO: 27214 - DNA, 399 bp, Homo sapiens
  misc_feature 14: r=a or g
  misc_feature 125: r=a or g
  misc_feature 143: m=a or c
  misc_feature 154: r=a or g
aaaaacatctccarcttccataacctaaaatggccctctcttctgtaggactagatatgtcaagccatcggaatacccatgcgcacaaagcaggacatcttcttccttggtaaactgctgggatrgtagtttccagcagtcamtggggagtgaraacagttgtggaattccaaactgactgatgtctgctggtggttgttttcctccaaatgacccaaagcaacatgacaagaaaatgaattgtacctacgatcacagaggctgatcctcggtcaggtcactgctccttttcaattttctgtctttctaatcagaagatctgtgaacctgaatacatgtattgaatcctggaagctctatgacaatcagaaaacagagaagtaacattacccatccccc

SEQ ID NO: 27215 - DNA, 96 bp, Homo sapiens
taagttttttttatttttgtgttgacatgctttgagcttttttcttattttcttttgtgtatctatacggatattttctttttttttttttttttt

SEQ ID NO: 27216 - DNA, 246 bp, Homo sapiens
agaaggggcctggaattgctcttaggtttctgcctgggtgattggatgttaactgagaatgaatttgagagggaggacccaatctgtagtgaacacagtattggacattttggcatccaggtgcagcacacatttagataaatatatctaaagcttgaagagggttcagaactggaggcttttaaggttagctacctataaatgattgttcaaaccatgagcacgaatcagatcacttaggcagca

SEQ ID NO: 27217 - DNA, 338 bp, Homo sapiens
  misc_feature 15: s=g or c
  misc_feature 121: m=a or c
  misc_feature 139: r=a or g
  misc_feature 140: b=c or g or t
  misc_feature 219: w=a or t
agagctggaggcttsagcctgtggtatctaggctcgcctcactggggttggtggaggtgatggaggttgcagcttggccagcatggtagaaaggtggcagggcacgtctggcttttaccamccagttgcttcgagccarbagatggaggagtcatctgttgcacgctggaggctggagcctgcagatggcatggttctgtggctcacctcgctgcagtwggtggcagagacagagactgcagcttgaccagagtggtggagtgatatgtatctcaagagcactccacaacaaagattctgcctgcaatcctccacttcaaggtctgttccaggaagaa

SEQ ID NO: 27218 - DNA, 273 bp, Homo sapiens
  misc_feature 243: k=g or t
  misc_feature 251: w=a or t
acccatgttaatttatgtagtcctcacaacaactgtatggaatggatctattattaaacccatcttagatacagatgaaaaatctgagtcatagaagggtggaataatctgtctataactgagtacccccatttttctaagagaaagggacttagttattttttaaattattattttcttcttttctctttcctccttttcccctgttccccacttcctacttatctttttagaaatgcagtkatcacctwtaccttcccttcactagccacg

SEQ ID NO: 27219 - DNA, 421 bp, Homo sapiens
  misc_feature 195: s=g or c
  misc_feature 286: k=g or t
  misc_feature 318: r=a or g
  misc_feature 344: r=a or g
  misc_feature 372: d=a or g or t
agtgttcagccatgcaggaggcctctcctcactagcctactcacactacaaccttttctgtgtatttttctcatcacttacccttagtacctagcacagctcctcgtatgaggttaaaggccgaatttcttagccattcttgactgccacttgcaggacctcatcactccttggtctcctgttatgggtgatgcstccactaagttctggccgatgtgctgtaagcagaagtaacgtgtagcacttccaggaaatctctttataagacagttgtcagatgccagtktttttccccttccactgcattattactgccargttcatagccattctgaggatttcaraaggctgatctctggagaactgaggggdtcgaaagattgacttctcaggagcagggctgagaatggaatgggccggc

SEQ ID NO: 27220 - DNA, 330 bp, Homo sapiens
  misc_feature 128: r=a or g
aaaacgttagactacactgcagcatcagaactaaaatctacttcagatggagtttcactcttgtcgtccaggctggagtgcaatggtgtgaccttggctcactgcaacctccgccttccgggttcaarcaattctcctgcctcagcctcccgagtagctgggattacaggcagccaccaccacgccaagttaatttttgtatttttagtagagacggggtttcaccatgttggccaggctggtcttgaactcctgacctcaggtgattcgcctgcctgggcctcccaaagtgctggaattacaggcatgagccaccgcacccgaccccac

SEQ ID NO: 27221 - DNA, 194 bp, Homo sapiens
gtcagactcagccagacaaggacagagcctaaaggagctaagtggaagagtgagcacgcgttatgttctctggccttggcaatggaggtagaatgtcaatgggcaaatggatgtctgggagcaatgggaaaagagaagcacctgagtctgggaaaggagccatgaacagtgggctaagtgaaaagtgcctgggg

SEQ ID NO: 27222 - DNA, 285 bp, Homo sapiens
aacccgctggggtccctttccacagtgtggaagctttgttcttttgctctttacaacaaatcctgctactgctcgctctttgggttaactgcttttatgagctgtaacactcactgtgacaattttgcagcttcactcctcagcccagcgagaccacgagcctactgagaggaacgaacaactccagacgcactggtttaagagctgtaacacttaacgaagaaagtctgcagcttcactcctgagccagcgagaccccgaccacatctgagaccctgagcacca

SEQ ID NO: 27223 - DNA, 270 bp, Homo sapiens
  misc_feature 9: k=g or t
cataaacakaggatgcctttccatttatttgtcttgtttttattttgagatagagtcttgctcatttgtccaagctggagtgcagtagtgtgatcacggctcactgcagcctcaacctcctgggctcaggctatcctcccgcctcagcctctcaagtagctggattgcaggcacatgccaccatgcctggctagtttttgtatttttgtatttttttgtagaagttgggtttcactgtgttgcccacactggtttcaaactcctaggccc

SEQ ID NO: 27224 - DNA, 271 bp, Homo sapiens
aaacacaagaggcaaagatcactcgggaccaccttgtatattggctaccacagaacccaacacaagcagtaagttaaaatcatgaagctcctgacgtcagaggacatggctctgccatttgttaggtagggatcctgttaaaggctcagcttcctcatctggaaatggaaatataggccttgcctggtttgctgtaatgggtcgtgatgaggaccaaactacaaagagtggtacagatgttaattacaatgatttttcctatgccacccat

SEQ ID NO: 27225 - DNA, 128 bp, Homo sapiens
tcccaagtgtaggaaaaatatgcagacatacagatatataggccaactattagtaataatatgaaatatacttaaagagcttttaaaactttgtatttttgtacaaaatatttgtcttttacaatttt

SEQ ID NO: 27226 - DNA, 149 bp, Homo sapiens
  misc_feature 117: w=a or t
  misc_feature 121: r=a or g
  misc_feature 123: w=a or t
  misc_feature 129: w=a or t
  misc_feature 131: w=a or t
  misc_feature 141: s=g or c
  misc_feature 142: s=g or c
  misc_feature 148: s=g or c
  misc_feature 149: s=g or c
tgcagtgacacagtcatagctcgctgcggcctcgacctctcgggctcaggtgatccttctacctcggccacctcagtagctggtactataggcgtgtgctaccacacctggctaaawtttrgwaatttwtwtgtagagatssggtagss

SEQ ID NO: 27227 - DNA, 251 bp, Homo sapiens
  misc_feature 108: m=a or c
gcacttttccttcctgccgccttgtaaagagggtgtcttgcttcaccttcaccttccaccacgattataagtttcctgaggcctccccagccatgctgaactgggcamactctgaccagaagtaagcctttcaaaatcaatattgtgagaagagctgccaaaatttgaccagtaacaggaatcttgaagtcatcagtttttcagaagactgaggtggggcagtaaatccagggcagatgtatgaggggcct

SEQ ID NO: 27228 - DNA, 345 bp, Homo sapiens
  misc_feature 124: n=a, g, c or t
  misc_feature 337: s=g or c
  misc_feature 342: m=a or c
aaagtcttgccgcagtcaccagttttggaggaatgggagaggagctttccactcctctgagagtcatgtcgagagtctgtcttagccctcgacccctcagtctttgtagatctcatcccaaganccccgagggagaggagaagttctggtctctcctcggtgctgcggctgccccaggaagagtttccaggagctgacaagcattcagatgagtaaagatgggatcggattgagaaaaggagaagggagagcatattcgttctctttccacctccctcccacagcctttcatgctgatctcatctgacgaagctgcctcctcctccctggactctasaagcmcca

SEQ ID NO: 27229 - DNA, 67 bp, Homo sapiens
  misc_feature 11: m=a or c
  misc_feature 22: m=a or c
aaaaaacaggmgaaggcagtgmcaaggagaaaggcagttgctctcatagatcagggagaaagccagc

SEQ ID NO: 27230 - DNA, 83 bp, Homo sapiens
  misc_feature 83: m=a or c
agcaggcagcgtctctcaggccttaataggaaaactctgtggttgctgtgtacccaacccaatcagcgtggaaacggcccggm

SEQ ID NO: 27231 - DNA, 362 bp, Homo sapiens
  misc_feature 93: m=a or c
  misc_feature 245: n=a, g, c or t
  misc_feature 246: v=a or c or g
  misc_feature 258: m=a or c
  misc_feature 304: m=a or c
  misc_feature 305: m=a or c
  misc_feature 323: m=a or c
  misc_feature 326: m=a or c
  misc_feature 329: m=a or c
cccaaattcttctcatcttggaaaactgaaactctatacgtattaaacttcccattcccccagcccctgacaatcaccattctaccttctagmtctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacacnvcgttttgttgamccattcacccatcaagggacccaagttgcttccacattttagctammgtgaataatgctactagmaamatmagggcacaaagctgggtctgtgacaccctgctt

SEQ ID NO: 27232 - DNA, 209 bp, Homo sapiens
tttctaatgcaagaggccagcttttcacattacctattaagatattaaggactttcttaattttttaatgattcctcttagtgcccccagctacctccaaattgagggcctattctgaatgtagtggtttttatggttggtagtttacattcttgctctcgatctagtttaccacttcaactattagaatataatgtggaagagaagtt

SEQ ID NO: 27233 - DNA, 96 bp, Homo sapiens
tttagccatagggtcttttatagacagggatagtaaaatgaaaattgagaaatataagatgaaaaggaatggtaaaaatatcttttagggggcaag

SEQ ID NO: 27234 - DNA, 241 bp, Homo sapiens
tggcacatgcctgtaatcccagctgctcgggagctgcaggcacaggaatcacttgaacttgggaggcagaggttgcagtgagcctgggcaacagagtgagactctttctcaaaaaagaaaaaaaacataagtaggggttttgataatgtttttaaatatacaaccctcctggctggctcacgatgttcatttgccgggcgcagtggcttacacctgtaatcccagcactttgggaggccga

SEQ ID NO: 27235 - DNA, 243 bp, Homo sapiens
  misc_feature 17: h=a or c or t
  misc_feature 20: m=a or c
  misc_feature 22: s=g or c
  misc_feature 23: m=a or c
  misc_feature 231: v=a or c or g
tttaattcgttctccahccmcsmctttcatttcagtgaaagtcgcagcagaagagggaactttctggagtttttgagaatgccaaaccacatttttatcacacttctttggaaatcaatgcctttgcatagaaaatcaaattcagggaccacaaagaattttcagtgggaatgtctagtctgaggggtctgaggttgtttttactttattgtgttgtttaaatattttaavaatatctttagc

SEQ ID NO: 27236 - DNA, 265 bp, Homo sapiens
  misc_feature 63: r=a or g
  misc_feature 118: r=a or g
  misc_feature 133: m=a or c
  misc_feature 134: r=a or g
  misc_feature 140: w=a or t
  misc_feature 259: r=a or g
gattgcgggactcagcccagggataattctgtgcccctgtgagacagcttagatggtgacaarctacagatattgaagccagtgggacctgggtttgaagtctgactctgccatttartgaaagaccttgagmrataatwtattctctaacttctcagatcagttggccacctaccacccccagcccagagggagaaagagaatccctgcagccccagggaaaagcccctgggaagctactacccagaggatgtccggrgcgccc

SEQ ID NO: 27237 - DNA, 161 bp, Homo sapiens
  misc_feature 55: r=a or g
tataaataatttttttccttttttgtgatggaatctcactctgttgccaggctgragcgccatggtgcaacctcagcctcctgggttcaagttattctcctgcctcagcctcccaaatagctgggactacaggcatgtgccaccatgcccagctaattttt

SEQ ID NO: 27238 - DNA, 211 bp, Homo sapiens
  misc_feature 13: s=g or c
  misc_feature 14: m=a or c
  misc_feature 55: r=a or g
  misc_feature 188: r=a or g
aagagggtggtgsmcgcccccttcctcccaccacgccctccccagtaccagcggragcttccacttagacttgagcgggggtggggtctctgggggacccattggtggggcgaggcggttgcctcggcgccggaagaagcttctagttaagatgtatccctgataagtactgtctggcaattccgcarcctcgcccgaactgaggggagcc

SEQ ID NO: 27239 - DNA, 154 bp, Homo sapiens
  misc_feature 20: k=g or t
  misc_feature 100: s=g or c
tataaataattttttttccktttttgtgatggaatctcactctgttgccaggctggagcgccatggtgcaacctcagcctcctgggttcaagttattctsctgcctcagcctcccaaatagctgggactacaggcatgtgccaccatgcccagc

SEQ ID NO: 27240 - DNA, 173 bp, Homo sapiens
caggctttttgagatattctttttctgggaattttcattagaataatgcaaatcttgtttaccatttagttttgcatcccaaacctgttctaaactattggctgttagctttgagctcagagagaaaaatacatttagaagtttttattgtgttttctttagttacggtaagc

SEQ ID NO: 27241 - DNA, 161 bp, Homo sapiens
gaattacaggcgtgaaccaccgcgcttggccttagtaagtctgttcttagttgaaaatatgaggggagctgagaagaatagtccatgctggagaaaaaatgaatgtcaggacaactaagaagtgggtatgatcattcaaagagaaggaaaaaggatgaggg

SEQ ID NO: 27242 - DNA, 72 bp, Homo sapiens
gagttgtgatcgtactactgcactccagcctgggcaacaatatgagaccctgtctcaagaaaaaaaaaaaaa

SEQ ID NO: 27243 - DNA, 355 bp, Homo sapiens
cctcaaaaaccgcaacgctcgaccccaggattcccccggctcgcctgcccgccatggccgacaaggaagcagccttcgacgacgcagtggaagaacgagtgatcaacgaggaatacaaaatatggaaaaagaacaccccttttctttatgatttggtgatgacccatgctctggagtggcccagcctaactgcccagtggcttccagatgtaaccaggtgacatgactctcccgaacgttattttgatgtattttcagtgtagatttctcatattgattttcttttttccgctcttcagtcacccggagaaggcatgtgatcaaaacctcttggtgacattttttctaggccaca

SEQ ID NO: 27244 - DNA, 260 bp, Homo sapiens
taaagacataactcatatcagtcgcatcattggacccatccacaccttccaggaacaccgccttcagctgggcccagactgttgcccactccatattccaaaagtaggggagggccagcaccagcatcggagcacagcaccatcctcacccccatccacaagcagaccaaggcggactgttcctggcttcctaaaggcttcctaaagacaatgaggtactccagccccactgcagcctcaggctttgctctcctgccccc

SEQ ID NO: 27245 - DNA, 209 bp, Homo sapiens
  misc_feature 35: y=c or t
  misc_feature 191: s=g or c
aaactccaggtgcccatagttgtgataccaagagyagtagctgttcacacggatcacatccacatacagagcctaggaccagagcagcagagcccgttcagcaatcacaagaccgcatgactcagtactcacatgctgtgggggctcctctgacagagaagactggctgcggctgaatgcggtggcacacscctgtaaccccagcccat

SEQ ID NO: 27246 - DNA, 154 bp, Homo sapiens
ccctttggctgaggctttttcccccgtcgctggctctgcccgaagtttctagagttttctgaccttcaaggcgagaactgctgtgtcattcttagggacactccccaacaaactgcgccacccgagtctctccctcctctcgccagccggccct

SEQ ID NO: 27247 - DNA, 84 bp, Homo sapiens
cttatcaaactgcatactttgaaatgtgtagtttattgtacatcagcactaccttaataaggttgttttttaaaaaaaaaaaaa

SEQ ID NO: 27248 - DNA, 347 bp, Homo sapiens
  misc_feature 199: s=g or c
  misc_feature 302: y=c or t
  misc_feature 344: r=a or g
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttsgttcctttgaaaggctgaataatattccactgggtttagatacaccacgttttgttgacccattcacccatcaagggacccaagttgcttccacattttagcyacagtgaataatgctactagaaacataagggcacaaagctgrgtc

SEQ ID NO: 27249 - DNA, 159 bp, Homo sapiens
  misc_feature 12: y=c or t
  misc_feature 14: s=g or c
  misc_feature 16: s=g or c
  misc_feature 53: s=g or c
  misc_feature 54: s=g or c
  misc_feature 120: s=g or c
  misc_feature 128: s=g or c
  misc_feature 134: s=g or c
ttcttacttttytsasagacagggtctcactctgtcacccaggctggagtgcsstggcgtgatctcagctccctacagtatctgccccctgggctcaagtgcccacttcagcctcctgastagctgcsaccgcsggcatgcaccaccatgcctagcttt

SEQ ID NO: 27250 - DNA, 157 bp, Homo sapiens
  misc_feature 28: w=a or t
  misc_feature 34: n=a, g, c or t
  misc_feature 35: s=g or c
  misc_feature 37: k=g or t
  misc_feature 60: r=a or g
  misc_feature 61: b=c or g or t
gaccccatctcttaaaaacaaatggtgwgcgccnstkgtcccagctgctcagggggctgrbgtgggaggatcgcttgggcccatgagttcaaggcggcagtgatctgcgatcatgccactgcactccaacctggacaacagagtgagaccctgccaa

SEQ ID NO: 27251 - DNA, 265 bp, Homo sapiens
ctggttatctttggtcctttttatactagctattctaaacaggtgtgcaatgatatctccatatgattttgatttgcatctcccttgtgattaatgatttcaagctttttaaatgtatttcttagccacttatacgccttcttttgagaaatgtgtattcaggccttttgtctatttcttaatcaaattatttgtttttcttttataaagttgtttgacttctttatatattttggacgttaatcccttatcagatgtatggctt

SEQ ID NO: 27252 - DNA, 261 bp, Homo sapiens
agttggtaggctgcctgtcaatctttcagagagctcttcgctgagtggagctcagcggtcacctccccctcgtggcgcctcctcacggccatctgaagattcctccggcacagccgatcgcccccgctccggcctcccacacagatggctgtcaaggtcgccataaggcaacctagtccttatggcgataggataaaacggccatattcagattatccgctgagggtggagaggaagtggaaaagtgtatcagaaggccag

SEQ ID NO: 27253 - DNA, 129 bp, Homo sapiens
  misc_feature 104: k=g or t
ctgtattcaatctgttgtgatatgatgggtagcctctgaaacactccactgtatacttgtgaaagaatgaatgtgaaaaaggaaaatagatttgtagtattatkattcaaattgttttgacctcagaga

SEQ ID NO: 27254 - DNA, 112 bp, Homo sapiens
  misc_feature 18: m=a or c
acaaacgccggggcctgmgatcgcggtggatgcacgcgcgggagcctggcttggataccggctgtcccaagaatgacatcactatcagaaagggactctgcagctgagacat

SEQ ID NO: 27255 - DNA, 208 bp, Homo sapiens
  misc_feature 101: s=g or c
  misc_feature 113: m=a or c
  misc_feature 114: m=a or c
  misc_feature 115: v=a or c or g
  misc_feature 119: n=a, g, c or t
  misc_feature 135: m=a or c
  misc_feature 139: m=a or c
  misc_feature 140: s=g or c
taagtgcttttgatagcttagtttacaaccctttggagttaactgtcctgagtggctgcttctttcaaaacaatgtcctgagacattggagcactttgtasattcgtagattmmvaacntaatgttttaggttamagtmsttaagataatagctgtactggcccaccactgtgctaggaaatgtagcttcgactacagcgtctctctc

SEQ ID NO: 27256 - DNA, 115 bp, Homo sapiens
  misc_feature 96: w=a or t
  misc_feature 102: w=a or t
atgctacttataatgcattaacatgctaagatacactctcaccagtgccatgacaatttacaaatgccgtggcgacgttgagaagttacactacawgctctwaaatggggaggac

SEQ ID NO: 27257 - DNA, 56 bp, Homo sapiens
  misc_feature 16: k=g or t
  misc_feature 25: m=a or c
  misc_feature 36: r=a or g
  misc_feature 50: s=g or c
gtgtgtgtgtgtgtgktcataaggmtttattttaaraaattggttcacasaattat

SEQ ID NO: 27258 - DNA, 82 bp, Homo sapiens
tcggctcactgcaagctccgcctcccgggttcacgccattctcctgcctcagcctcccaagtagctgggacaacaggcgact

SEQ ID NO: 27259 - DNA, 152 bp, Homo sapiens
  misc_feature 84: n=a, g, c or t
  misc_feature 102: s=g or c
  misc_feature 145: s=g or c
gccctgaagtccttcctacttcacccctccccagtcactcctatatatggcatctcaccccacctttctcaaacattcctctcnagcaaccctgagattcasaatcctggccattctctgacccaagcagtcctgccccttccascaaacac

SEQ ID NO: 27260 - DNA, 215 bp, Homo sapiens
  misc_feature 66: r=a or g
  misc_feature 67: w=a or t
  misc_feature 106: v=a or c or g
  misc_feature 186: s=g or c
taatacctgtaatgaataatttgatacagcagttacagttacaagtcattgttttgtttggtttgrwtttttgagacggagtcttgctctgtcacccaggatgaavtgcagtggtgcgatctcggctcactgcaacctccgcctcctgggctgaagtgattctcctgctttagcctcctgagtagstgggactgcaggcgtgtgacaccatgccc

SEQ ID NO: 27261 - DNA, 53 bp, Homo sapiens
tatcaagaatccgcaccctcaccctcagtcctcagacactggggtctccggct

SEQ ID NO: 27262 - DNA, 271 bp, Homo sapiens
  misc_feature 48: m=a or c
  misc_feature 101: r=a or g
  misc_feature 103: m=a or c
  misc_feature 211: m=a or c
  misc_feature 212: m=a or c
ctatatatttttccttggttttgttgcctgttaaggctgaagaatagmattggccaggacctaggttctcatattcttggtattcctcctggatggcaaargmtgttggcatcaataggggacagaggctgatgctggagtggccagtagaggtggtggagcagagcagccatcttttaagtggggctgtatcaggctgggtttatttaammgcaacaaaatgttttggttaagaaaattattttgctttcagtgtaaatcttcgcagtgc

SEQ ID NO: 27263 - DNA, 61 bp, Homo sapiens
  misc_feature 34: m=a or c
ctttgtgatgtttgcatttaactcacagagttamacattccttttcatacagcaattttgt

SEQ ID NO: 27264 - DNA, 324 bp, Homo sapiens
  misc_feature 120: m=a or c
  misc_feature 278: w=a or t
  misc_feature 279: m=a or c
  misc_feature 320: m=a or c
aacaacactcaactcgggattggcacccagccagtgccctacactatacaagatgccactgtagggacagggatgacctctagcaaggtgaccctcagtgggccagagggggcttctgamgagaatttctctagcttcttggtgtttcctgcctgctactttcaaacaagggtcccatttttaatgttttcccagtaataccttatgaatgttattgcaaagcagcgggctaaatcaacaccacaggccccgtgatcaatatatgtgatgaggacatwmcatcctggtgttgttgccccaagtcttgacgtgaatctgamcacc

SEQ ID NO: 27265 - DNA, 258 bp, Homo sapiens
aatagagcgcccctgaaaagccccttgtcctgtcctctcttctgctctgcccaggtctgcatgagagttgtaaggcccagggctaggtggcagggttgtcctgaccacttccccaaactgtccctccactgggagatctgcaaagaggggttttcatgcatattcacaggtggccttggagtgtctgtaccatcgagagaagaggattgggattgatttggtccatgacaacgtggagaaaaaccttatccgggaagg

SEQ ID NO: 27266 - DNA, 281 bp, Homo sapiens
  misc_feature 42: w=a or t
  misc_feature 81: y=c or t
  misc_feature 100: w=a or t
  misc_feature 102: m=a or c
  misc_feature 148: r=a or g
  misc_feature 192: m=a or c
  misc_feature 193: r=a or g
  misc_feature 261: r=a or g
  misc_feature 262: w=a or t
aggatgtgtcatcagcttaggattctgttatttacttaattwgagcctaatgatatgaaacatcgttgtaatgttgaagtyttcttatccttttcaaggwgmttcaattccctgaggaaagagaacttacctggagacacacagccarcaagatgagcatctggagcagagaggaattttactttaacggamratagcggtgagggcttgcaacactaaggaattaatgagagatcagcccctttagcgactcaaagcatrwtataactccagctggtcaa

SEQ ID NO: 27267 - DNA, 127 bp, Homo sapiens
  misc_feature 76: s=g or c
  misc_feature 77: h=a or c or t
tcactatttcttgttttagcctctgaagctacctaaaataagtggtcctttttctataaactgctaattaattatshttttgatttgacatagacatttctctttttttccccaaaaaatacggcat

SEQ ID NO: 27268 - DNA, 348 bp, Homo sapiens
  misc_feature 236: w=a or t
  misc_feature 272: v=a or c or g
atacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgatttttwttctaattgtaatttgacgtaatagccatacaaaavatgactctattcatactaggtttagcttctcatggttgtagatattacttcagttcccggtgctggaaaatatgta

SEQ ID NO: 27269 - DNA, 204 bp, Homo sapiens
  misc_feature 4: b=c or g or t
  misc_feature 15: k=g or t
  misc_feature 25: m=a or c
  misc_feature 34: s=g or c
  misc_feature 102: b=c or g or t
  misc_feature 107: r=a or g
  misc_feature 109: b=c or g or t
  misc_feature 129: w=a or t
  misc_feature 165: r=a or g
  misc_feature 167: r=a or g
  misc_feature 184: r=a or g
  misc_feature 188: m=a or c
agtbaaatgtaccakgtaaatcagmagccacttsggacttcgacacaatttggaaatgaatttcacacttaaatcccatctccttactttccaaggtagatbatttrcbgctggttcagtcaacatcawaacaaattcattcatgtaagtctaagcattactgtrarcccctgttgattgtcaragcmaaattcaaagcagccc

SEQ ID NO: 27270 - DNA, 232 bp, Homo sapiens
  misc_feature 145: r=a or g
  misc_feature 146: r=a or g
  misc_feature 232: r=a or g
cgagtagctgggattataggcgtgcaccaccacactcggcttatttttgtattttgagtggagacggggtttcaccatgttggccgggctggtctcgaactcctgacctcaggtgatccaccctcctcggcctcccaaaatgctrraattataggcatgagccaccatgcctggcctatatcattttacttaacagctgtatttagtcttccatgatgtgacaccccactgr

SEQ ID NO: 27271 - DNA, 210 bp, Homo sapiens
  misc_feature 129: w=a or t
  misc_feature 130: w=a or t
  misc_feature 132: w=a or t
  misc_feature 152: w=a or t
caatggccaagcgtcaaaatcctacgtcagtgctaggactgcttttttctatatcagacacgtgggctcctgctgtgtcttcctggaaagcagaggccaaggatggagcagaccaagaggatgccaggwwawaatcacaaagaagcccagawagcacagctggaagccaagaaccctatttttggtttgtgtgggtggaaggtgagggac

SEQ ID NO: 27272 - DNA, 137 bp, Homo sapiens
aaggacatttgagcagctccttagagaagccctcagtcatcaccagcactgatttgccagccatgtacatgggccaccttggaagtggatccacccacagcagtcaaacccctgcctgcaaccccagtctacctctg

SEQ ID NO: 27273 - DNA, 340 bp, Homo sapiens
ccactggaaattttcatggaggtaaatgacaaacgcagattactttgaggatgtagagtagataaaaggctagctaagccgattgtatagtgctaggttgatgagtttttgcttaactcacatagataaaaggatgtgaagattacttgtctctgattatttattatggaccaaatcaacttaatttgactgtaaactgtacccccattgtttagggtcctgagaggatggcatttctttctatccctttgtaaagttccggttctgttggattactttttgtaagtgcagtacttgaatgcctccaagtaccctctttccttggctaatttgtttctgc

SEQ ID NO: 27274 - DNA, 274 bp, Homo sapiens
  misc_feature 10: k=g or t
  misc_feature 45: k=g or t
  misc_feature 73: k=g or t
  misc_feature 74: k=g or t
  misc_feature 75: k=g or t
  misc_feature 117: k=g or t
  misc_feature 125: k=g or t
  misc_feature 144: k=g or t
cagtgaacckccattcatcacccagcttcaacaaccaacttcctkgttcttgtttcatcttttctctccattkkkatttttttcccctggagtattttaaagcaaatcccaaacatkgtattgckttcaaaaatatgtgtctckacatgcacacgtatgtttattgcgggactactcacaatagtaaagacttggaaccaagccagatgtccaacaatggtagactggattaagaaaatgtggcacatatacaccatggaatactatgcagcca

SEQ ID NO: 27275 - DNA, 262 bp, Homo sapiens
  misc_feature 2: k=g or t
  misc_feature 11: k=g or t
  misc_feature 139: k=g or t
  misc_feature 148: w=a or t
  misc_feature 155: d=a or g or t
tkttcattctkcttctggccaaagctcagtacaagacacatgtttagcctatttgtccaatctagattcagaacaagatgtgcaaccagacacttcagcttcctcaaattcatataaagaagatgtgaatttaacttckacttcatgwgatccadaagatcaacagcaatctgaagactctgactaacatgcagaatctacccaataccacactgcccccattaatggaattaaattgggaaaaacaatattgccacctccc

SEQ ID NO: 27276 - DNA, 490 bp, Homo sapiens
  misc_feature 315: r=a or g
  misc_feature 318: n=a, g, c or t
  misc_feature 436: w=a or t
gactgagtctggctctgtcacccaggctggagggcagtggcgtaatcttggctcactgcaacctctgtctcccgggttccagtgattctcctgcctcagcctcctgagtaactgggattacaggctcacgccaccaggcccggctaatttttgtatttttactagagacggggtttcaccatgttaggctggtctcaaactcctgacctcggtggtccacccatctctgcctcccaaaatgctgggattaaggcatgagccaccgcacccagcgttttgcttattttttgattggttggtttttttcttatagarttntaggagttcttcataccttttgggtaccagttcttgatcaggtagctgttctgcaaatattttgtcccagtctgccgcctgtctttttattctgttaacagtcttttccaaaacattwttgttttgaatgaagtccaatttattgattttctcattcacagatcatgctttt

SEQ ID NO: 27277 - DNA, 153 bp, Homo sapiens
  misc_feature 131: h=a or c or t
  misc_feature 140: k=g or t
aaaatttcttacttctctctgaagaagtaagcttgagtgccactggtaggcctacagcaagagtaaaagtggagagagaaacaaagaaaaaggataggagagagaagatgccagatgtacatgcagctgchtactgtttkatatggtggaact

SEQ ID NO: 27278 - DNA, 265 bp, Homo sapiens
  misc_feature 63: k=g or t
tatttttaaatggttacattgtaaactgttatataagtacctgataatatcattaattttgtktcttggcctgccatgcttaaaatattaactctctggccctttaagaaaaaaacgtgctgacccctgctctagatcaaagaaaacaaacctcaaaaatactttcctccctctaccccacttgacccttgtcccggggcagtaggcatctccgtcaaaactcttgtccctggtctgtggtaactttctcagctccccaacccgt

SEQ ID NO: 27279 - DNA, 236 bp, Homo sapiens
taaaaatatctaactagtaaaccttaaaaaacatagttatttataaagtagctggggccaggtgcggtggctcacgcctgtaatcccagcactttgggaggcagaggctggcagatcacaaggtcagacattggagaccagcctggccaatatggtgaaaccccatctctactaaaaatacaaaagttagctgggcatggtggcaggcacctatagtcccagctactctggaggct

SEQ ID NO: 27280 - DNA, 185 bp, Homo sapiens
  misc_feature 139: n=a, g, c or t
cacggtgtctgaaaaaattagctagctacacttgaatagtcatttttaaagttactttgcaaaaatttttaaagctatgcagaaaaatattccactttccccaaaattatgcctaatcgtattctctataatgaatgcnacttaccactagggaaggaaatggaacagagggaacataagggagg

SEQ ID NO: 27281 - DNA, 275 bp, Homo sapiens
  misc_feature 96: w=a or t
  misc_feature 200: w=a or t
  misc_feature 203: w=a or t
  misc_feature 247: r=a or g
gaggggagcagagacttcaaggggaggaagcctgagtgactcagcaatcattgggggacattagggcagagggaggaagtacaggccgggtgcggwggctcacgcctgtaatcccagcactttgggaggctgaggcaggcagatgacttgaagtcaaaagttcgagaccagcctggccaacatggtgaaacaccatctcwacwaaaagtacaaaaaaattatccaggcatggtgacacatgagccargatcgaaccattgcactccagcctgggt

SEQ ID NO: 27282 - DNA, 286 bp, Homo sapiens
  misc_feature 120: w=a or t
  misc_feature 124: r=a or g
  misc_feature 125: d=a or g or t
  misc_feature 139: n=a, g, c or t
  misc_feature 231: n=a, g, c or t
  misc_feature 247: s=g or c
cgctgggcgtggtggctgaagcctgtaatcccagcactttgggaagctgaggtgggtggatcacctgaggtcaggagttcaagaccagcctggccaacatggtgaaaggccgtctctacwacardcacaaaaaatagcngtgtgtggtggtacgtgcctgtgatcccagctactcgggatgctgaggcaaaagaatcgcttgaacccgggaggcagaggttgtagtgagcnaagatcacaccactgstcttgagcctgggtgacagagcaagactccatcacacac

SEQ ID NO: 27283 - DNA, 81 bp, Homo sapiens
  misc_feature 74: r=a or g
aagggcaaaatgctaaccgtacttgaggggcaccatgttagttgtaaaaaacatattattaatgataataagarggccgat

SEQ ID NO: 27284 - DNA, 344 bp, Homo sapiens
  misc_feature 16: w=a or t
  misc_feature 208: b=c or g or t
  misc_feature 209: v=a or c or g
  misc_feature 269: n=a, g, c or t
  misc_feature 307: d=a or g or t
  misc_feature 308: v=a or c or g
aggcagttcttgaggwtcaaggaggcgggggagacctgagctcacgcttgctgagacagaagtcacagcaggattatgcccctcagggcaagaggaaggtgggagctcggctgtggctttagcctggccagctttcaaggctaggacaaggacagggtcgggaattggaaggacccggggggagcggagagctggacgggaaggaggbvccaacgggaggattcagtgttagagttcagaaactgccgccgtaacccaagaacaaagtngcatgcagagccaacctaagagcttcaaaatcgggatdvcttactgagaaagatgtataacataaaacagtcaac

SEQ ID NO: 27285 - DNA, 276 bp, Homo sapiens
  misc_feature 12: m=a or c
  misc_feature 25: s=g or c
  misc_feature 52: r=a or g
  misc_feature 111: r=a or g
  misc_feature 197: m=a or c
taacaggggttmcctgtgggaactsatgaaaggaacaaaactgatgagattrgagagaagagtaagaattatcaatgtatactgctttgatttttgagctatgtgaatgtrtaactattcaaaacattttaaaaataagaagtcatatatttatttactttgtaaagcattttattgtggtaaaacatatataacamaatttgccactgtaactacttttaagttgacaattaagtggcattaattacattcacaatgttgtgcaaccctcacaac

SEQ ID NO: 27286 - DNA, 140 bp, Homo sapiens
aaggctgcgtgttctccaccgcttgttgtggccagtgttactgcggtgaccgccagagcagccttcgcgctatggaggagcccggtgctacccctcagccctacctggggctggtcctggaggagctacgcagagttgtg

SEQ ID NO: 27287 - DNA, 166 bp, Homo sapiens
  misc_feature 19: m=a or c
  misc_feature 52: m=a or c
  misc_feature 152: w=a or t
aaatattaatgtctgtgcmcatcgcagactttcagaatctaatggtgtaagmagaactcagttggagggatagatgcatgtttttctgttatagctcagtggaaaagagttacaattaatagattaattgccaattaaatggtttaaattcwgttagaggaagtct

SEQ ID NO: 27288 - DNA, 466 bp, Homo sapiens
  misc_feature 405: w=a or t
  misc_feature 411: m=a or c
aaaagagtaccagtccctggaccagaccatgctctttccacacttacttctaatataaaacatatttgtgaaaaggagaagaaagaaaagaaaaatgaaaagaaaagaaaaagaaagaaaaagaaggactatcaaggactatgtggatctgacaggcacttctgctcagctctcctctagagactcctagaacatcatcgtttcctgatttctttgctggctgcttttataaccaaactccaaacatcaaaattatcatcttagtcctgggtgttctgtcctaatgtgttaactgcaaaaatgacctcaattcttaggaacttctgccatcagtagctggagtctattgggtttcaagtctgggcctcaagaggcattgcaaactttcatcctctcttttgagawttcggmaccatcaccaaatgaacaagtcccaggtagcctgctggaggatgtacaaccatgt

SEQ ID NO: 27289 - DNA, 170 bp, Homo sapiens
  misc_feature 115: s=g or c
  misc_feature 116: n=a, g, c or t
aattgtatttttagtagagacggggtttcaccatgttagccaggatggtctcgatctcctgacctcgtgatctgcctgccttggcctcccaaagtgctgggattacaggcgtgasnaccgcgcccggccggcctcctttaatttcttaaccataaatatcctccccccct

SEQ ID NO: 27290 - DNA, 133 bp, Homo sapiens
caagttatttaaaaccccagtcttagctaaaaatggaatctgaggctgcaaagatgacagaagatcataatataaactgcatggtgtacagtctagaacacagtcttagtttcccacaatttattaaacgccc

SEQ ID NO: 27291 - DNA, 340 bp, Homo sapiens
aacatatgctagaaagttggtgctctgctgaaattgggccccgagatatttttggaaactttgatgcccatgaggagggaaaactgccaatttgaagtgagaagagtgttttcgtgtctctaaatgtagagtttatggtttagtttttgagaaaattactatttcgagaaataatcactgtgttggacacttaagagaaattgagcaggacccaatttggaattcagacaattaagactttgaggagttaaactatgaaaatttgtctccattgaggatggagatatatttctgtggattgtgtcctttaggagaatgtttcttttctgaacaaggagca

SEQ ID NO: 27292 - DNA, 182 bp, Homo sapiens
acactgcctttatgagctgtaacactcactgggaatgtctgcagcttcactcctgaagccagcgagaccacgaacccaccaggaggaacaaacaactccagacgcgcagcttaagagctgtaacactcaccgcgaaggtctgcagcttcactcctgagccagccagaccacgaacccaccgt

SEQ ID NO: 27293 - DNA, 431 bp, Homo sapiens
  misc_feature 119: w=a or t
  misc_feature 120: k=g or t
  misc_feature 319: r=a or g
  misc_feature 400: h=a or c or t
attttatccagatcctattcaagatagagtcactggttcaaaggcctctgacaaggggacagaaccacttgtggccaagtcctcccaaatgcaacaaccagtggacaggagagtggagwkaggcctggagtgaatgttaatggaatttcctccatgttgaaggaagcataaggctgcagtgcaatggcataatctcggctcaccacaacctccgcctcccaggttcaagtgattctcctgcttcagcctcccgagtagctgggattacaggcgtgccctaccgcacccggctaattttgcatttttattagagacggartttctccatgttggacaggctggtttcgaactcccaacctcagataggattctggttttcgttcaagatagtgtccctgahactagaatcataagctcttggtgaagaatta

SEQ ID NO: 27294 - DNA, 334 bp, Homo sapiens
  misc_feature 159: y=c or t
  misc_feature 217: m=a or c
  misc_feature 262: r=a or g
agttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgctttttttttyccaaggtgatcactttactgtagaagaaatgaggttaacagaaaagagtgagggagamcaacaactcaagcccaacaactctaatgcacccaatgaagatcargaagaagaaatccaacagtcagaacagcatactccagcaaggcagcgaacacaaagagcagacacacggccc

SEQ ID NO: 27295 - DNA, 257 bp, Homo sapiens
  misc_feature 17: w=a or t
  misc_feature 95: r=a or g
  misc_feature 96: m=a or c
  misc_feature 101: r=a or g
  misc_feature 104: m=a or c
  misc_feature 105: m=a or c
  misc_feature 151: k=g or t
  misc_feature 152: s=g or c
  misc_feature 224: r=a or g
  misc_feature 226: r=a or g
  misc_feature 227: r=a or g
cattctggggtgcagtwaagttacttggaaacagtttgattctttggagtcttgcttttaagatttgttaggtgggccaggcacggtggctcacrmctgtratmmcaacattttgggaggccgaggcaggtggatcacgaggtcagcagtksgataccagcctgaccaacatggtgaaaccccatctctactaaaaatacaaaaaaattagctgggtgtggtgrcrrgcgcctgtaatcccagctactagggaggcg

SEQ ID NO: 27296 - DNA, 126 bp, Homo sapiens
aatttcatttagaaacctagttcagaatctgagcaaatttacaagtgacctctgtaataaatggtattgataatcagagaatgtatttcagaatactacagtacaatatattatgaagcatgacca

SEQ ID NO: 27297 - DNA, 150 bp, Homo sapiens
gtaaggaagcccctcctatcaacctctggcctgtacatgagggggactggatggttgtctgtggctttttcccagataacctggtaccaactgcagacagtggagggaactgattggtttggggctagaatcatataccaatggcccaca

SEQ ID NO: 27298 - DNA, 283 bp, Homo sapiens
  misc_feature 13: s=g or c
  misc_feature 41: k=g or t
  misc_feature 42: y=c or t
  misc_feature 142: k=g or t
  misc_feature 143: b=c or g or t
aaacccctttggstcttgttccacgctgtggaaggtttgtkyttcgcaataaattttgctgctgctcactctttgggtctgcactgcatttatgatgtgtaacactcactgtgaaggtctgcagcttcacttctgaggccakbcagaccagaaacccactgggaggaatgagcaactttggatgggaggaacgaacaactgcagatgtgccgccctcagagctgtagcacagtgaacgtctgcggcttcgctcctgaagccagcgagatcacgaacccaccgt

SEQ ID NO: 27299 - DNA, 53 bp, Homo sapiens
  misc_feature 7: m=a or c
  misc_feature 25: y=c or t
  misc_feature 26: s=g or c
gataatmtctaaggaataaaacttysaaaaaaactcaccaaactttttttttt

SEQ ID NO: 27300 - DNA, 176 bp, Homo sapiens
  misc_feature 12: k=g or t
aattttgcagtkacattaagtaaagtgtaaatgcacatgaatggcagcttatagagaaccaccttgtaaccagtatacaggtacaactacagctcttcagaaattggaaggttttgctagccggttatttcatagacactctaaaggtactgcacatgatcagaaaacagccctgg

SEQ ID NO: 27301 - DNA, 248 bp, Homo sapiens
atgcctcctcctaccagtctccttaagacactgcctgcaacagctgattaatcattgttgatgactgcagtttttcccatccttcccgatttacatctgttcaggccaattcaaatatggtaagcggacctcccggtgaatggcttgaggatggttttcgcttgcgtgacttgaatacagtcactatgggggacttgcctgctcggttggactggtctatcatgggctgcactattcttctccggtgc

SEQ ID NO: 27302 - DNA, 208 bp, Homo sapiens
  misc_feature 200: s=g or c
cctcccgggttcacgccattctcctgcctcagcctcccaagtagctgggtctacaggcgcccgccactacgcccggctaattttttgtatttttagtagagacggggtttcaccgttttagcccgggatggtctcgatctcctgacctcgtgatccgcccgcctcggcctcccaaagtgctgggattacaggcgtgagcsaccgcgcc

SEQ ID NO: 27303 - DNA, 284 bp, Homo sapiens
  misc_feature 126: r=a or g
  misc_feature 177: w=a or t
  misc_feature 227: w=a or t
  misc_feature 255: w=a or t
tctaggttccctgcctactatttctgggaactttccttttttaagctcatcaaatggccccttctttaagatttgcttattcagatcttttactcttcagttgttttgacttgggctagaagatargcataaatatcagaatctctgggagagactttttttcttttttttttctgwaagggacttttgagggaagggcagttttcaaaggagccactgccttttgwatcttcattgaatccctgttttcctgtwacctgccaaatatagacatttccctgcga

SEQ ID NO: 27304 - DNA, 431 bp, Homo sapiens
attcagaaacgctgattttagtaaccttaaccctcggcctttggtgggaacttcggctctgtgggaattagtctttgggggactgatggtgatgctgaaatcttattgcgtaggaaattaagtacaacaaagaagacccgtcgtgagaggagagtgcggaagaaatgcgaagtctacgggaggtggcagctgcagaagcttggtgttggatttggagttaggagaccgggaggagcccagcttccggtccagacggttatcttgttgacttgcacgactgcaaacgccctgagctgcttttgcagtctgaaacatcagcgatcccatcaaaatattctgtttcttgggatataagaaacatcccaaggcgggctgtagagcgagagatttggactcgatttaaatacagacaaaatagtatgcatttacta

SEQ ID NO: 27305 - DNA, 402 bp, Homo sapiens
  misc_feature 389: w=a or t
cataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttwtccgttctgattt

SEQ ID NO: 27306 - DNA, 51 bp, Homo sapiens
  misc_feature 2: k=g or t
  misc_feature 6: w=a or t
  misc_feature 20: k=g or t
tkcacwcctcttagggcatkaaagttatccacgttattgtcccacataccc

SEQ ID NO: 27307 - DNA, 335 bp, Homo sapiens
  misc_feature 283: m=a or c
  misc_feature 313: s=g or c
  misc_feature 319: m=a or c
  misc_feature 320: w=a or t
tcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggggactataggcaccaccacacccggctaatttttggtgttttttgtttgtttgttttgtatttttagtagagacggggtttcaccatgttggccgggctggctgmaaactcctgacctcaggtgatcagcccgcstcagcmwcccaaagtgcatggg

SEQ ID NO: 27308 - DNA, 384 bp, Homo sapiens
agggtgtgtttgctggattaacgacaggtcgatgccaatacaggacacccctgcaggtttaaaaaacaaaatggccaaggctcaccccaggtgtcgatggggtgggaggcatggcccaactcctgaagatgtcatggcagtgggcagccaccatggggaatccggccgggatgacagagacagccctgcagcacggcactgctcatagtggggccaggcccttgaggagtctcctgaagccacaaacatacatagtccgcaccctcccctgccccaaactcagcgtgtagcagatcaacctctgtactatcagccaagccaatacaacaagcacagtgatttgtggactactccccaagaacaaaacatcgaagaacagccaag

SEQ ID NO: 27309 - DNA, 352 bp, Homo sapiens
gcccgatgactatcatgagagttcagtataatgtatagtggaaacaagtctccaaagcaaactttactagaaactagagttgtgttctaggttaactcatgtcactttgcttgactctgggatgtcttcttttatacactgggttcactttctaattggctctgcctacccaggttgcgctttaaagccctgagcctggttcactctattacatctaatctctaaactggcctaattccttgccacaaatttcagttttattctctaatgttatcttaccatccctaaatcttcttcacttttgccatgctaacaggccagattaggatatatgactttaacttaccacatt

SEQ ID NO: 27310 - DNA, 186 bp, Homo sapiens
  misc_feature 104: w=a or t
  misc_feature 105: v=a or c or g
atacaccatggaacactacacatccataaaaatgaaatcatgtcctctgcggtaaaatggatgcaactggaagccattatcctaagtgaattaacacagaagawvactatatacagcatgttctcacttataagtgggagctaaatattaggtactaatggacataaagatgggaacagtagacac

SEQ ID NO: 27311 - DNA, 274 bp, Homo sapiens
tcaggattattctatacaagattattattttatataattctacataagattattcattcttccagtaaatatttatggcacatggtaggtactcagtaagatagcttttaattaaatcttgactaatctgtccaaatgcaaaaaattgagccctagtcttttctaacttttaatttcttggtaaaatctacataggataaatctaaggtaaattttggcatggtgagaaatacattagctacacaaatagacaaatcaacacatcgaaggcaga

SEQ ID NO: 27312 - DNA, 259 bp, Homo sapiens
aagaaccagggaagctgactgtgtaactcctagttgagtgtgaagacctgaggtatcaggggtaggggttgctctgcttgtgtaagtcccatagtgtgaaggccagagaaccaagagatggtcaagaagagagagtaagtgtccaatgtcccagctcaagaagagagaaaacttttgtggatagctaagttactgctagccatctgattatagcaatggcttccaggagcatcacgacctgtgcagactccccagcact

SEQ ID NO: 27313 - DNA, 174 bp, Homo sapiens
cttaaatactagcacctccaggcaggcttcctgtcatgggcccctccgagggcagatcttaggtcatgtggtctcaggatgctgaggagtgtgctagactctcattgggggaccttgggtaagtctcaaaggctcagttcactcatctgtaaaataggaagttaaaccaacaaa

SEQ ID NO: 27314 - DNA, 187 bp, Homo sapiens
ttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgg

SEQ ID NO: 27315 - DNA, 54 bp, Homo sapiens
tgtttgtattttcttttcttttctttttttcttttttctttttttttttttttt

SEQ ID NO: 27316 - DNA, 449 bp, Homo sapiens
  misc_feature 31: r=a or g
  misc_feature 129: w=a or t
  misc_feature 282: w=a or t
  misc_feature 312: k=g or t
  misc_feature 313: k=g or t
  misc_feature 351: n=a, g, c or t
  misc_feature 352: v=a or c or g
  misc_feature 371: v=a or c or g
  misc_feature 372: k=g or t
  misc_feature 373: v=a or c or g
  misc_feature 390: y=c or t
  misc_feature 392: n=a, g, c or t
attttcaacacagaaacacggaaaggtagaragtccgtttccttaagtgcggtaaggttttaacaaaaataaggcaaaaaaaattattgcgtcctctctttctcaaacttgcttgccaaacttggagawaactggttagagaagggcgataagatggaattttcttaaaaacatattcataaaaacgaacttctaccttaaggaaatcgtcttccttaaatcctaccattcttacaccggcaagctcagaggtacgggatttcagcattttactcagaattwtgtatttttcctgatgctctggtccctackktttaacaaacttcaaggccgccagggagatccagttgnvttctggcacctgacttcavkvaatgattaaaacaactyangaaaatttggcaatgggacactaaaattggtggaggtggagatttatccgttaattt

SEQ ID NO: 27317 - DNA, 196 bp, Homo sapiens
ttctatgttcctggaaattctttctctatctcttttttcatggtctcactctgttacccaaggtggagtatagtggctcatgatcatagctcactgttaccttaaactcctgggttcaagcaatcctcccacctcagactccccaacagttaggactacagacatgcatcaccatgcccagttattttttcattct

SEQ ID NO: 27318 - DNA, 241 bp, Homo sapiens
  misc_feature 239: w=a or t
  misc_feature 240: m=a or c
agattctctctctgtgtcacactgctcgctgccagattatgggacagaggcggtgtgggcaaattgaaactgcctttcctaccctcttcagtgactgtttccttgatataatgttaaaaccaggaagctggaaggatggattttctgttgtctattgagtcaagaaactgagctggtgatcatgaagataacacctatatataatgaaagagtaaaaggcaagcagaatcagagtcagwmc

SEQ ID NO: 27319 - DNA, 169 bp, Homo sapiens
  misc_feature 22: w=a or t
  misc_feature 105: y=c or t
  misc_feature 118: m=a or c
  misc_feature 124: w=a or t
  misc_feature 135: w=a or t
  misc_feature 143: w=a or t
atttattcttttgggtattgtwccctcctttttatctatttccctctagcaaaatctgacaatcctcaaatgccctttgaacccccctagcccattgtgtatgtyaccatattagcamttactwacacacttcgwattgtttwtgtgattattttatctgctacccaat

SEQ ID NO: 27320 - DNA, 118 bp, Homo sapiens
  misc_feature 12: h=a or c or t
  misc_feature 27: k=g or t
  misc_feature 28: y=c or t
  misc_feature 38: d=a or g or t
  misc_feature 39: d=a or g or t
  misc_feature 104: v=a or c or g
  misc_feature 118: k=g or t
gtgcaaaaaathggccgggcgtggtgkygcgcacccgddgccccagctgcttggaaggctgaggcaggagagttgcttgaacccgggaggtggaggttgcagtvagctgagatcgcak

SEQ ID NO: 27321 - DNA, 314 bp, Homo sapiens
atatttccttccttctgcaagctttgggtttagcttattctttttctagctcctagaggtataaagataggttccttatttgagatctttttttgacataggcatttatcattaaaacattcctcttcttactaaagtattttctttaaccacattcaaatgaaattagaaaccaataactgaaggaaagtttaaaaatttacaaatacatgtaaattaaacaacatatatctaaataaccaatggaccaaagaagaaatcacaagggaaattaaaaaatgcttagaggttaatgaaaacaaaaacacagggtt

SEQ ID NO: 27322 - DNA, 346 bp, Homo sapiens
  misc_feature 196: d=a or g or t
  misc_feature 275: w=a or t
agcgggcgctctgctgactgagaggctcgggtactagggaaaccacccccgccatgggtatgcccaagacaacgatatggatcctaagtactgtcatagagatggaagatgtggaaggcagcataatctggatttaaagcgctctgagatccatccttgggaaagtgacagctaagccgaaacctcaagatgagtdacacgtttgtgagacaaaaaaatggaaaggggcatggaggagtgaagtccaatagaaaagggttaaagtgatgcttgtwgtataggtgacaagtctggggaggcaagttacggccagatcttaaaggccatgtattaaattggtagggct

SEQ ID NO: 27323 - DNA, 225 bp, Homo sapiens
  misc_feature 59: w=a or t
attctaccacgaacacattcatgtcccagatgcagctctaatgcaaattctctgatgtwaggtcatttatcttcaccaggtaacaagaacacaactatacatcctgactgatacacatgtacacatatgaagatcaagataaaaagactgaaagagtttattactcatgaggcctgacttacaagaattgcgaagttgaagtgaaagaatactagacagcaacat

SEQ ID NO: 27324 - DNA, 85 bp, Homo sapiens
agtctctgagtcacccttagcggacagggctgcagacctcgcaggtctgttagcagaatcgcagattgcactctttttttttttt

SEQ ID NO: 27325 - DNA, 223 bp, Homo sapiens
  misc_feature 14: w=a or t
  misc_feature 142: y=c or t
atcctgccgcccgwtttacccgcggagacgccgaggcccgatgccgtatcctgccgcccgttttacccgcgggaaagccgaggcccggtgctgtattctgccgcccattttacccgcggggaagctgaggcccagtgctgtytaatatcttactcatgttcacttgatgagaaagtgacagatctgagacaaacccagttctagaggttatgacaccagccga

SEQ ID NO: 27326 - DNA, 422 bp, Homo sapiens
agaaaggactaacagcactctcagcagagggagactgagtccttcattcctgggaggtgtctgggaagcacatcgcagtgtgcaccgcagcagcaacacaaaatggactaagacacccagcaagccccaggagcatcaaggaagcaggcatgaggtacctgctgggcccaccgtgctcactgctttctcactgcgtctggaggtcctgagttcacaacaatgagaagttttgagctggataaaactgttcatttatggagcatattggaaaaggagggatcacacatgtctcagaaacaatgggatgcatttcctgtttggtagagggaggcttctaaaaggttgattggttacaaaattgcctctctaaaagactcctttctaaaggcaaataaggaaactgaaaagcttaagagatggat

SEQ ID NO: 27327 - DNA, 110 bp, Homo sapiens
tctatatttttataactcttgacttatataaatgggtcagccgttgagtctgaggatgaccagcagcccaaggctattccaggtgctggtatttcttttttttttttttt

SEQ ID NO: 27328 - DNA, 217 bp, Homo sapiens
  misc_feature 157: h=a or c or t
  misc_feature 158: h=a or c or t
  misc_feature 205: s=g or c
accaccgtcccccgcgggaccctggggttagcttcccgctcccccagggtcactcatcacctggctgtcaccagcttcgtcgcttttcacatccgaggtcaaccctggcttggagggaattgaggcccagaggaaagaaggcgcctagccaaggtchhattgtcgggggcgtcagaccccaccttgggcctcccgaatcccagtscactgcccttcc

SEQ ID NO: 27329 - DNA, 144 bp, Homo sapiens
  misc_feature 78: s=g or c
gggaagcacactcagcggagaggagggaaggcgggccggagggggcggggccaccgaggagcattcgacacgtgtgtscctctgtccattaacacattaccaacgccttttgagtattcctcccagtgcagggtgccgggaacc

SEQ ID NO: 27330 - DNA, 229 bp, Homo sapiens
  misc_feature 145: k=g or t
ggcaaccagctcgggtccccttccacaccgtggaagctttgttctttcactctttgcaataaatcttgctactgctcactcttcgggtccaggctgcttttatgagctgtaacactcaccgcgaagatctgcagcttcactcctkagccagcgagaccacgaacccaccagaaggaagaaactccaaacacatctgaacatcagaagggacagactccagacgcgccac

SEQ ID NO: 27331 - DNA, 185 bp, Homo sapiens
gatttacgtctcccaacattgtgaggttgtcgcccaagtgcattgttcagattctagagctggaaactgggaaactgacttttagctccaggctcagagcctcagctcccatggtcactaaaggcctttcctcactcataactactgggacttagcaaatattaaatgaccgtgcctgtgcaagc

SEQ ID NO: 27332 - DNA, 289 bp, Homo sapiens
caaaattaaaaaattgcttccttcaaggaaacttcacggatgtggatttcatgtgactctgggcatcttctttggaaaggcagtgccccattcctttcttcctaggggcacgtgaatgaaatgagactctgccagtaaacgcctcagttatccagcaggccctctcgaggtagctgctcagaacttaaacacctggaagagtgggaaaggcctctgatgagtcagcacagctgctgctgaggctttgtgctaaagtccatgccctttcctgatggtaaagtgcccccga

SEQ ID NO: 27333 - DNA, 224 bp, Homo sapiens
gactagcctgggcaacatcgcaagactctgtctgtacaaaagaattacaaaattagctgggcatggtagcatccacctgtagtcccagctactcaggaggccaaggtgggaggattgcttgagcccagaagttcaaggctgcagtcagccatgatcacactcctgcactccagcctgggtgacagagctagaccctgtctcaaaaaaaaaaaaaaaaaaaaaaa

SEQ ID NO: 27334 - DNA, 236 bp, Homo sapiens
  misc_feature 95: n=a, g, c or t
gaagtaaatatgattaagtgaatggatcatgttgatatggtataggcatataagaagaagatttgaaaaatggaaaataaaataggatgcaaganaaacaatagctacacaagaaagacatgatccaaaccagaggaaaggaaaacatgagctgaacaactgagtttggggagtcagaagaagctcatttgtttgcttggatggctgaaacatggaccaaaaaggttacccacagt

SEQ ID NO: 27335 - DNA, 113 bp, Homo sapiens
tcggctcactgcaagctccgcctcccgggttcacgccattctcctgcctcagcctcccaagtagctgggacaacaggcgactgccaccacacccggctaattttttttttttt

SEQ ID NO: 27336 - DNA, 116 bp, Homo sapiens
tacaggaactatttgaaaatattgaggaggaggaactcctccccaactcattctatgaggccaacatcatcttgataccaaaatctggcagatacacacacacacacacacacaca

SEQ ID NO: 27337 - DNA, 66 bp, Homo sapiens
  misc_feature 15: k=g or t
  misc_feature 16: k=g or t
  misc_feature 45: n=a, g, c or t
  misc_feature 46: h=a or c or t
tactttctacgtctkktcccactctggacatttcatacaaatganhtagtataatacgtgagtttt

SEQ ID NO: 27338 - DNA, 239 bp, Homo sapiens
  misc_feature 108: n=a, g, c or t
agcagtggatggttcaggttgggaagaagagcagtgggattgccagttaaggttgtggaatcaaagagcaaaggctgttgtgaagtggaatatcaggctcaaatggangtccctcccgaatgagcactgacacctgtgtgcccggacatccacgagggccccaacacctgtgctcctgacagctccatgcactaagcagggcacagtctggatccaggggactgactgtctctggcatt

SEQ ID NO: 27339 - DNA, 199 bp, Homo sapiens
  misc_feature 16: b=c or g or t
  misc_feature 82: r=a or g
  misc_feature 83: w=a or t
  misc_feature 84: k=g or t
  misc_feature 129: r=a or g
  misc_feature 130: s=g or c
  misc_feature 184: r=a or g
  misc_feature 188: w=a or t
  misc_feature 190: d=a or g or t
ctattttaagatggcbctggctgcctgtggagactggattgtgggagtctgcagctgttggagcagcaggttgtgggtggarwkcaggccaagaacaaggacctgaaggagaagcacaagcggcgcaarsgctacgcagacgagcgcaggaagcagctggtggctgccctgcagaactcggatraggwcdgcggggact

SEQ ID NO: 27340 - DNA, 314 bp, Homo sapiens
  misc_feature 286: n=a, g, c or t
  misc_feature 287: n=a, g, c or t
atcgttatacccaactcacagatgagagaagcaaggcacagaaggaagcatccatgatgcccaaaccttaaatgtgaatagaatatttgccaaggtgaagaactaggtacccagtggtaaaatgatgttgctacggcctggaatttgcctttaatcaagtccattgaatgacacgtgagaatttttttgcaatttcttagcatcagaaaaagtattttctgccaaaaagatttgaaaagtcagagccatggagaagggcaagcactttaatccagtgcccacttgnnacctttattgaaaagtgacgggaaaga

SEQ ID NO: 27341 - DNA, 214 bp, Homo sapiens
  misc_feature 69: h=a or c or t
  misc_feature 74: r=a or g
  misc_feature 84: k=g or t
  misc_feature 200: r=a or g
atgtctccaggccatgtcagagaccttcatggcagcccctcccatcacgggcccagagaccctggagghaaaartggttttgtkggccagggccagggtccctgtgctgtgtgaagcctagggactcagtgctgtgcgtcccagcccctccagctgtggctgaaaggggcgaaaacacagctcgggctgtggcttcagarggtggaagccccaa

SEQ ID NO: 27342 - DNA, 247 bp, Homo sapiens
gactagtgtctttcttagaagaggagaggacacagagcgatacagagagcataagaggggatgtcttgtaaagatggaagcagagcttggaatgatgcagctacaaaccactgaacacctagggctgccaggagccgccagaactaggaagaggcaaggaaggagttcttccccagagccttcccagggagcatggtcttgctgacactttgattttggactctggcttccagagctttgagagagt

SEQ ID NO: 27343 - DNA, 135 bp, Homo sapiens
  misc_feature 80: m=a or c
  misc_feature 89: k=g or t
atagtctgataatggaccggccttcattagtcaggtcacgtaagcagtctcccaggctctcagcatccagtggaaacttmatacccccktaccatccttcatctttgggaaaggtagaaagaactaatggtcttt

SEQ ID NO: 27344 - DNA, 147 bp, Homo sapiens
caaattaatcctagattgaggaccaggtagtatgtggtctgattctaactcaacaacttgcagaaactcacttcttttttctttttttttccccaggaggagctatcgtattaactgacgaaactcacttcatttctttggacctgt

SEQ ID NO: 27345 - DNA, 136 bp, Homo sapiens
  misc_feature 119: s=g or c
  misc_feature 123: r=a or g
  misc_feature 127: m=a or c
  misc_feature 133: m=a or c
agatcaggtgagcggaacgagggtggccctctgaatgtggggtcccttccctggagttacggacatatcgccgccccttgggggttccgggacgcctcacctcagggccgcagagatcsggarccgmgggagmaga

SEQ ID NO: 27346 - DNA, 317 bp, Homo sapiens
  misc_feature 108: r=a or g
aaaatttgcagttccacaggaggaataagtacaagaggtccattatacaacatggtggctacacttaataacagtgtatagtcatctggaaaatcaccaggagagtarattttagggcactgatggcatgctgtcactcgcggaacttgagctgcactggtatgcaggcccagccactgtgccaattggatggggatcactttgcctgaagcatacaaatgaggaacactccagacacccgccctcttgctcttttgtgaggatatgcaaaagctgactgcaggtggattcatgatttcaagaatacataggagtct

SEQ ID NO: 27347 - DNA, 344 bp, Homo sapiens
  misc_feature 121: w=a or t
  misc_feature 128: k=g or t
  misc_feature 129: k=g or t
  misc_feature 248: v=a or c or g
  misc_feature 307: m=a or c
  misc_feature 308: m=a or c
  misc_feature 337: w=a or t
aatttggaatacttctgtgcatttgtctgtccaccgtaattttagaaaagcatatccataacgtttacagttgtagtacagttgtggttagttatttgtagtgggattgaaagtaattttwtttcttkktatatttctatatttagtttgtttttttgttgttgttgttttttgagatggagtctcgctttgttgcccagactggagggcagtggcgcgatctcggctcactgcaacctctgcctccvgggttcaagcagttctgcctcagcctcccaagtagctgtgactaaaggtgcacgccgcmmatgcccagctaaattttttgtattttagwagagaac

SEQ ID NO: 27348 - DNA, 192 bp, Homo sapiens
  misc_feature 131: r=a or g
  misc_feature 189: m=a or c
actctggcctggccccacagcggcagtgtccctcccctccccccactcctctcagtgggggcccctccagtccctgagaattggtactacgaaaaggtgaactcctgggcaggaatcttgcctagagcttrcggagtcgagccaggcccctgctgaagggccccagaccaccggccacttctcccccgmggc

SEQ ID NO: 27349 - DNA, 297 bp, Homo sapiens
  misc_feature 21: m=a or c
  misc_feature 91: m=a or c
  misc_feature 125: m=a or c
  misc_feature 126: m=a or c
  misc_feature 133: w=a or t
  misc_feature 143: k=g or t
  misc_feature 249: m=a or c
gcgcgcgtcgtttgctggggmtgtttgtgcgttgctgctgtgctaccgcgttgcgttttctaggcatttacttacacgctttgtggtttamgctctcataaccttgtggttttaatagtccttammttattgwagcgcacgtkacttaaatccagaagcagatgtgtaccccagcaagagataaaatgacgctcagagtcagtagatccaagaccgtgcctgagatcctgaatcctgtttcctacccamtattcagccattgggtcacaagcgatgaaaagagcaccttgaagattt

SEQ ID NO: 27350 - DNA, 113 bp, Homo sapiens
  misc_feature 8: r=a or g
  misc_feature 11: w=a or t
  misc_feature 15: b=c or g or t
  misc_feature 18: r=a or g
  misc_feature 19: s=g or c
attaccarcgwaggbgcrsgggtcaggacgactctcggcagcgccattgcgcgccctctagtggcagccggttttgaggccggcctccggctttgaagttcctcaccgcgtct

SEQ ID NO: 27351 - DNA, 314 bp, Homo sapiens
  misc_feature 87: d=a or g or t
  misc_feature 88: w=a or t
  misc_feature 110: w=a or t
  misc_feature 111: r=a or g
  misc_feature 116: m=a or c
  misc_feature 138: m=a or c
  misc_feature 204: r=a or g
  misc_feature 248: s=g or c
aaaaatgccaccaatcagagccatttctttctcaaggggaactgagtgatttgcagggtttggggaaggttgcttgtccctaaagcdwcattccgtcccactctggtgcwrtgcamggagctcgactatcctgaatcmaccatgattcgacctcatgtcagtcctttggctgccagcccagttcaactccaagctgatgaccartgtcgaccgccagtcattctgaacatttgaccagttgagctttsaaatgatggcagtcctggctgacattttgggtgaacaatatgagagactgactggttgagcccttc

SEQ ID NO: 27352 - DNA, 99 bp, Homo sapiens
  misc_feature 15: k=g or t
  misc_feature 37: s=g or c
  misc_feature 59: k=g or t
acaggcagggggaakggggaggggacggtagcgtcasctacacccacacgcagtttcckgataaaaggtcctttggaaactttgattctcttctcacca

SEQ ID NO: 27353 - DNA, 252 bp, Homo sapiens
  misc_feature 116: m=a or c
  misc_feature 135: w=a or t
  misc_feature 152: n=a, g, c or t
  misc_feature 244: y=c or t
atttttactagacatgggtttcaccatgttggcctggctggtcttgaactcctgacctcgtgatcacttacctcggcctcccaaaatgctgggattacaggtgtgagccaccgtgmcctgccattcttttttgtwcctttcataggctttanggttcctttcaagcttcaaagttctgtgattaaaaattttttttcttgtctttaaaacatggaatttttgatttttgaaaaatatttgctcygtatactt

SEQ ID NO: 27354 - DNA, 237 bp, Homo sapiens
  misc_feature 15: r=a or g
  misc_feature 118: w=a or t
  misc_feature 129: w=a or t
  misc_feature 155: b=c or g or t
  misc_feature 236: b=c or g or t
  misc_feature 237: h=a or c or t
ttttttgacactgcractcccatgaggccctgcagcgtccctggcgccgctgaagacgccctggaactcggctggcttcggagggctcggtgactctggccgcgctgcattatggaawacagagtctawgagaaaactagcccggcaccgactcbggaccaagcacacgtgtttaccttgtgcactggggtgggggcgtcagtgaagagcagctaacaagatttcgtcataaagabh

SEQ ID NO: 27355 - DNA, 91 bp, Homo sapiens
acttccgtcaccggcgcgggaagatgacgcacgtctgggcggagtcctgatgagggccggggcctagggaggggcggtgtcgtagggcgga

SEQ ID NO: 27356 - DNA, 239 bp, Homo sapiens
  misc_feature 38: s=g or c
  misc_feature 39: k=g or t
  misc_feature 62: s=g or c
  misc_feature 63: s=g or c
  misc_feature 119: w=a or t
  misc_feature 124: m=a or c
  misc_feature 127: m=a or c
  misc_feature 228: s=g or c
agtggacactgtcagctcaccgccatcgccgtcgaggskctcccacacgctgtgctcactgsscagtagcttgggctcctgacactgatgacgagaagcctcatcagtaacccagcccwtctgmtcmtaccactgggatgtccctgaggactgggaaggcttccaacacactcaggggacctgggttccctagtgtctcaggatgccccagagtcccctccccagacsatccgcttcca

SEQ ID NO: 27357 - DNA, 319 bp, Homo sapiens
  misc_feature 204: m=a or c
  misc_feature 205: r=a or g
gaacttgaaatatttttttcagagtttctcacacactttaaaagtctaacttttttgtgtgtaagcatttagcttgccagcatatttctttttggctccttaaattgcggttgtgtttgcagtattgtcacttttgctctcactgttatgttgaataataattagcatataattgtctacagaagcaagagcaatctggaaggmrcaaaaatgttttctgtgattaacagtgaagaccttgtaaatgcagatgtgtgataaagcatttagtcagtcccccaaacagtcatgccaactgtgaaggaatgtcccacaaagc

SEQ ID NO: 27358 - DNA, 107 bp, Homo sapiens
aaaaatgggggtggaggaggcatggataggggaagtttctgtggtcaggttgaaacattgagtaaaattatttatgcagctaacatttactgattgtgacagatgct

SEQ ID NO: 27359 - DNA, 310 bp, Homo sapiens
  misc_feature 114: r=a or g
  misc_feature 119: m=a or c
  misc_feature 283: r=a or g
caggattattttaattaatttttttcataattgagacagaactgtttgttatgtaccataatgctaaataaaactgtggcacttttcaccataatttaatttagtggaaaaagraagamcaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgrggagaaattaaatactctgagggccat

SEQ ID NO: 27360 - DNA, 275 bp, Homo sapiens
  misc_feature 92: k=g or t
  misc_feature 155: s=g or c
  misc_feature 212: n=a, g, c or t
aggtcaggggcgtgcgcccgctgggtcagcgccctccttcctgccggggaagggaagtgcgtcggtaggggagggctcacctctccaggttkaaacgatggcggtcagaaccgcctgaggtaaaaacgggtggcactggggaagcggaggcgtastcccgagagcctcacacttgtgctcagtgccgcctcacccctggtggatccgcgatngccgcggattcccctggattgccggcgctgggcaggagcgccacctctaatctctcccgagtc

SEQ ID NO: 27361 - DNA, 361 bp, Homo sapiens
  misc_feature 112: k=g or t
  misc_feature 114: y=c or t
  misc_feature 117: w=a or t
  misc_feature 120: s=g or c
  misc_feature 131: m=a or c
  misc_feature 170: m=a or c
  misc_feature 171: m=a or c
  misc_feature 210: m=a or c
  misc_feature 268: r=a or g
  misc_feature 302: b=c or g or t
  misc_feature 311: w=a or t
  misc_feature 344: b=c or g or t
  misc_feature 345: n=a, g, c or t
aaagtttgaggatggaccaactgagaccagtgttgctggagcacaaagtgccaaggagagaaatggcaggctaaggctggaatatgcagggccaaaagagaaacattggcckayttwgasaaccttaaagmggactccaggaatatcaccaacagcatgacctttgcgammaaatccagcaaccagaacttcatcattttcctggaatamaataagaagtttatttctggtgttggtggcgatcacaaaaatactttcatgtgaggaractcccttgcatcagataaaaatgtgagggaggbcaccccaawcaacagaaggtacgatagagttgaaatactcabntcaataaagttcaagc

SEQ ID NO: 27362 - DNA, 198 bp, Homo sapiens
  misc_feature 112: m=a or c
  misc_feature 116: m=a or c
  misc_feature 132: m=a or c
aacaccagcaatgcgcatgcaaagcaggaaaggccctgcaaggcatgctaagaacgaggacggccatccgcccaccaaggagagaagtattaggaggcaacaaaccggccamcacmttgatcttggacttcmagcctccagaactgtccgcagcttgggctaccttccagcataaagtcactaaagatgtgccgggcc

SEQ ID NO: 27363 - DNA, 185 bp, Homo sapiens
  misc_feature 118: s=g or c
  misc_feature 119: m=a or c
  misc_feature 122: k=g or t
tagttaagttctgtatttagtgaattaattgcatcctgtatggatataatcattatagatttgtggtaaatcaacctattttatgagtatgtaatatcagtgtttgtctcatgttagsmctkgacttaaaacatatctaatacacaattgtagttactattttcataaaatgttttttttttttt

SEQ ID NO: 27364 - DNA, 260 bp, Homo sapiens
  misc_feature 117: r=a or g
  misc_feature 122: m=a or c
  misc_feature 124: m=a or c
cagatggtggtgaggttgtagagaaaaaggaacgcttatacactgttggtgcgagtgtaaattagtttaaccattgtggaagatgatatggcaattccacaaagacctaaagtcagraattmcmattcaacccagtaatcccattactgggtatatactcaaaggaatataaattgttgtgttacaaagacacatgcatgcgtgtgttcattgcagcactgttcacaatagcagagacatggaatcaacccaaatgccca

SEQ ID NO: 27365 - DNA, 185 bp, Homo sapiens
  misc_feature 119: w=a or t
  misc_feature 121: s=g or c
  misc_feature 122: r=a or g
ggttttcaacgctcggacacggaaatacggtttgcgtctcctcgcgcttttctctcctggagaggggagaagggggctacatcctgccaagtctgtatggttgggccgccggcgccctwasragtccgcgctgggggctgggagcgactggagagccccgagatagttggagaaattgcaggggt

SEQ ID NO: 27366 - DNA, 306 bp, Homo sapiens
  misc_feature 124: m=a or c
  misc_feature 125: m=a or c
  misc_feature 133: r=a or g
agatgacgcacagaaaaatgccaaccctggttccactggcacaagcttcaccttcattcactggagcctcagcccatagccacccagggaggcaggcagggtggtgttaaccttcccatctcammaatggagraaaactgaattggcatataaatgatttgtacatggttaagagttaagacttgaacccaggacttctgaccaactccagtacttttttttgcaagaatttatgttctgaaaagatctcaagctaacccacatggcctggacagcagccttttccacttgcctcctccgacccac

SEQ ID NO: 27367 - DNA, 122 bp, Homo sapiens; identical to SEQ ID NO: 27048

SEQ ID NO: 27368 - DNA, 88 bp, Homo sapiens
atcctcccgcctcggcctcccaacgtgctgggattgcaggtgacagccaccgtgcccagcctagagtttttttgttgttttttttttt

SEQ ID NO: 27369 - DNA, 293 bp, Homo sapiens
  misc_feature 8: k=g or t
  misc_feature 280: s=g or c
cccaaatkcttctcatcttggaaaactgaaactctatgacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccacgttttgttgacccattcacccatcaaagggasccaagttgcttcc

SEQ ID NO: 27370 - DNA, 52 bp, Homo sapiens
  misc_feature 10: s=g or c
  misc_feature 11: w=a or t
gtgggcgcaswtccttaggtataaaatcggctccagtcgcggtaactgaagc

SEQ ID NO: 27371 - DNA, 256 bp, Homo sapiens
  misc_feature 18: k=g or t
  misc_feature 55: r=a or g
  misc_feature 173: h=a or c or t
  misc_feature 227: y=c or t
  misc_feature 228: d=a or g or t
agatcatccagccgccakctgaccagaaagtgtctaacacaatctcttccacgartcggaacttgatacatatttgctgaataaacgaaaagttaaagatgaggcagaaagcacagctccttccaagggcagctctcaagagcccacgttttcagattcagcagtgaagcgghacgcgtctggtacgagactacaagtcgcacaggcggagagggggcccccgggcydctggtttcacgtctccctcctggtcccc

SEQ ID NO: 27372 - DNA, 127 bp, Homo sapiens
  misc_feature 53: n=a, g, c or t
  misc_feature 79: s=g or c
  misc_feature 80: m=a or c
atctcacaggcccgccccttctgtagaaccaatcggaactcgaggcgcagggnctgggtattccaggatagcgcatgcsmagcacgcatggccacagactgccggtcagtgtcagcaggcggtgggt

SEQ ID NO: 27373 - DNA, 210 bp, Homo sapiens
tacatatgagtaactgaaatatttgagtaaaaaaggcaaaagtttaaatttggaatgctgtatatattagagaatatggggaatcatggtgtgaccaactgtacaaggaagattcatatgaaggtcttaggggaaaaagataattctgaagggtgaaaaaaaaatctctcccatggagattcttcacattatatggtttgacataagggt

SEQ ID NO: 27374 - DNA, 98 bp, Homo sapiens
tccagtctgacaagatagtatgcatttctactcatctatcaatccttctaggccagtctatgtagccgggcccttagtccactttctttttttttttt

SEQ ID NO: 27375 - DNA, 154 bp, Homo sapiens
  misc_feature 9: y=c or t
  misc_feature 10: y=c or t
aaaaatatyyaaaatggcggacggaggcagcagcgagtcaagatgagagttcagccgcggcggcagcagcagcaggtaatcattacagcattttacatattcatattcatactcaaccccggctcccgctgcccccccccgccgacttagcatc

SEQ ID NO: 27376 - DNA, 54 bp, Homo sapiens
  misc_feature 2: n=a, g, c or t
  misc_feature 3: w=a or t
gnwttcttaattgtgttgccagagaatattttatctttttagcatttttttttt

SEQ ID NO: 27377 - DNA, 303 bp, Homo sapiens
aaattacccagtctcgggcatgtctttatcggcagcgccaaaacagactaatacacttctctttggttcaatcacatatgcttgacaaaattcgtgttatgaacccagtcatctcatttctcccttcattggttcttgaatacattaatgttgctagtgtcaactaggttatcagtttaccaagcactttttggagtaactatttcatactaactctgtactcctcaaaagctaactttaccacttttaccactcttctttgacccttactttgaagaccttgcttcttagagaatgtggaaa

SEQ ID NO: 27378 - DNA, 107 bp, Homo sapiens
  misc_feature 14: k=g or t
  misc_feature 15: k=g or t
cttggtatagttckkccctgacctgaactaccaattcctaatttccaaaggaaatgacaaagcctatgtaaattgttatagcttattctgaccttgttacctgcccc

SEQ ID NO: 27379 - DNA, 395 bp, Homo sapiens
  misc_feature 58: m=a or c
  misc_feature 121: r=a or g
  misc_feature 124: s=g or c
  misc_feature 132: s=g or c
  misc_feature 133: y=c or t
  misc_feature 290: s=g or c
  misc_feature 343: b=c or g or t
  misc_feature 344: n=a, g, c or t
  misc_feature 345: n=a, g, c or t
  misc_feature 358: r=a or g
ctctgcctccgcgcgcctgcccacgcgctccggtactcgctgctcgcggctggccggmtcgggattccgggctttcttcccgagaccgcgtcccccagctgggccgaaggtggacgctcarggsctggaggsycagcggaatcccctgcgttcagtagccccgctctcccctgtcccgaaggattactctgcccctcagcggttccagtgccctcaaagcaatctgtctctgaagtactggctatcttctgagcgtgtgccagaagatccagctttgttgaaaagcgaascgttagtcccttaatacaaaggatcagggatagcagaaatgaaagtataatgbnnggcagctggaggrattccaggtccactttcacccaagtaatggaagagct

SEQ ID NO: 27380 - DNA, 196 bp, Homo sapiens
acctgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggcccacac

SEQ ID NO: 27381 - DNA, 185 bp, Homo sapiens
ctagtatctttcacacttgtccaaccgtcttatttttttaaaagttctgttgcttgtattaacacgaaactagagagaaatagtttctgaagccagtttattgtgaagatccccaagggggaaggttcgggtagagaaaaatagtaagctggtttagaaactgacgagggcaaacagccaggatc

SEQ ID NO: 27382 - DNA, 248 bp, Homo sapiens
ggatgcaaaatgattagaaaacttttaaattcctaagattgttttaatcagatttatataacatatttattttattttattttttatttttattttttatactttaagttctaggatacatgtgcacaacgtgcaggtttgtcacataggtatacatgtgccatgttggtttgctgcacccatcaactcgtcatttacattaggtattcctcctaatgttattcctcctccagacccccacccgcctt

SEQ ID NO: 27383 - DNA, 329 bp, Homo sapiens
  misc_feature 130: n=a, g, c or t
  misc_feature 158: d=a or g or t
  misc_feature 161: k=g or t
  misc_feature 184: n=a, g, c or t
  misc_feature 277: n=a, g, c or t
aggaagtgaaccgccgccggaagtgcccctcggggcggcgcggcgagggaccggggcctctcctgcaaccgccgttctgtcgccacggatgggaaggagtcgaccgcgagaagaggactggggggaagangggtctcagtgcagacagagttctggadaakactgttgatatcacccgagccgnagggcaagctgggaaaggtagctcggcacagtccggctgttggactacaaatcccagcatactcctggaggagagggcgaggcggcagcgtgntggcctccacggcctcgaaggagatttgtggggtggcgcgtatgtggggacc

SEQ ID NO: 27384 - DNA, 107 bp, Homo sapiens
tcaagtaatttcactagtgcctcatttttaaactgctacttgttttagttttctttgttctctgtaatacagtcaggtagctggacttttttttttttttttttttt

SEQ ID NO: 27385 - DNA, 162 bp, Homo sapiens
  misc_feature 129: w=a or t
  misc_feature 133: w=a or t
ggcctggggaggggatgttcatgaatgtcaagggtctgtatactctttaattattcagtgagtctactctttcactaaaggtctgtttaatatttgtgatcccaggttcctagagtttttatttttgtwtttwgttttgcactgatactctttttttttttt

SEQ ID NO: 27386 - DNA, 438 bp, Homo sapiens
  misc_feature 193: n=a, g, c or t
  misc_feature 194: w=a or t
  misc_feature 321: k=g or t
  misc_feature 322: r=a or g
  misc_feature 382: s=g or c
  misc_feature 383: n=a, g, c or t
tttagtaaaggcagagtttcaccatgttggtcaggctggtctcaaactcctgacctcaggtgatccacccaccttggcctcccaaagtgctgggattacaggcatgagccaccatgcctggcctagactcagtatctttaaaacaatatttttcagttatgtcactgtcaccttgaggaataggcactatctnwgggtggtcgtttattttccatttttgtgtgtttaagagtatttctgttaaacttacgttttatatgagatagaatatctgatgggcatctgtagcatactgcacaggtttggcaaccttgtttctckrccctttactcttggtaattactgagagttctgatttattcgtataatgatgttatttatsnatttattctgcaatgacaaatttaaccatgtaataaaaatgttgaaactctttaa

SEQ ID NO: 27387 - DNA, 250 bp, Homo sapiens
  misc_feature 15: w=a or t
  misc_feature 69: r=a or g
  misc_feature 108: w=a or t
  misc_feature 121: w=a or t
  misc_feature 128: k=g or t
  misc_feature 138: k=g or t
  misc_feature 182: n=a, g, c or t
  misc_feature 183: n=a, g, c or t
taattgcttagaaawtataatgggcgtgggccaggtgcggtggctcacgcccataatcccagcactttrggaggccgaggtgggcggatcactaggtcaggagatcgwgaccatcctggcwaacacaktgaaaccctktctctactaaaaatacaaaaaaattggccgggtgtggtggcatnntgcttgtagtcccagctacgtgggaggctgaggcaggagaatggcatgggcctgggaggtggagctt

SEQ ID NO: 27388 - DNA, 407 bp, Homo sapiens
  misc_feature 128: r=a or g
  misc_feature 381: n=a, g, c or t
  misc_feature 382: d=a or g or t
  misc_feature 383: k=g or t
  misc_feature 385: w=a or t
agcaggagtggaatgaaaggtcgcggaggggaggaggcggttggccggggcgagagggcctgcccggggacatgacctttggctctaaaaagaagactccatttttcatgataaaatggcaggtggtraaaacccccagcagaggactaaagaatgctaaagaaccctttaataatgcatcaccccatctcttgaagaacctagtggaggagccgaaaaaaaagaaaagaagtacctaatcacctcctagaatcaaaggtttatgcaaaacttgtgaataataaggtcatacaggcaagacctggcataatacattttggaggctatcaagtagaaaaacaacaccaacagattctgcatctggtcaaatgtttccaatgndkgwcacacgtgttcatattttaccc

SEQ ID NO: 27389 - DNA, 105 bp, Homo sapiens
tacacattctcaccaggagtaaatgagagttattaccccaatcttttccaatatttagtattttcatacttttgaattttagctagcttggtacatgttacggac

SEQ ID NO: 27390 - DNA, 180 bp, Homo sapiens
  misc_feature 167: k=g or t
gaaataatacagagaactcctgtggattctttacacagtttccccagtggtaaacttggaaagttatagtagaatatcacagccaggatattgacactgatacaaagtacaggacagtttcaccatcataaagatcttttgtgttgctcttctagatagccacacckaccccaccccacc

SEQ ID NO: 27391 - DNA, 271 bp, Homo sapiens
  misc_feature 16: r=a or g
  misc_feature 44: k=g or t
  misc_feature 78: k=g or t
  misc_feature 86: k=g or t
  misc_feature 147: y=c or t
  misc_feature 148: k=g or t
  misc_feature 215: w=a or t
catggacaacctttartcagagcatctagagtggcctcttgttkatcctgaagatactgatgggtcttgttttctgtkagtctgtkttgtaatattcttgtcccttccttcatggggaggcttagtttgtccagtccttccatgccyktctatcccagattacctaaatgttcccttctcaggaattctgtctcatcagttcttcacagtgagawaagaggctagatgatggtgtggggggttggagttttcttctaataccgagggtccc

SEQ ID NO: 27392 - DNA, 52 bp, Homo sapiens
  misc_feature 27: d=a or g or t
  misc_feature 45: k=g or t
tatcaaactttttaactgcagtgtttdaatttaatctaatgattkgagtttt

SEQ ID NO: 27393 - DNA, 168 bp, Homo sapiens
  misc_feature 43: k=g or t
  misc_feature 129: r=a or g
  misc_feature 138: d=a or g or t
tctttatgccaaaaatgagaacactggtgtggttgtcgtgaakacccatctgtatcttctggtggcaacttacactgagggcatgtatcctagcatctgtgtggaagccacagagagcctgggagactracctaagadgaaaaggaagttaagtcatcagaggcccac

SEQ ID NO: 27394 - DNA, 85 bp, Homo sapiens
  misc_feature 16: k=g or t
  misc_feature 17: k=g or t
  misc_feature 37: k=g or t
  misc_feature 72: w=a or t
aagactatactttcakkgatcatttctatagtgtgtkactagagaagtttctctgaacgtgtagagcaccgwtaaaccacgagga

SEQ ID NO: 27395 - DNA, 100 bp, Homo sapiens
  misc_feature 13: k=g or t
  misc_feature 16: h=a or c or t
  misc_feature 40: k=g or t
  misc_feature 41: r=a or g
  misc_feature 53: d=a or g or t
ctatccatccatkcahccatcatccatccatccatccackrcacaccgtagcdcggccacagtgctagtcatagaaatacaaagcaaaaagacgtacttt

SEQ ID NO: 27396 - DNA, 225 bp, Homo sapiens
  misc_feature 94: m=a or c
  misc_feature 130: m=a or c
  misc_feature 165: r=a or g
  misc_feature 171: m=a or c
  misc_feature 186: n=a, g, c or t
  misc_feature 209: s=g or c
  misc_feature 210: k=g or t
  misc_feature 211: k=g or t
  misc_feature 212: r=a or g
attatttaaaggctgccgctgccctcgccaccacagtcctgccaggacggcgacagtgaagcacctgggttgagagggagcagcaggtaactgmgcaacccctgcctcccccggccccagcccgtgcctmagcagagccgggtgtggtggggacccgggagtggrtctcamtgcgtgtcgcctgcnaacaccttcctcccccaccatcskkrcccagccccagtt

SEQ ID NO: 27397 - DNA, 221 bp, Homo sapiens
cacaacatttattgattaaactcactgtcctctatgagtgcagtttgtggtgcccccaattataataatattgaaggtcacagatcacagatcaccatgacagatgtaataaagaaaattttgaaatattttgagaattatcaaaatgtgacatagggacatgaagtgagcacatgttattggaaaaattgtgccaatacatttgctcgatgcagggtcaa

SEQ ID NO: 27398 - DNA, 66 bp, Homo sapiens
cccaaattcttctcatcttggaaaactgaaactctatacgtattaaacttcccattcccccagccc

SEQ ID NO: 27399 - DNA, 348 bp, Homo sapiens
  misc_feature 122: s=g or c
  misc_feature 123: k=g or t
agccctttgcctaagattagcctatgggaagcatggcctctgtgtgaattggtggtggattcaaagcacagcatctggggtcctgtgtcaattacgctctcctcaacagaagatctgagtgskggtgcatcttcatggctgctggaaggccccgctgtgtaattacgtctggaattggtgggttcttggtctcaccgacttcaagaatgaagccgtggatcctcgtgctgacagaatcaagttttaaagatccagttaaatgcctggctatcaacttgccaagagctgatccagatggaagccatcatcctaagagtcagacaactcattaactctaaagggaccgcc

SEQ ID NO: 27400 - DNA, 251 bp, Homo sapiens
  misc_feature 4: w=a or t
  misc_feature 176: m=a or c
tacwatataaccacagctggaactgaaaagaaacaaagacaatgataaaatgtgatgccctaagctacaaatttcatctgtagcagaaaaagaattgtcactaaaaactctacgacagtgtgtggaaaacttactgagtgttcagtgctatgcggtctacaagacagtcgtaaaamacagtaaaacacactttctacgcagccattctcaggagtcatctgaaactgcgtacaccagtcctctgcctgccc

SEQ ID NO: 27401 - DNA, 115 bp, Homo sapiens
  misc_feature 78: m=a or c
  misc_feature 79: v=a or c or g
  misc_feature 84: w=a or t
  misc_feature 85: w=a or t
  misc_feature 90: r=a or g
  misc_feature 91: r=a or g
aatcagagctcctgcccgcaccgctgccgctgcagcctcctccgcagcgccccgctcgcaccccgccactctccttgmvctctwwccggrrgcttccctgctttggcttgacctt

SEQ ID NO: 27402 - DNA, 223 bp, Homo sapiens
  misc_feature 126: k=g or t
  misc_feature 127: w=a or t
  misc_feature 165: k=g or t
tatttggcttttgttttgcatgatttttaaaagcagtactcctagggaaatggcctctgaagtatatcagtttcatctcttaccaagactgttaagaagaaactagtgggattttgaacaagttakwataatttggtggtctgaaaaagaccctaaactgaagtkctgtttaaatatagttacatgaatttctctgatactaatgtactcaacagccagggtc

SEQ ID NO: 27403 - DNA, 258 bp, Homo sapiens
gaagatgtgtaagtaaacgttcttgcccatttgtgcattcttggtaacgaaagcgtggatacccatcaacgaagttttgatattggaattcagattggctatcagcgacgcaataaggatgtgttggcttggggttaaaaaaaacgcagaagaactattcgtcgagaagatttgatcagcttcctgtgtggaaaagttcctccaccacgaaactctagagctcccccaagactgactgtagtgtcccctaaccgagcc

SEQ ID NO: 27404 - DNA, 104 bp, Homo sapiens
agtagtgctctgcagtgtttatttcatcctcaagtgtcatcaccagcagtagattccatctcaagaaaccattttctttaaaaagaaactgctcatctattgat

SEQ ID NO: 27405 - DNA, 267 bp, Homo sapiens
caagaaataagctagatagagtgtatgccaagaggaaataaaaacattttaaatttaggtttaatatgtaaatactctgagatgtttaggtagtgattttttaagtttatactctagtgagtaaccatatttttgcttactgaaatatcttggattatttagttattttctgcattttgatgttttattacttactaaatagtataaacatggactacctttctaaggaatcattttactagattattagggttatccctaattaac

SEQ ID NO: 27406 - DNA, 202 bp, Homo sapiens
  misc_feature 138: r=a or g
  misc_feature 158: k=g or t
  misc_feature 162: r=a or g
aaaagtagtaatagtggtcatcctcaccatgttcctaatctttttttttaattttttttattatactttaagttctagggtacatatgcacaacctgcaggtttattacatatgtatacatgtgccattgtcggtgtratgctcccattaactcgtckcttrcattaggtatatctcctaatgctatctctccccactcccc

SEQ ID NO: 27407 - DNA, 416 bp, Homo sapiens
  misc_feature 122: y=c or t
  misc_feature 129: y=c or t
  misc_feature 365: k=g or t
  misc_feature 371: w=a or t
cctctacccaccatccttcccagcctctgttaactatctcattctactctccatctccatgagttcacgtttttagccccacaaatgagtgagcacatgtgatatttgtcatgctgtgcctyatttcgyttaacataatgtcctccattttcatacatgctattgaaaatgacagaatttcattcttttaatgactggctaatatcccattgtgttaatgtaccacactttccttatccattcatctgttgatagacactttgattctatatctttactattttggatagtgctgtagtaaacatgagagtgcagatatatccttgaaatactgatttcctttcttttggatatatactcagcaktgggtwtgcgggatcatgtatatatttattaattcttttgaggaacctcca

SEQ ID NO: 27408 - DNA, 433 bp, Homo sapiens
  misc_feature 131: m=a or c
  misc_feature 134: r=a or g
  misc_feature 309: d=a or g or t
aagaacctttgtacttttgttgttccctctgcctggaatgttcttccctatggacatgattcattctttcactcttttcagatgtcagcacatgtggacgccacacagcagggactctgctctttcggttmcargttcactgacatatccccaggacctaaaacagtgcttgacatatagtagatacccagtaaatatgtgataggagcatgctgctatgtggaatgttcagctttaacccagaagggattgaagactgtttttgatgaggctatcatagccattttaactccaaagaaacacactgtdgaaaaaagaataggatcaagatgtataaactgttgtttaattacgtgagaaacatcttcagtggccaaggaaactgtccatttctctcagaaagcaaatgaaatgctacagctatacccagacc

SEQ ID NO: 27409 - DNA, 297 bp, Homo sapiens
cttctactggcagaaaaagggaaagtgtatctggagtaggaacatccactctagctttcaatcataagccaaaatctctctctggttcatcttatttaaaaaatcagcttagtttctcttagtctaaaattttaaactctgggtcaatccctacaatgctatttcactcttccacttccctccctttctcttcttttttgtttctctttcttttactgctagccatatggttcagctttccttaagagaactcatgcccataatcagagtaatatagaatgtatttaaagagtcggt

SEQ ID NO: 27410 - DNA, 188 bp, Homo sapiens
  misc_feature 132: w=a or t
  misc_feature 133: b=c or g or t
gaccactgtctgtgctgtgtctttcaaaggtcagaagagattgaacctttgtggttttattttccctgagtttgctttttctcatggggaacctgtgttgctgctttgaagtttatacatttgattattgtwbcaagcagagtacctttgaaattttttttcatttaaaaaatatggatcttggctca

SEQ ID NO: 27411 - DNA, 155 bp, Homo sapiens
  misc_feature 123: r=a or g
  misc_feature 135: r=a or g
aaagttctcagagggtgagggtcccacatctcctgcaggacaggccctagctaccgagtcacagaaacccagggccgaagcaaagtcccaatcccagagatgctggggcacacctacaactgraaggaggcttaraaatccttcagagaccaccc

SEQ ID NO: 27412 - DNA, 274 bp, Homo sapiens
ctgctgaacagaatttattttctgagtcaaatataatttattattatttttgtcaaagaagtatttaagctgtgctgtggtgtgagaatgtcattcttgatcttcagccttcgtttgcaagaagagttccagttgatgtggtgtttggttccatggcggggtaccctagggattcatctgttttcttgacttccctttgcatctgagatcctgctggaaaccacggcaacctgtatccactattaggaggtaaaaatcaataaaatggcccata

SEQ ID NO: 27413 - DNA, 436 bp, Homo sapiens
  misc_feature 124: k=g or t
  misc_feature 130: k=g or t
  misc_feature 137: w=a or t
  misc_feature 384: w=a or t
aatatttaatccatcccttctgaaatttgtgtgtgtgtgtggtaggaagtagaaatttacctttttccagatagatagcaaattgtctcagtctcatttattgaggagtcagtcttctttccckattgakttgaaawaattataacccaaatttccacaaatgcatgggttagtttctgggcactagtgatttgctcacctaatcccaaatcagcaccacacttatttaattattatagctttacagtatgacttcatatcttatgagtaaaatttgttctcttaaaaaattgtcttggctatatgagggtattggtgatgttgactccatctcttatttaaatatatatatgtaaatatatatgtaaacggctttattgagawataattttacacatcatacaattaacccacttaaaagtgtacaattcagatt

SEQ ID NO: 27414 - DNA, 251 bp, Homo sapiens
  misc_feature 129: m=a or c
aggaagttttctgcaggagctggaaattcagatgggtctggaagaatatggatagggcactgagaggaacagagtggacactcgggccaggaggataataatgtcagaagtactgccccgagaagcaamcgcctcatttccagagcctaaaagagctgctctgtcagaaccagtacggtttctcatcagagaggctgggcaggccaggaccagatggccagaggggagttggaagggtggttttttttttt

SEQ ID NO: 27415 - DNA, 361 bp, Homo sapiens
  misc_feature 146: w=a or t
ctagaagggttttttttccagtgttatcttcaagaatttttatagtttcacatcttagatttaagtccttaatccatcttgagttgatttgtgtataaggtgagaggtgaggatccattttcattctcctacctgtggccagccawttatcacagcaccatttgttgaaaaaggcttttctcccccactttgtttttgtttgccttgtcgaagatcagttggctataaggatttgggtttatttctgggttctctattctgttccattggtctatgtggctatttttataccagtaccatgctattgtggtgactatggctttagtatagtttgaagtcaggtaatgtgatgcccccagat

SEQ ID NO: 27416 - DNA, 198 bp, Homo sapiens
  misc_feature 123: m=a or c
  misc_feature 198: m=a or c
aaaatgggatccaagcagagacctagaaaaacatgtgtgtattgaggcttaatctctcttgcagcacttggaaccatggactactatgtgcatgacagtgagatagtctgctggaggatagamggctacatgtagaaatgaagcactcggccaacagcctgtgaatgccagacatgtgcatgaggccattgtagatcm

SEQ ID NO: 27417 - DNA, 215 bp, Homo sapiens
aaccatttttttctttgtaattaataagtacaatatcttgtggagagatactttgagactattcacacgtactatttcttatcttgtattcactgaccaattttagcattgttgatgagtttggccttaactgaggtttgccaaatggttttctaattctgtagttcctctattaggaattcttccacaagaagagctttttttccccctgccca

SEQ ID NO: 27418 - DNA, 156 bp, Homo sapiens
ctacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggca

SEQ ID NO: 27419 - DNA, 321 bp, Homo sapiens
  misc_feature 308: m=a or c
actcctcgggtcctctttcatgctgtggaagctttgttttttcgctcttcacaataaatcttgctgatgctcagtctttgggtccacgccacctttataagctgtaacagtcactgcgaaggtctgcagcttcactcctgaagccactgagaccacgaactcactgggaggaatgaacaattccggacgtgccacctttatgaactgtaacactcattgtgaaggtttgcagcttcactcctgaggccagcgagaccccaaacccaccagaaggaagaaactctggacacatctgaacatccgaaggmaaaaactccagac

SEQ ID NO: 27420 - DNA, 392 bp, Homo sapiens
  misc_feature 33: k=g or t
  misc_feature 34: s=g or c
  misc_feature 103: d=a or g or t
  misc_feature 109: m=a or c
  misc_feature 137: k=g or t
  misc_feature 199: s=g or c
  misc_feature 259: w=a or t
  misc_feature 350: m=a or c
atccagatttgaggtggcacatcttccaccackscctgcaccatcagcatgcacggagcgcataaaacaagccctgctcctaatggcagtgaaacctcggatdgcctcmaatcaggtcaatacaactgaattgctgkgctgacttaaagattgaaggactccattttagtaagtagagaagtgtgacctttctcaaccsaggttgtgaatgtggattcacacttatctcaaaaaggcacctggagttttaactttatgwcattgtctcagtactggttgcaaggtatgaccaaaagtgttccttgaatggcacctttttgaatattaatttagaagaaaacatgccagamtgacatacttaccccctccgcactgttactacttccttacca

SEQ ID NO: 27421 - DNA, 223 bp, Homo sapiens
catgtattcaccattatagtatcacagaagtttcactgccctaaaaatcctgtgttctgccttttcaacacttcctgtcacccaatttctatcaactaatcttttgactgtgtccatagttactgtcttttctagagtgtcatacagttgtgaagcaggaagcaggagtgaactccggaggcagggactttactccggaccagattgaagactagccgataca

SEQ ID NO: 27422 - DNA, 269 bp, Homo sapiens
  misc_feature 73: r=a or g
  misc_feature 74: w=a or t
  misc_feature 80: r=a or g
aaaccaaactagcgggggcgtggtggcatgcatctgtaagtcccagctactcgaggaggctggagtgggaggrwcgcttrggcccaggaggttggggctgcagtgagctgtgattgtgccattgcactccagcctgtagagcgagaccctgcctcgacaaaattaagaaaataagtattgttgctccccttttggagatgagtcaaaaagattaaacaactagccccaagtcatggagataattaaaaaagattaaacaactagcccct

SEQ ID NO: 27423 - DNA, 237 bp, Homo sapiens
  misc_feature 142: n=a, g, c or t
  misc_feature 143: n=a, g, c or t
attattcaccagctgcagaccctggagaaataactgaatgtcctacacctcacttttttcatcagtaaaatgggatactagtaacatctttttcctaaagttggactctatcacctaggctagactgcaatggtgcaatcanncatggctccctgcaatctcgaactcctgggctcaagcaattctcctgcttcatcatcctaagagagcctaggactacagatactcctacagcct

SEQ ID NO: 27424 - DNA, 130 bp, Homo sapiens
aatttttccattctggacttttcatataaaagtaaccatataatatgctattttttgtgactggcttcgttcacttagcataatgttttcaaggtttatccacattgttactcgaatgactatttctttt

SEQ ID NO: 27425 - DNA, 165 bp, Homo sapiens
  misc_feature 39: r=a or g
  misc_feature 43: r=a or g
  misc_feature 44: w=a or t
  misc_feature 160: r=a or g
atccgatcgctgtggtgtcctgagagccccgcgagtgaragcrwttggccatgggacttaagatcgagtttccccaggggtcgtggcacttcgagggtttgcaactgtggaagcagaggagaaacaaaaccacccgagaagtgaccccgcggaagcagarggttc

SEQ ID NO: 27426 - DNA, 212 bp, Homo sapiens
ggacatttgggttggttccaagtctttgctattgtgaatagtgccgcagtaaatatatgtgtgcatgtgtctttatagcagcatgatttatagtcctttgggtatatacccagtaatgggatggctgggtcaaatggtatttctagttctagatccctgaggagtcgccacactgacttccacaagggttgaactagttgacagtcccacta

SEQ ID NO: 27427 - DNA, 364 bp, Homo sapiens
  misc_feature 31: r=a or g
  misc_feature 33: w=a or t
  misc_feature 44: w=a or t
aataacggctaccagggaagaccacgctctrawgcacttacccwaaccacctcccacctcctgagctggaggctgggtctgcaggggggcagatacctgaacaaaactggagttttgataacaacaaagaaaatacaattttacttaaagtgatccaaggggacactgagtcagccattcatgaagctgaacatcatttcaagggacgctggctccggtatcatggtgaacgccaaggtgaagagcagccgcatgagatcccaaaggaaagcccgggagtcacacaagtggagtacagcagcaaaccccctccaccgcctgcccttggctttggtcttgccagggaacagctgatgccgactat

SEQ ID NO: 27428 - DNA, 167 bp, Homo sapiens
tataaataattttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaatttttttttt

SEQ ID NO: 27429 - DNA, 322 bp, Homo sapiens
  misc_feature 46: w=a or t
atttattatggtcagcttgttttacatgtccccaatgatgagaaawgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcgttctttgtcatctcttctgagttttcgaatctgtcataaataaactttttcactatgcacct

SEQ ID NO: 27430 - DNA, 236 bp, Homo sapiens
  misc_feature 60: r=a or g
  misc_feature 68: r=a or g
  misc_feature 69: r=a or g
  misc_feature 71: r=a or g
  misc_feature 86: r=a or g
  misc_feature 96: s=g or c
  misc_feature 97: w=a or t
  misc_feature 111: r=a or g
  misc_feature 112: r=a or g
  misc_feature 178: w=a or t
tcctccggtcgatctcttttttttcttctggcacggtccaacagacactcctggcacttrgcttcccrrgrgctgctcgcccccgrcccagaggcswttttccagcggcarrccttattccaccatctttgcagcttccaattcttttcatgttaagttgttttttggagagatatawaaatttattttggtgtttcctgtgatctctgggatcctgatccgcaccactcaacttt

SEQ ID NO: 27431 - DNA, 68 bp, Homo sapiens
taaagaaggcaaatgttcccagccatgttttacattaacatgaattatactgccttttttgtttttct

SEQ ID NO: 27432 - DNA, 71 bp, Homo sapiens
  misc_feature 23: r=a or g
  misc_feature 42: r=a or g
  misc_feature 43: r=a or g
tggggggatgaaggacgccaccraggaagcagaccccaccgrrctcccgaggctgccaggccccccgctca

SEQ ID NO: 27433 - DNA, 287 bp, Homo sapiens
  misc_feature 52: r=a or g
  misc_feature 53: m=a or c
gagcaggaacagttcatggacgaactctgaggaccattctgaggacaagagrmatccagtgtcatgagtggaacatgcagcattttatggctacagagttaaggcaagggttgaattccacgagtcaaaaagcagcccttttcagagacccaactctctggggtgctcaggggcttgggctggattgagaagaaaactgacaagagtaagctgccctctcttctctggccatctcacaaaccacagtgcgggccaactggtcctgcctctttaccacacagaaccac

SEQ ID NO: 27434 - DNA, 248 bp, Homo sapiens
  misc_feature 149: b=c or g or t
tgggaaataagctatattaattaatataacctacactactatttgtgtgagggcagtgattttgatgtgttattgaataagcaatctatagttcatcaaattattcagaatttcaccattaaaccctctcctctgccctccaaaaagcbtatataacactgaatacagcaaaatgtattgtaagtcttcattttgcaactcatctatatttataaaacctctaacaaaatcactgcccttgttaatct

SEQ ID NO: 27435 - DNA, 243 bp, Homo sapiens
  misc_feature 201: k=g or t
  misc_feature 202: m=a or c
  misc_feature 221: v=a or c or g
aggaaatgcacatatgatctcctaaataaaattagaccaccaaggctgagaaacgtttaatttgtggcccatgttacagaactggcttcctcagatagggaattttctttttgccaattctttgattccagaagtaagccatgtcaggtggcaggggtggcatctctccatggtgcccaattccctggctggcatttgaakmagcagggtccttttaatcvtgtggctgcttaccccagagac

SEQ ID NO: 27436 - DNA, 90 bp, Homo sapiens
aattgacttttcatttggttctgtgcatgtccatgttacttggttgatggacttgatcagattcttcttgttttcttttttttttttttt

SEQ ID NO: 27437 - DNA, 256 bp, Homo sapiens
  misc_feature 145: h=a or c or t
aggttgcagtgagccaagatcgtgccactgcactccagcctggtgacagagcgagactccatctcaaaaaacaaacaaacaaacaaaatccttcctaagattttgctaggaattgcattatactatacatcaatttggggagtahtgatatctttactatgttatattttcccgtcaatgaacatagtaagtctcttcagttatttagatctttgattttacgttagcattttgtaattttcagcatatagatcct

SEQ ID NO: 27438 - DNA, 202 bp, Homo sapiens
cagagaggaatagaaaagatcagaggggtaagttggaaagtatggtggtaatctctttgctcttaattaaaagtaggagataatggccttggaaaacagtcagagctgaagcaaactcggcctgtgttagagactggagtggaactaagtgtcgaagaagccagctggcccttgggcaaagaattatgaaatagatggagct

SEQ ID NO: 27439 - DNA, 68 bp, Homo sapiens
  misc_feature 35: m=a or c
  misc_feature 36: m=a or c
acattggcctagatgttgctgtgaaggtatttttmmgatatgtttaacatttaattcagtaggctttt

SEQ ID NO: 27440 - DNA, 118 bp, Homo sapiens
aattttgttcttctcgtggttccagtggggagagaaggaggaagtagggagcggggtggcaggggggggacccgccgcggctgctgccaccgccgccaccaccgcctctgctcgtggc

SEQ ID NO: 27441 - DNA, 281 bp, Homo sapiens
  misc_feature 206: k=g or t
aacccctcctcccagtgctgaagtcccaaggagccgccctgcaggccgaaagaatgagggtcgtgatcaactcagtatgccactggaggctatatgagtaaacagcaaaccgtttctcatgaaagcaggatgtttggcaaactgacaaactgcgtctgccacccagaaggaatgctgaaggcagtcacgacccaggcacaagtgtktcttgtgattaggcataattgaagcctgttaacaataatgtgaacttgtgatcaattaagcagctgaccagtcga

SEQ ID NO: 27442 - DNA, 327 bp, Homo sapiens
  misc_feature 180: m=a or c
  misc_feature 215: m=a or c
  misc_feature 256: m=a or c
  misc_feature 282: r=a or g
  misc_feature 306: m=a or c
  misc_feature 307: y=c or t
atgatgcactgttatggctccctctatgggcaacccagctcttctaatttaaaagttgctgcatttgtgatgattttcatcttgactggggatgtaaccctgggacttctgtaatattggatcatactgataaacctaatttctgacaaattcttcctcatccaattcatgatatgtcamcgtgagattccttatgcagaggcccatgtggcaamaaactgatgtgtccttccaacaaccaggcctgagacctcamaagacccaactggatctcccagacaraagcaggcagaacaccatttctgmygccccacagcgctcaaagtt

SEQ ID NO: 27443 - DNA, 371 bp, Homo sapiens
  misc_feature 170: w=a or t
  misc_feature 230: m=a or c
  misc_feature 362: w=a or t
atacacgctcctctcctttcgcagcgacccctgcaccacttctccagcctgagatcgggaaggaggtggaggaacccggtggcggccagtggcagttttgtgggctctgccgctgggcgatgtggaggctattagaaaccctagaccagtcccctcccatatcatttcawaaaaatgtttaaacaactgtcttttctttttttgagacggagttttgctgttgcccaggmcggggtgcaatggcacgaactcggctcaccgcaacttccgcctcccgggttccagcaattctcctgcctcagcctcctgagtagctgggattacaggcatgcgctaccacgctgggctaattttgtattttwaatagagac

SEQ ID NO: 27444 - DNA, 262 bp, Homo sapiens
  misc_feature 63: m=a or c
  misc_feature 146: m=a or c
  misc_feature 244: d=a or g or t
  misc_feature 245: h=a or c or t
tctccacatcctctccagcatctgttgtttcctgactttttaatgatagctgttctaactggmatgagatggcatctcattgtggttttgattcgcatttctctgatgaccagtgatgatgagcattttttcatatgttttttggmtgtataaatgtcttctttttcaaagtgtctgttcatatccttcacccactttttgatggggtttttttcttgtaaatctgtttaaattctttgtagadhcttgatattagccctaa

SEQ ID NO: 27445 - DNA, 351 bp, Homo sapiens
  misc_feature 118: m=a or c
  misc_feature 203: m=a or c
  misc_feature 205: m=a or c
  misc_feature 208: s=g or c
  misc_feature 212: r=a or g
taaacagggtcgggatgccgatgccggcttggagttagagatgagtcaccgctgagagcagctgcagtagctgagcagtggcagcagagaggcagacgtgagctgagggcgcagaggmaggcagcatctctgagggtccccaaggaacatggctgggagccgtgaggtggtggccatggactgcgagatggtggggctggggmcmacsgggragaagtggcctggctcgttgcagcctcgtgaacgtccacggtgctgtgctgtacgacaagttcatccggcctgagggagagatcaccgattacagaacccgggtcagcggggtcacccctcagcacatggtgggggcca

SEQ ID NO: 27446 - DNA, 233 bp, Homo sapiens
  misc_feature 11: b=c or g or t
  misc_feature 49: y=c or t
  misc_feature 50: k=g or t
  misc_feature 133: y=c or t
  misc_feature 140: y=c or t
  misc_feature 170: b=c or g or t
  misc_feature 171: n=a, g, c or t
aagtggcagcbtcagcacccagggctgtggtaggtcacagtctctgggykggtctcagtgtccaacactgtagctggtgcctgccaggttcccagtggttggggtcaccaggtctgaagagagatgtgctggytgcgggyatggggccagatcctcctgccagttttccbntccctctttctcatccaattgcttatcagcttctcagagaatggttttatccacagccccat

SEQ ID NO: 27447 - DNA, 345 bp, Homo sapiens
  misc_feature 34: s=g or c
  misc_feature 44: m=a or c
  misc_feature 47: w=a or t
  misc_feature 80: w=a or t
  misc_feature 81: r=a or g
  misc_feature 114: k=g or t
  misc_feature 115: d=a or g or t
  misc_feature 139: y=c or t
  misc_feature 216: d=a or g or t
  misc_feature 218: s=g or c
  misc_feature 235: w=a or t
  misc_feature 301: w=a or t
  misc_feature 310: w=a or t
  misc_feature 340: d=a or g or t
tcctctctaaatagtagtttattactgccacatstccatgcatmagwaaaatgttggtgacatttttctagcctggcagwrcagattacttaaagctatttcatttcaaagcakdctgaatgtgacttcatctaaaggyagtattaggtactgcatggaaataggtcattaacttgaaactcttatcaaaatatattttaccagtttccagaattdgsagtacaggaccgcctgwagagagagccattgttcaattccaattcagtgtgagtgacaaagtgaaatttagaagtgaagttgwctatttgawatttaactctttattaaatctttctttaadtttct

SEQ ID NO: 27448 - DNA, 192 bp, Homo sapiens
  misc_feature 116: h=a or c or t
  misc_feature 117: w=a or t
  misc_feature 156: k=g or t
  misc_feature 157: r=a or g
  misc_feature 167: y=c or t
tagtcttagtttttgaggttccagtgtgataatgcaaaaatgctttttaaaacagtttttaattattagtaatatatttctgcctatctctttcacatgcctctatttggaatcghwagttttttagttttttatgccctcctttgaataaaagakrttttgggcayaggttatcaacaccctccccccccc

SEQ ID NO: 27449 - DNA, 151 bp, Homo sapiens
aacaggagcctgaagcagttcaccatggtgagcagttggtcatagatgtgaagaagagagaaagatagcacctggaagtagaaagtgctgcagagacccgtgtttgttcgagatctggttttggttgtacaaataataaactctcagccca

SEQ ID NO: 27450 - DNA, 122 bp, Homo sapiens
tatggactggatagtaaatgtttttccaacaattttgttttagcaaattacatccttatcacaacaccctataaaccaggtactatcattggccctgttcaacagataagaaaactgaggtc

SEQ ID NO: 27451 - DNA, 76 bp, Homo sapiens
  misc_feature 50: r=a or g
  misc_feature 51: w=a or t
tcccacctctcgtcctccagctccctaagccgtcgatctcctgccctttrwgtttctctccctgtgccccggaatc

SEQ ID NO: 27452 - DNA, 127 bp, Homo sapiens
tgaatgtttctgccatcgggatgctgggagttgtagtttctcgggcccctagactcagtagagtggtggtaagtaaaatctttaatgagctatgatggaacagttgctaagaactatacaccccaac

SEQ ID NO: 27453 - DNA, 88 bp, Homo sapiens
  misc_feature 10: n=a, g, c or t
agaccaaggnaggaggatcacttgagcccagaagttcaagaccagcctgggcaacatggcaagaccctgtctctaaaaaaaaaaaaaa

SEQ ID NO: 27454 - DNA, 144 bp, Homo sapiens; identical to SEQ ID NO: 26753

SEQ ID NO: 27455 - DNA, 332 bp, Homo sapiens
  misc_feature 179: n=a, g, c or t
  misc_feature 189: m=a or c
  misc_feature 283: m=a or c
tcttccttaaaaaggaaatacagtgatttgagctagatgaatccagctacattttacttttttttttgagaccgagtctcattctgttgcccagggtggaatgcagtggtgcaatctcggcttactgcaatctccacctcctggggtcaagtgattcttgtgcctcccaggtagctggngactataggmaccaccacacccggctaatttttggtgttttttgtttgtttgttttgtatttttagtagagacggggtttcaccatgttggccgggctggctgmaaactcctgacctcaggtgatcagcccgcctcagcctcccaaagtgcat

SEQ ID NO: 27456 - DNA, 347 bp, Homo sapiens
  misc_feature 195: r=a or g
tggtatgttttttcattttttagatctttaatttcttcaacaatgttttgttgttttcagagtataagttttatagttcttgttaaatttatttctaagtattttatttttgatgctgttttaagtgggattttaaaaaatttagtcttcagattattgtaagtatatagaaatacaattgatttttgtgtattratcttgtatactacaggtttgctgaacttgtatattagttataatagttttttagtggataccttgggatttcgtaaattcaggatcatgtcatctgcaacatagagttttacctctttctttccaatctggattctgtccatcctcactct

SEQ ID NO: 27457 - DNA, 196 bp, Homo sapiens
  misc_feature 69: y=c or t
ggcaacccgctggggtccccttcaccactgtggaagctttgttcttttgctctttgcaataaatcttgyactgctcactctttgggtccacgctgcttttatgaactgtaacactcaccgcgaagatctgcagcttcactcctgagcccagtgagaccacgagcccaccaggaggaacgaacgactccagacgcgc

SEQ ID NO: 27458 - DNA, 278 bp, Homo sapiens
agcccagattctaacaggctgataggtgaaagggacttgtcttgtctcagatgtggcagctccatcttttgttttcagcaaaaagctttccatgaaccacaatgcttgcacctatctggcccctggtgcctcaaaatagaagatatctgaggtcatgactgctatatatgctgagactgccttctagttgccggatataatcagaaatgatacggataatgaaggaatcagggcttcctggagaaatggctggggcagagaatatacaagatgagcac

SEQ ID NO: 27459 - DNA, 362 bp, Homo sapiens
atttgccttcatgttagaagcaccataacgctaagattctgggctctcacaacccttcctgttttctacgtccttgctcatcattagcagctccttcctccgtgtcgcctttagaagttactcttgctccatttcaaaacagcgttttagacaccagcgtttttatcttaagtttaaatgaaaggcagggggcgagattaagtgtacagcacgttctttaggacgtgctctttgtgatggctacgggggtggctcagatagctcttttggtaaatttcccaatcctgcgccatgctccagtgtctagtatgtattagacactcatgaacattaaatgaccaggtgaggtaacattacataat

SEQ ID NO: 27460 - DNA, 247 bp, Homo sapiens
  misc_feature 111: s=g or c
tgtgtttttagtagagaggtttcaccatgttggccaggctggtctcaaactcctgacctcaggtgatccatccactttggcctcccaaagtaccgggattacaggcgtgasaaccatgcccggccaacattagctctattcttaaaattcagttttgttgagatataatttacgtataacacaattttacatgtacaattcagtgagttttgacaaatatatatggtctcataaccaccactcgccc

SEQ ID NO: 27461 - DNA, 459 bp, Homo sapiens
  misc_feature 445: m=a or c
atcaattcgtcaacagagggaacagcagaggacaggggcaggccagcctggcacctagagcctttggatttcatttttacagtgaggtggtttaaaaaagaggaggttaaactgaattatttctaagatttcatccagctgtaaaatcctattattctgaactgccaggcttacaagttcaagaggcagaaggtaaattcctgcagcctttaaatgaacaaaacaaacagcacaagctacactgcgaagatgagtctgcactgcatgtatttctttctacacccaggaacctggcttaccagtatatcaccccagcgttgacatactgacggaatctcactctgtcacccaagctggagtgcagtggtgcgatctcagctcactgcaacctccgcctccctggttcaagcgattcccctgcctcagcctcccgagtagctgggamtacatgtgcgcacc

SEQ ID NO: 27462 - DNA, 246 bp, Homo sapiens
agatatagttcttgcctgcaaagaatttatagtctaatgtgaatgattaagtacataattgaacatgctcgtcttttggagggctggtccaggctcctctaagccatgacgccggctgaggatcagcgagcctgtcatagggaactgcatggatagaagttctccaggacaagcagtggagctgccggatcacaatgggctcgggtacccagcacgcccctccgtccatgagcaccacaggcccct

SEQ ID NO: 27463 - DNA, 370 bp, Homo sapiens
  misc_feature 235: w=a or t
  misc_feature 236: r=a or g
  misc_feature 240: w=a or t
  misc_feature 361: w=a or t
ggttcagattaatggttgggcgtggactggaaactgcagcgtcaagctccttgtcctctgccctaaaagaccaggattctatgggccttgctgggctcttgccttcaaaaacccaggcctcctaattctccccagaaacagctgcattggagaccccaagtctcgggagcacacccctgcttcctgccctgtgactggtcagtctttaacctgtgccttggcgggcgctggcttwrcggwgcttcctctgcagggactgacctcggacacccagcttgtcattgccccgggggcgtcctggctttggttctgttaacacctcagtgctgagaaggcacctcagccctggctttctctcccwgtcccgttt

SEQ ID NO: 27464 - DNA, 104 bp, Homo sapiens
  misc_feature 67: y=c or t
ttttgatctgttgagatattttgagttatttctcataggcttagtttaattataagttgtgacttayacaaattagtatactccgcccccctcctttttttttt

SEQ ID NO: 27465 - DNA, 165 bp, Homo sapiens
  misc_feature 70: m=a or c
tattaaagtaggtagggatggtgtgtagataacatagaagagaaaatatcagtgcctacactccactccmgagctgctgatattgtatgtttagggtaagacatttagtgggtatgtcttcagaatgcttttcagatgactctgaacagaggcagggctgcgatt

SEQ ID NO: 27466 - DNA, 271 bp, Homo sapiens
aagttcaagttcaccatgagccacagcagtaagccatgctttagcctctgacctgtgctccaattttggtacaatgatttctgccatgttctccaacagggtgaggaaacagacagcactaagagaaaaagctggaactcaaaaccaaattaactccaaacttaagttttcccacttcgacaagaaaaggaactgcatgtgtttttctgcctcttgcagatgtatgtcataaaagttggatgccttcctttcaagacatttgaatggaatc

SEQ ID NO: 27467 - DNA, 180 bp, Homo sapiens
catttataaacgaatttgtgtcacctggtatgtcttagatgtgatttgagactttttgttgttgttgacatagctttaataaaattaacataaactgtgactttgtataggctaggaggaaggagagactgaggagtactatgtttggaaggaaagctgaaggtagggcagccggatgaa

SEQ ID NO: 27468 - DNA, 179 bp, Homo sapiens
aagaagtgatttgtgctgtgagcagagctttgaccccagttttgaactcagctgacagtcagcaaaggggaaaccagtctctgtacaaaacaggaaggaaatgagatgaaatgaactgcattataagctaccagagggtgcctaatggcatcttcaccacatagaagtcccaggaagta

SEQ ID NO: 27469 - DNA, 291 bp, Homo sapiens
agattccaaccacgatactgaaaaaaccaaagcccagtctagccatttaaagagaacacatggaagtaaaccaagaacccagccaatatccccagaaattgacaagatgatcctaaaatttatctagaaacacacgggacacagaacagccaagataattttgaaaaataagaacgaaggactcatacttcttgatttcaaaactgactacaaagctacagtaattaacactgtgtgagactggcataaggatatgcatatagattgataaaataaaactgagaagccctt

SEQ ID NO: 27470 - DNA, 97 bp, Homo sapiens
atctgtagtaaaaactgcttctttaaaggctggatagagctggacatggtggctcatgcctgtggtcccagctactcaggaggccaaggtgggagaa

SEQ ID NO: 27471 - DNA, 175 bp, Homo sapiens
atgtagagctggaaaaatgtaagaatacccaatttcttgttctagctctactggtaggggcactaaaaagataaatgaaactgaaactggaaggttttacaaagactatattaacaaactgaagaattttcaggcaccaagttatattttttctgtaattcacctgtgggactta

SEQ ID NO: 27472 - DNA, 293 bp, Homo sapiens
aaaccagagatgtgacccctcctcccagcttgaactttcgaggttaccctccgtctgcatgcccaccatcaaggtatgaggatggtagaagctctcgtcgaaccagatggatgaagaccactaacggcttttgtttcctctggtaacagcaagagacagagcgacatgagagattggaccgcgggctgcactggagaatttactggtaggataattcatccctaaagagattgaagtgagcttcagaatggcaaaagaggagccccagagtatctcaagggacttgcaggaac

SEQ ID NO: 27473 - DNA, 428 bp, Homo sapiens
  misc_feature 392: m=a or c
  misc_feature 423: m=a or c
caatcaatctatgcgacaaatgctactcctaactgcccctcaatgtcacccccaccccaagatctctctcccaattaggagtccatgccgccccaagtcccgctcgaagaatccctgagaaacatcaccccgtccacttcttttcttattaaaacaaaaagacaggaatgtcatatcccacaaatatggctgcattattgccagcaggccattattgacggtgggccattaagaactctgtgaccagcacatatgcctccagacttcctggaaccagaaaacctgcaacaaccaaaaaccacaaaagaagaacaacgggtttctgttccaactggttgatcaacttcttgagtcaacaagtcccaaaaccatgttgtaattttccacccgcmactttgccctgtaaagactgctctccctcamacctc

SEQ ID NO: 27474 - DNA, 204 bp, Homo sapiens
  misc_feature 94: s=g or c
aaccgtgtgggtaactctgatgtaagacatgccaagagcctggcataggactggcacacagtaaactcaaaaccagcccaactctctgcgcaasccctcagcactgccttcaggatgaaggccaaggactttcaagtggtttgcagagccctttagactctgcccctgctaatggctcaggcttctctctccccctccaccccc

SEQ ID NO: 27475 - DNA, 317 bp, Homo sapiens
  misc_feature 110: w=a or t
  misc_feature 113: w=a or t
  misc_feature 136: r=a or g
tgaaacttacttaaaagaagtcattttcccccctgaatcttagtgtaaaggcagctgcagtctgctgacagcttgtggttatgctctgatttactggggaaggaggaggwtgwactattttaaatgcataatagarcattcgtttcgtcatctggaagcagagatggaagaagctggggggaaatgagagacatcactgttgctttcgtggagggaagctttgtagcatgttatcagacagcagtgcatattgaagaaaatatctgttaggaatgcatgtcaccagatgtattttgctttcaagaatggtagacacc

SEQ ID NO: 27476 - DNA, 180 bp, Homo sapiens
tataaataatcttttttccttttttgtgatggaatctcactctgttgccaggctggagcgccatggtgcaacctcagcctcctgggttcaagttattctcctgcctcagcctcccaaatagctgggactacaggcatgtgccaccatgcccagctaattttttttttttttttttttttt

SEQ ID NO: 27477 - DNA, 331 bp, Homo sapiens
  misc_feature 193: s=g or c
tgagatttcaaatgcctagtatttcaaaacttaggttctccaaacgaggagaacctaggtacgtttctttgacaccatcaaccttcatcttttctgtgctatgtccagagcattcctgctgtatagacacttacagattttgtataattgtatgttcattttcacgtgtatagattttacagctgtgtctttsatttatttaagatctggacgttggtggttggctatgtgttgactgtttcattcaagtggaatgcaagcactgaacgctacttgagaacagtttcaattcctgtctggattatattgctttttcatttaggtgggttcc

SEQ ID NO: 27478 - DNA, 204 bp, Homo sapiens
ctcccatgcattgagctcccatctagcttcagcagggcagaacccttctccagatgtgtgtaacttatgtcttgagtatctgggagtagttgaagaacagataattccttccaaacatcaagccttgggattcttggagcaagcagaaagccagtaacttcgctctgttagaggtggaggattttcctatggttccccccttct

SEQ ID NO: 27479 - DNA, 206 bp, Homo sapiens
agcaacccgtttggttatctttctgtgctgaggaaggtttgttctttcactctgcactattttgcaataaatattgctattgctcactttgggtttatattgcctttatgagcttgtaacactcaccatgaaggtctgcagctttactcttgaagcttagcgagaccactaacccaccagaaggaagaaactccggacacgcgcct

SEQ ID NO: 27480 - DNA, 226 bp, Homo sapiens
tggattgaaataaattcctagctccacggtcaggtcagtaggctgccatgatgaaatttgaagaagagtctgttatgatgtgtaataccaatttctggagggcatggctgctctccgaagtactctaacatggacagaagtcgtgggctggtggagtgttgcgtcgctgcttagtgatgtggcagcatggtggccaccgcactccacctcaacacggggaggggta

SEQ ID NO: 27481 - DNA, 219 bp, Homo sapiens
  misc_feature 32: w=a or t
gacagcccactggaaagcttcaatacagctgwggaaatctgcaccctagaagatcctagtacagaaattctacaaccaaccataatcatggaagagccaacttccagcaccaacgagaataaaatgaagagcccctgtgaatctaacaaaagaaaagttgacaagaagaagaagaatctgcacagagcctcagcccctgaacagagtttgaaagagaca

SEQ ID NO: 27482 - DNA, 313 bp, Homo sapiens
  misc_feature 236: m=a or c
  misc_feature 238: k=g or t
gcagctcccgcgcctgcgccatccgtcaccgccctccctttgtgtcgtctcccggtactcagtttggaacggcttggagacaaaggggcctgagagggaagctgcttcctagtgccgagccccagaagaggtggataggcccgaggggcgccttccctaggccttatctcttcccgccctgtgccatggacaccgttctcggaggccgctccccacacttggaaaggctgcccacmaktatgcagacacccggtcggccggcgtcctgaggccattcagctccccggaccgccctcccccgcgtcgcccctct

SEQ ID NO: 27483 - DNA, 164 bp, Homo sapiens
  misc_feature 73: s=g or c
agtttcgtccgagctcagtagagttttgctgttaagactgcgcaaggagctagagagagcggagagcgcggascgggccgcacccgccgagccgtgaaaaaagtacatctcctggaagggatgctttttagctgagctctggtggatgagaggagctagccttt

SEQ ID NO: 27484 - DNA, 107 bp, Homo sapiens
atgattaagtggctaacccttttctctccaagtctctttatcctccagtaaaagaggagtgacagaatacacctcccaggaactgttacaaggattggtgagataac

SEQ ID NO: 27485 - DNA, 231 bp, Homo sapiens
  misc_feature 15: s=g or c
  misc_feature 16: m=a or c
  misc_feature 107: w=a or t
  misc_feature 108: m=a or c
  misc_feature 110: m=a or c
  misc_feature 167: r=a or g
  misc_feature 168: r=a or g
  misc_feature 192: r=a or g
attctcctgcgtcasmtcccgagtagctgggggctcccgccaccacgcccggctaattttttgtgtttttagtacagacggggtttcaccatgttagccaggatggwmtmtatctcctgacctcgtgatccaccccacctcggcctcccaaagtgctgggattacarrtgtgagccaccactccctgccgtraaaggcctaatctttaatgaccctcctgtgcgtgtgaaa

SEQ ID NO: 27486 - DNA, 228 bp, Homo sapiens
  misc_feature 10: s=g or c
  misc_feature 64: d=a or g or t
  misc_feature 101: r=a or g
  misc_feature 113: w=a or t
  misc_feature 125: w=a or t
  misc_feature 129: m=a or c
  misc_feature 159: n=a, g, c or t
  misc_feature 160: n=a, g, c or t
  misc_feature 180: w=a or t
agagcgtgascgcgacctccgcgcaggtggtcgcgccggtctccgcggaaatgttgtccaaagdtcttccagtcctcctaggcatcttattgatcctccartcgagaacatgwatacagagaagwgctmaaatcataaagtgtacagctgatgagttanncagaatatgaccacagcggwgtaaagaaagccaaatcaaaggacccgaatgtgagcaggacctcagaa

SEQ ID NO: 27487 - DNA, 197 bp, Homo sapiens; identical to SEQ ID NO: 26783

SEQ ID NO: 27488 - DNA, 111 bp, Homo sapiens
  misc_feature 17: s=g or c
acaagtcatgtacaacstcaacctccaccaccaaaaggagccattggaaattatgagactcaatgtgttttttttcagtcaataaaggcatcccgatactgttcctttttt

SEQ ID NO: 27489 - DNA, 489 bp, Homo sapiens
  misc_feature 350: d=a or g or t
  misc_feature 436: n=a, g, c or t
  misc_feature 437: n=a, g, c or t
  misc_feature 438: n=a, g, c or t
  misc_feature 439: n=a, g, c or t
  misc_feature 451: m=a or c
  misc_feature 489: y=c or t
cattaaagctatctttaagtccaaatgcctcgcaatgctttatcaccatgctcttttctactgttaaggaaaattaaaccttcatttctttatctgatcttcttggtattatagcagatgacccatttatgtaatacacatttatgtttaggtacaacataagcataggaggtagcctacacccttgaggattcatcatagtgtatagtgtagttggaaatagacatggataaaaacagtatttacaaagtacacttcataacaagtagatgattccaaagtagctcataagtattgggatattaaacaaattacataaaacgtaacaaaattttgccttatggaacaadtaaatcatgcatgtaatatcatttgttacctagttaattgctttctaaaagtgtttgcacttcttttgaatagctaagaagccccnnnngctattgtagcmatattcaaatattattaacattggctgggcagggtggy

SEQ ID NO: 27490 - DNA, 183 bp, Homo sapiens
  misc_feature 121: r=a or g
  misc_feature 127: m=a or c
  misc_feature 128: m=a or c
  misc_feature 142: r=a or g
  misc_feature 143: r=a or g
  misc_feature 149: r=a or g
aaaagttaatgctctaaatcctcgtgtaggacgcccaacatctggatgcacacagcatgactactagtgctgagcagccacccacagagggcatatgcacaaagacattaaatgtaaaagraatggmmtgtgctgagcaacrragaaarctgtatcagagataaaaaccatacagtaagcttc

SEQ ID NO: 27491 - DNA, 214 bp, Homo sapiens
  misc_feature 15: w=a or t
taattataagcaaawataatatgtgcaatttctggtatggatccttaaaaaggagggtaggtggtatgtccttccaatccttctccctttcttctagttggaatatggagctccagcaggtacttggaccatgagttaaccttgagggtggaagacattcacaatgaaacagtaaaatagaagaaccccgagctccagagagccctagcaacct

SEQ ID NO: 27492 - DNA, 131 bp, Homo sapiens
cagttccccccttccctttcttttaatagaaatgtttcttggtgaggtgcagtggcttacacctgtaatcctagaactttgggagaccgaggcaggtggatcccttgaccccaggagttcaagaccactct

SEQ ID NO: 27493 - DNA, 196 bp, Homo sapiens
agatgggctgcgggaactccaccgccaccagcgcgggcgcgggccaaggccctgcaggagcagccaaagatgtaacagaagaatccgtaacagaagatgacaagaggaggtatgtttggtattgcagctggctttagtttgaatggttttggccatacctcatggatttaacacactgtagcatattcccaataga

SEQ ID NO: 27494 - DNA, 54 bp, Homo sapiens
attaatttttttctctaatcttttatctaatgacttcttttttttttttttttt

SEQ ID NO: 27495 - DNA, 84 bp, Homo sapiens
gtcgtgcacgcagttcccaacacttctcgtcatcctctctttggtctctttattctgctgagcggtgctgttaggatttctttt

SEQ ID NO: 27496 - DNA, 244 bp, Homo sapiens
aatgttttaatcgaagaatgtaatgaatataaggctaatttagcagaaggtaggaggtggcctaaataagcttattgatttttttcttaagagggcaaatggaacctcttctaagtgtgtgtggtttataatgagatataatttatgtatacattttaaacgtgcaatttagtggtttttttggtatatttacaaggctgtgcaaccaccaccactgtctccttccaaaacattttagtcaccc

SEQ ID NO: 27497 - DNA, 217 bp, Homo sapiens
caaaaaaattaaaatagaaataaaaacataaggaatttaagaaaaaaccttagaaaaatattagaatacatttacaaggccaaaatttattatttgaaaaattaataaaatagacaagttctaatgacagcaatcaaagagaatgagaagcagcacagtaaatattaagatatgaaaagactacataactactagtatactagtaccactccccccc

SEQ ID NO: 27498 - DNA, 139 bp, Homo sapiens
aaaattctcactgcctaaagattgggctgtctgggaggggcccaaccaccttgtccctgcaggagaaaaggcgggatggcagagagagcaagttctctgcactggaacacaggatctccctccctcacaacctcccacc

SEQ ID NO: 27499 - DNA, 285 bp, Homo sapiens
agtcatgagactggaatttaatgtcacataagctctataaaggaatagttcaaatcacttttctatatgttaattataggatggcttgctctatggtttcaattataattttctataatacttctttgtttatttctttggtgattaagcttgaaaatagttgaaactggtacttagtagtgaaaaggaatgataaaggtttagaataaacatagtagttgatgctaacaggcattttggtgctgggaagatatataagagtattactaatatttgccattcttt

SEQ ID NO: 27500 - DNA, 132 bp, Homo sapiens
acttgctggaaggccactcacaatggccagctttgttcctgcatgggtttgaggaacacaaactctgctatgtccaccagcaccctgtggcccaggacctgccatcatcttcaacaggaaccaaggaaagcc

SEQ ID NO: 27501 - DNA, 348 bp, Homo sapiens
  misc_feature 347: s=g or c
  misc_feature 348: m=a or c
ataagaaaatgaggaaccagagagagatgaaaattttcccaatgtcctaagattatcacactgcatcataactgcccagtaatttttccatctccctcattaacctctagaagccatatgaaggtggttggaaatcccggacccccggtccaccagccttggcctcctgcagatgctaggctcaggatgaagtgcggccgaagactgctgggaaaagaaaagaaagagccctaatgtgccatatcgggcaagccgtggggtggcccactaactgcttttttatgattgtcacttactggctctgatttaaccccacttaaagagtggtggcagcaattgtggagggsm

SEQ ID NO: 27502 - DNA, 51 bp, Homo sapiens
  misc_feature 33: s=g or c
  misc_feature 34: r=a or g
gcaaagcaccgcccctccggcgcggaggctggsraactggcggtctgacgc

SEQ ID NO: 27503 - DNA, 195 bp, Homo sapiens
  misc_feature 105: k=g or t
  misc_feature 106: s=g or c
ggggtttggatgcttcagagaactgcctttcaaactgttcattgtgaacacttccacccacacacttgattatgcaatgttataagttctgtggaactcccactksatgcagatgtacagaccagtaatctactgataacctttttaaagtatagctcaattgtcatgcaggacaccaaagatgaacacaggcga

SEQ ID NO: 27504 - DNA, 252 bp, Homo sapiens
taactactgtcctattctgtgttttatatagtcagaagtttatgatactgaaatgtctgggaaaagattactcagtaacagttacactttttcagtttggacaaccctggtcatataatttgtttctggctatttttattatcgatttcttactgctgatccagtaagttatagaattgtactagtagttttttaatgggcctgttatattctcttaatctgggataatctttttagattgagtcagacctc

SEQ ID NO: 27505 - DNA, 196 bp, Homo sapiens
  misc_feature 135: r=a or g
ctggaacaataaatgtggctgtgcagtttaattctgggctgtgtgtatccatctagctaagtctgcagttttctttcctccaaagacaactcttgtacataagtacagaaatttaagctcacatgtatttgacaratatagtttagtagactagctctatgtgcttttcactttcctcggattttctctccctgat

SEQ ID NO: 27506 - DNA, 121 bp, Homo sapiens
  misc_feature 15: m=a or c
aatcacagagaatgmagaaggaaggctgttcgagaaatatgggcagctcttacaggaaagccccccagcctctaacaggccctctctgggcatcgaaggtgccagtggtcttccaaggccc

SEQ ID NO: 27507 - DNA, 226 bp, Homo sapiens
  misc_feature 120: d=a or g or t
tcaacctccgcctcctgggtttaagcaattctcctgcctcagtctcctgagtggctgggattacaggcgtggcccaccacgcctggctaatttttttgtatttttaagtagagacggggdttcacatggttggtcaggctggtcttgaactctcctaaccttgtgatccgcctgcctcggcctcccaaagtgctgggattacaggcatgagcaccgtgcctggccc

SEQ ID NO: 27508 - DNA, 297 bp, Homo sapiens
  misc_feature 66: m=a or c
  misc_feature 105: m=a or c
  misc_feature 109: b=c or g or t
  misc_feature 171: n=a, g, c or t
  misc_feature 215: w=a or t
cactctgaacaggtgggaaagaagtgaactgcttgttcacttgctgctgttgccactgctggtacmgaaatagaaggtaagacagcacaaaaaaacaaagacaamaaabctccaagctcccttcagtagttgctacaccttcagattgagacgcccttcctcatttacagncctcagctgtgtctgggggcagggccacagtgaaactgccaggwgcaaaaaggcttccaagaaaaagtaccacatcagattggaaactggggacagatcattccttgggatgtgacgggcaccaga

SEQ ID NO: 27509 - DNA, 128 bp, Homo sapiens
aatttttccattctggacttttcatataaaagtaaccatataatatgctattttttgtgactggcttcgttcacttagcataatgttttcaaggtttatccacattgttactcgaatgactatttctt

SEQ ID NO: 27510 - DNA, 259 bp, Homo sapiens
  misc_feature 5: h=a or c or t
  misc_feature 8: k=g or t
  misc_feature 64: r=a or g
  misc_feature 129: w=a or t
  misc_feature 161: w=a or t
  misc_feature 169: r=a or g
  misc_feature 176: r=a or g
  misc_feature 185: d=a or g or t
  misc_feature 196: s=g or c
  misc_feature 218: n=a, g, c or t
  misc_feature 219: s=g or c
  misc_feature 241: n=a, g, c or t
attghtckaaaaacagagtcccaggcaacagggacagagagactggcccagcaggggctctctrggccaactgagcaaggtgacagggcccaggaaaggagctgttgcctgcacaagggcagatggagwcaaggaatcagtgttcatgggatcctggctgwccccacartgtcgtrgctgaaccdtacaagaacasaagcaagtgaagcacaggtagnsagccacctcaagggggaagtantgataacgaagggactca

SEQ ID NO: 27511 - DNA, 74 bp, Homo sapiens
ttcataaattttggtctttctgcaacatttgcattgtgcgtgattcctttcttttcatcttcattaaccttttt

SEQ ID NO: 27512 - DNA, 112 bp, Homo sapiens
attctttcctgcctgccatgatgtaagacgttcctttcaccttccactatgattgtgaggcctctccagccacgtggaacttggccagtttcacaaagaggctgcaggaagc

SEQ ID NO: 27513 - DNA, 85 bp, Homo sapiens
  misc_feature 13: w=a or t
  misc_feature 25: w=a or t
aaaaaaccccaawtctagaaggaawtacagcaaaccctagaacgcttttaacccttaagacatcttgtattaaaagaaaaaaaaa

SEQ ID NO: 27514 - DNA, 236 bp, Homo sapiens
  misc_feature 3: w=a or t
  misc_feature 112: m=a or c
  misc_feature 147: m=a or c
  misc_feature 175: r=a or g
  misc_feature 183: m=a or c
  misc_feature 198: w=a or t
  misc_feature 199: r=a or g
tawaaatatctaactagtaaaccttaaaaaacatagttatttataaagtagctggggccaggtgcggtggctcacgcctgtaatcccagcactttgggaggcagaggctggmagatcacaaggtcagacattggagaccagcctggmcaatatggtgaaaccccatctctactaraaatacamaagttagctgggcawrgtggcaggcacctatagtcccagctactctggaggct

SEQ ID NO: 27515 - DNA, 302 bp, Homo sapiens
actttgggaagctgaggtgggcagatcatttgagctgaggagttcaagaccagcctggacaacatgctgaaaccccatctctactaaaactacaaagaattagccaggcatggtagcacatgcctgtagtcccagccactcaggagcctaaggcaggagaattgcttgaacttccccagcttcaagaggaagagtctgcagtgagccgagatggcgccactgcactccagcctgggtgacaagagtaaaactccctctcaaaacaaacaaacaaaccaaaaaaacaaatagcaacagcaacc

SEQ ID NO: 27516 - DNA, 413 bp, Homo sapiens
  misc_feature 396: w=a or t
taggtatatgggacttatggaatccagactccagaggttcagtagttgagcagctcccctgatgatcttgggcttcgtgaggcagtccttgccctcgttccccatccctgggtggattcctgcctgcactgatgctggctgcctctgctacaacagcccaggtacaaagccctaccatggtgcagtgcactgtggaggacctgctaaatacctggggctgagctctgcacagttggggactcggagaggattagagccatccctgttctcaaggaggctacagtccaggctctgacaaagagtaaattggtaactgtgacaaagaccagcatgtgagatgggccaaaagggaggcacagataaagcaaagtggaatttagagatttgaaagagtawatcaagctgagcagtca

SEQ ID NO: 27517 - DNA, 208 bp, Homo sapiens
  misc_feature 178: m=a or c
catagttttagtcctctaactagatgagtggcattgggcaagatactaaccactctgggatttggatggtctatccataaagcttcatgcctggtattatgtactgagacacatatttttcacacacgttgaaaagatcttttgttgaaaggtcaggaggctaccgtctcactcatamtcctcttccaatgaaatgttagccagcgcc

SEQ ID NO: 27518 - DNA, 143 bp, Homo sapiens
gcatattgaagtggagattccataattatgtcagtgtttaaaggtttcaaattctgggaaaccagttccaaacatctgcagaaaccattaagcagttacatatttaggtatacacacacacacacacacacacatacacacac

SEQ ID NO: 27519 - DNA, 110 bp, Homo sapiens
tagattctttgggatttaagaaaaatgtctaggatttataatagtaggtttgttattttccagtttttgtgtattttctttttctttctttctttttttttttttttttt

SEQ ID NO: 27520 - DNA, 207 bp, Homo sapiens
ccttttacttttacctatgttgacaattacaatatattgctacagtttttacttaggcagtcaattatatgttagaaaacttttaaataaaaataaatatatgtattttatatgtataacatatatatatacacacacacatttctggacataaatcttcatttttaaaaataaatctaactttctgtccaatattatacaccttca

SEQ ID NO: 27521 - DNA, 177 bp, Homo sapiens
  misc_feature 158: n=a, g, c or t
  misc_feature 160: n=a, g, c or t
aagggtggagccctcccaatccagagctggaatgggtttcccagaagaaagcctgtttccggtaccagaagaagcagaacaagtaactgacttctgtcccctgcagcagaggaggacactgaggctccgggaagtgaaaagtcttgctcaaggaggcngnactgcactcgcaacatc

SEQ ID NO: 27522 - DNA, 454 bp, Homo sapiens
  misc_feature 291: s=g or c
ctcttgttctctttcttccaacattcaccatcatctgtaattaattatatatccatccatgcgttttcttgtttgacatctttttcccacgctggactgtaagctgctggaggacagaagccatgtttattcaacaccttctgcgcagcctcaaacgatggccagcacagaggaattgctcagatatttattgagtaaatgagggagggagggaacaaatgaacagataaatttcagcttgtagaatcttgacctaaggactctgctacgcactaagggacttcagtgtcsccattctgctctttgttgtgatgaactttgctcttctaaagcaagtgtttttcccctagattatttttatagaaaaaagtgaagcaaatatagagataattattgattcttgctcatcaagtccctgttccctatcaccaacatcctccctgagagcctgcct

SEQ ID NO: 27523 - DNA, 392 bp, Homo sapiens
  misc_feature 306: n=a, g, c or t
  misc_feature 309: y=c or t
  misc_feature 310: w=a or t
  misc_feature 324: n=a, g, c or t
  misc_feature 325: n=a, g, c or t
  misc_feature 326: n=a, g, c or t
  misc_feature 327: s=g or c
cattgcgccccacagctacgtgaagtgggaagggccggggttcgttggggcgagagagagatgagggtctcactttgctgctcaggacaccatggatacccagggaccagtctcccagccttttcagcagcctgagaaacctggtcgtgtccgtcgtcggaagactaggcgggaacgtaacaaggccctggtgggcagccgccggccattagcccaccacgatcctcctgtggccattcgggatccacctgtggtccctactgcctccaagctcgtggtcataacccagggccggctgagccgggnagywccggggtctcttcnnnscacgaggtgaaatccctagatgttgcaaggctgcttagcagtgggaccctggtgccaggcagccc

SEQ ID NO: 27524 - DNA, 207 bp, Homo sapiens
  misc_feature 137: s=g or c
  misc_feature 165: y=c or t
  misc_feature 168: v=a or c or g
  misc_feature 174: y=c or t
ttaatctaaaatgtactttagagtgcttcagaactaaaaaagtagtgttgtaggcttgtttttgtttgttttttgagacagggtttcactgtcacccaggctggagtgcagtagcgccggcatggctcactgtaacsttgaactcctgggttcaagcgatcctcytgvgtagcygggactacaggccggtgccccacgtccagctaa

SEQ ID NO: 27525 - DNA, 86 bp, Homo sapiens
  misc_feature 86: r=a or g
tagatctcagagaggaagggaacttggagcgaagtagagaagaataagaccttacaaacataggggaaaaggagtcataatggggr

SEQ ID NO: 27526 - DNA, 438 bp, Homo sapiens
  misc_feature 407: m=a or c
  misc_feature 417: r=a or g
  misc_feature 432: r=a or g
  misc_feature 435: n=a, g, c or t
  misc_feature 436: w=a or t
aggtatctattgatcagtactcttaagaatcttaactttggtggtgcatacatgaacttaacatgggtggtaaatttatctagaactaaacgcgcctaaatacatacacagacacacagataagtataagtaacactggagaaatctgaacaaaatcagtgaattgtatccatgtcaatattctggtgtgatatactaaaatggttattgctgggggaaggtgagttaaatgtacctaggatttccctgtattattgtttgcaactgcatataaatcaacagttatctcaataataaagttcaattaaaaaaccaaaattttatgcatatatcaatatgacatgcttaaaagaagacttgtaaatttgcctttgcagaaggagggaaaggtcgtgagtgattcccamttctcttggraaggcccatagttarccnwaa

SEQ ID NO: 27527 - DNA, 168 bp, Homo sapiens
aaataaacgagacggatgcaatggaatttcataaccatgatggactttggggtgtaataattttcttaggcaagcttataaaaacagtgttttctccctgtagtctgtccttggggactaatgttctaaaaagagagaacaattttccagtaaaattaactctgtgaa

SEQ ID NO: 27528 - DNA, 330 bp, Homo sapiens
  misc_feature 313: r=a or g
  misc_feature 314: n=a, g, c or t
  misc_feature 328: s=g or c
agacagtcatctcaggagcagaaagaaaagagctcccaaatgctatatctattcaggggctctcaagaacaatggaatatcatcctgatttagaaaatttggatgaagatggatatactcaattacacttcgactctcaaagcaataccaggatagctgttgtttcagagaaaggatcgtgtgctgcatctcctccttggcgcctcattgctgtaattttgggaatcctatgcttggtaatactggtgatagctgtggtcctgggtaccatggctggtttcaaagctgtggaattcaaaggataaattaatgrngaaaacaagcggasac

SEQ ID NO: 27529 - DNA, 240 bp, Homo sapiens
  misc_feature 109: s=g or c
acctcggtaacatcacagcaggtccaggccaatgataaccttataagaggccatgtcgaagcgcgacatcgtcctcaccaatgtcaccgttgtccagttgctgcgacascgtgcccggtgaccagagcaccgcccccacctgagcctaaggctgaagttgagccccagccacaaccagagcccacaccagtcagggaggaaataaagccaccaccgccaccactgcctcctcaccccacc

SEQ ID NO: 27530 - DNA, 158 bp, Homo sapiens
  misc_feature 31: w=a or t
  misc_feature 32: k=g or t
  misc_feature 42: k=g or t
  misc_feature 43: k=g or t
  misc_feature 44: w=a or t
  misc_feature 45: k=g or t
agaaagagaaagacggagaggcagagacccwkgggagccgakkwkcggagacacggacccagcagggtcacgcgggaggagactcgggacacccactcgctggctgccaccgggagcagaggggggctcggccgccccctcccacatcagtctccaga

SEQ ID NO: 27531 - DNA, 300 bp, Homo sapiens
  misc_feature 145: m=a or c
  misc_feature 218: m=a or c
  misc_feature 243: m=a or c
  misc_feature 279: m=a or c
agaagcaagtcggcaagcccagattctagtggcaagttcacagactccatctcttggtgggggtgtggcaaagccaattacagaagagcaaatggaatggaaaatgtctgcgagaaagtgaccaattctgtatcctccgagctgmaaccttatttccagactctgccagtaatgaccaaaatagattctgtggctggaatcaactatggtctggtggmacctccagcaaccacggctgagaamcctggatgttacagatgaagtgatggagtttcccgmtgcccatgaccgcatggtata

SEQ ID NO: 27532 - DNA, 253 bp, Homo sapiens
ttgggatgggctttgggtccctggtagcacaagtgttcagtaaataaatgcttttactacaagaaaaattttaccatattttccgtaaattattatgaagcccttggcaccatgcctgacctacagtaggtggccagtaaataagtgcatttgctgttattgtatgaagcccttggcatgacacctggcacatggtaggtagctaataattggggcttctattgctgttgcctggcacatagtgcgtgacaat

SEQ ID NO: 27533 - DNA, 226 bp, Homo sapiens
tcaacctccgcctcctgggtttaagcaattctcctgcctcagtctcctgagtggctgggattacaggcgtgccccaccacgcctggctaatttttttgtatttttagtagagacggggtttcaccatgttggtcaggctggtcttgaactctcctaaccttgtgatccgcctgcctcggcctcccaaagtgctgggattacaggcatgagccaccgtgcctggccc

SEQ ID NO: 27534 - DNA, 268 bp, Homo sapiens
  misc_feature 250: n=a, g, c or t
  misc_feature 251: d=a or g or t
aaaatccaggtgctcccctaagaactttgcacgtgtatgtgtgtgtgtgtgtctgccttattgaaatgttttaaaactacaaattccccaataatggggcctatatctttttctttatatcctcagtatttatcaatttgtctataatatagcaagaaattgatacacctttgttgaactgagcaaaatgaaagcactatatttaccatgaagtctttggaaacaggtttacaagattatgctatgagandacccagaagtgaacaga

SEQ ID NO: 27535 - DNA, 187 bp, Homo sapiens
aggagactgggacttcctgaagaaggggggcggaaggagtggcggggagcccccccctttccacgccccttggatactccatactggaggagagaggagtctcaactctcaaactccccttttgaggggcgattactgaaatggagaggttaaattcaaaggctccacttttaaaagacctgtccct

SEQ ID NO: 27536 - DNA, 200 bp, Homo sapiens
acgccattctcctgcctcagcctcccgagtagctgggcactacaggcgcccgccatcacacccggctaatcttttgtatttttagtagagatggggtttcaccgtgtgccaggatggtctcaatctcctgacatcgtgatctgcccacctcggcctcccaaagtgctgggattacaggagtgagccaccgcgcccggacc

SEQ ID NO: 27537 - DNA, 104 bp, Homo sapiens
acatgcgtcaccacgcccagctaattttgcagttttagtagagactgggttttactatgttggtgaggctgagtctcgaactcccaacctcagatgatccgccc

SEQ ID NO: 27538 - DNA, 279 bp, Homo sapiens
  misc_feature 271: n=a, g, c or t
  misc_feature 272: b=c or g or t
attagaatgtggttaatttctccactgagctagaagcacatggtttgcagaacattggctacagtaagaacatactctgcatcagagagggttcaacattaacaacgtctgtaaaaacagaatcacagctgtcaagaagagtgctttctccatgtactgtgaaacacatccatctggatccacctatttaagctacatgcctagcctccagagtcatccagacttttagcataagaactcaaatgagaaatcatgaagaatgcattaacanbaatccgt

SEQ ID NO: 27539 - DNA, 234 bp, Homo sapiens
  misc_feature 12: w=a or t
  misc_feature 58: k=g or t
agtgatggtggwaaaaaaaacaagtcaattcatttagactggtagaaccagaaccackgtgtagtacatccaaacggttaaaattccctggaagatgttacataatcctatcatggtgtttatttatggaaatctattttaaaaattttatgtaatactgcacagtctgtttgcatgatgccttgtacgtagtagcaactcagtaaatactttttgaatgaactagtatagtat

SEQ ID NO: 27540 - DNA, 325 bp, Homo sapiens
catattagatgtaacagtttaaaatggattgcaaatcaatgtcagacttaaatagaaaatatttattatcacctcatttctaccaataatttcagatgtttaatgggactttgaaaagataggaaaaaatagaaatgaaaatttatctcacctttaatactgtgaatactatttggagggtccctggtcagacatttaaatatcaaacttaagaactgacatggagcctttgattagtttatatacaggatctgaatatttacacacatagcacactatagcaacctcttgtaaaaaatcatgaagatagaatgcaacagtgcgc

SEQ ID NO: 27541 - DNA, 79 bp, Homo sapiens
actccagaatcaaagaaaggggggatttcctcctaactgctttgaattgggacctcagtttttgtcttttttttttttt

SEQ ID NO: 27542 - DNA, 96 bp, Homo sapiens
  misc_feature 86: s=g or c
aagactatactttcagggatcatttctatagtgtgttactagagaagtttctctgaacgtgtagagcaccgaaaaccacgaggaasagaggtagct

SEQ ID NO: 27543 - DNA, 202 bp, Homo sapiens
  misc_feature 181: w=a or t
aaaaaaacacgattacttccaactgccttgcggaggaggcgcagtcgtgcggtgtgacttggacagcttgctgctctctgatggcacgcggagggagaataattaaaaaggccagcatcacttactaagtgagtaaacacagagccgttccaatcgtgctctccagctaatgagaagctgwaatttcttatacttcaaggac

SEQ ID NO: 27544 - DNA, 118 bp, Homo sapiens
  misc_feature 111: y=c or t
cttaaacctttatcaaaacagaacattacgtctcccagaaaaagttttcatgcctcttggttcttcaaccttagacaaagacaaccactgttgtgattttttttttttttyctttttt

SEQ ID NO: 27545 - DNA, 134 bp, Homo sapiens
cattttgattagattaattcaggtttggtgatatgttgcttgcttttgtcttcagctgttaagtcttttcatgccctggtctatgacaaacatggacctgttttctgtcactatcattttgcttttacgccccc

SEQ ID NO: 27546 - DNA, 56 bp, Homo sapiens
agtaacgtactctggtctatttctatgttgtggaaactttgttgttgttttttttt

SEQ ID NO: 27547 - DNA, 151 bp, Homo sapiens
aaaacacagaccttttttcttcttgatttttctgaagttgttttatataaaatataattgggatttgccaagaatgtgaaatattccattataataatgcccttagccgggcgtggtggcacactcctgtaaacccagcactttgggaggc

SEQ ID NO: 27548 - DNA, 180 bp, Homo sapiens
gagaagatttaaattttatttctatactgtatattagactctaagcttaagtgagcttaatattagaaaaaatatataatagtattcatagcaatataataattgttgcaggaagtcagggaccccgaacggagggactggctggagccacggcagaggaacataaattgtgaagatttc

SEQ ID NO: 27549 - DNA, 191 bp, Homo sapiens
  misc_feature 91: m=a or c
  misc_feature 132: w=a or t
gcccgcacgccgccgctggagctagagaccagccggttcctgctggaagctcctggtctgatctggggataccatgtccaagccccccgamctcctgctgcggctgctccggggcgccccaaggcagcgggwctgcaccctgttcatcatcggcttcaagttcacgtttttcgtctccatcatgatctact

SEQ ID NO: 27550 - DNA, 429 bp, Homo sapiens
  misc_feature 266: v=a or c or g
  misc_feature 267: n=a, g, c or t
ctattttgcttgaagaaaggtcttgttgttagacaaaaaaaatgaaatcctgcttggctttcccatcccagtgtgtgtaccccagcatggaatataagagcaccgctcccacttgcttcaatccatcgtctgtctccctgtgtccctgatgctcctggagcagcagtttttgataacttggaaggttatgccatgtgggagctggcatgagacccagcatcatgaaaaccactcaactaaggctctgggatatatgcttagatggvntgggccatcctggaaatgtgtgacctggagtgacactttcgtctcctgagaaaagaggatgacagtacacatgctgtcgccttcaaggggtgtcatcggggtagcatgagatagcagatctgaaaatcacttttaaaaacttttaattttgattcacacagt

SEQ ID NO: 27551 - DNA, 105 bp, Homo sapiens
  misc_feature 64: s=g or c
  misc_feature 65: y=c or t
  misc_feature 78: s=g or c
  misc_feature 84: s=g or c
  misc_feature 85: s=g or c
  misc_feature 94: s=g or c
  misc_feature 95: m=a or c
  misc_feature 102: s=g or c
agaggccgggcccgagcagagtgtggcggcggcggcgagatctgggctcgggttgaggagttgsyatttgtgtggaasgaggcssaggcgcagsmggaagasgct

SEQ ID NO: 27552 - DNA, 142 bp, Homo sapiens
tagcctttaatctttttgtagaatgccaatgagactcctccttccaggacagctgggagggtcgggaagtcctcagtgaatgttcatcatcaggaaaaccttggtggatgatgggcaggagggaagcttcagcagtgggccc

SEQ ID NO: 27553 - DNA, 274 bp, Homo sapiens
  misc_feature 129: y=c or t
cattctctcataagtcttgggtcttccctcccattcttccttctttctttttttcgagacagggtcttgctctgtagtgtgctaccactcccagctaatttttaatttttttttttatatagacggagytcgttatgttgcccaggctggtctctaactccagggctcaagtgatcttcctgacttggcctcccaaagtatagatgtgagcttctacacctgtagtgctagtattagagatgtgagcctctacgcccgccaccatgcccgggac

SEQ ID NO: 27554 - DNA, 251 bp, Homo sapiens
tcatcagcaaagcaaggacaaatttttcttttttgatacagagtctcactctgtcacccagactagagttcagtggtgtgatcttggcccactgcaacctgcgcctcccaggttcaagcaattctcctgcatcagcctcctgagtagctgggatacaggcacatgccaccacacccagctaatttttgtatttttagcagagatggggtttcactgtgttgaccaggctggtctcgaactcctgacctcaa

SEQ ID NO: 27555 - DNA, 59 bp, Homo sapiens
  misc_feature 44: w=a or t
  misc_feature 45: w=a or t
tcaactttttaatgtatcccatctggttttcttttctttctttwwtttttttttttttt

SEQ ID NO: 27556 - DNA, 91 bp, Homo sapiens
  misc_feature 85: m=a or c
aaaaaaattaatcctaaatgtcatagaacaagaggacgagtacacaccacatgtatagtcagccctccatgtgtgtgggttccamatctgt

SEQ ID NO: 27557 - DNA, 319 bp, Homo sapiens
  misc_feature 243: w=a or t
tcgtgactctctgtcaagtgcttgtccctaatctaatcagcttaagccagttgagatgctggttatcttgtataaaccatgtttacctaggacggttgagaaagctctttaacttagaagaagcttgaatgtcacaggtacaatgtttcatttctattatataataaatccaccaagcctctaataatgtattttttatttaaagaaatgacatatacacacacacaatataattgctgtttwgccatcgaaagtaatggcaaaagccgcaattacttttgcatcaacctaataaattctgaagatcataagcatatca

SEQ ID NO: 27558 - DNA, 251 bp, Homo sapiens
  misc_feature 175: m=a or c
  misc_feature 185: s=g or c
  misc_feature 186: m=a or c
  misc_feature 192: k=g or t
ccccctggccccaggagcggctgctgcggcggagttaggccggccgcagtgggaaaaccctgggcgccctctgggtctcagcgtcccattaggacggttccgcgctgggtgccgcacgccgcacagtgggcaacgctttcacaggggtctttgcatttcacccgcacacagcagmtcctggaggsmggccakgaaaacacttaacccattttgcagacagaaaactaaggctcaaagtggggaggagactt

SEQ ID NO: 27559 - DNA, 130 bp, Homo sapiens
tcaggagttcaaggccgacatcaagttcaagagcgcgggacccggtcagaagctcaaagagtccgtgggggaaaaggcccacaaagagaagcccaaccagccagcccccaggccgccccgccaggaccca

SEQ ID NO: 27560 - DNA, 317 bp, Homo sapiens
gccaaatcatcaacaagttcgtgaatagcgtgatcaacacgctgaaaagcactgtatcctccctgctgcagaaggagatatgtccactgatccgcatcttcatccactccctggatgtgaatgtcattcagcaggtcgtcgataatcctcagcacaaaacccagctgcaaaccctcatctgaagaggacgaatgaggaggaccactgtggtgcatgctgattggttcccagtggcttgccccacccccttatagcatctccctccaggaagctgctgccaccacctaaccagcgtgaaagcctgcagtcccaccgct

SEQ ID NO: 27561 - DNA, 288 bp, Homo sapiens
ccgaaagtgctgggattacaggcatgagccaccacgcctggctaagatcattattttctgtttttagtcaggtgatctcataatcaaaaaatgtttaattgatgatttgtcaatttgtagttttggccactaaaactacaagagttaggatgcacctttatattacagtcatacataacctcagctagtgaagaaaaactgctctatttgtggaagataagatactttttacatcccctttatgatattttaaacccttagtgcatgcaggtatatatgtagactcac

SEQ ID NO: 27562 - DNA, 226 bp, Homo sapiens
ataaaagcaagctgcccgagccaggggtggcaacccactcggtcctgttccacattgtggaagctttgttcttttgccatttgcaataaatcttgctgctgctcactctttgggtccacactgcctttatgagctgtaacactcaccacgaaggtctgcagcttcactcatgaagccagcgagaccatgaacccactgggaggaacgaagaactccagacgcacca

SEQ ID NO: 27563 - DNA, 307 bp, Homo sapiens
  misc_feature 2: y=c or t
  misc_feature 25: y=c or t
  misc_feature 50: s=g or c
  misc_feature 51: s=g or c
  misc_feature 132: m=a or c
  misc_feature 154: y=c or t
  misc_feature 155: y=c or t
  misc_feature 157: m=a or c
  misc_feature 158: m=a or c
gygatgatggagctgtggctggatyttgggtctgagcatactactctcgsstatttggagacctccgtaagaacctatgataatatccattgaaaatggtaccctcctctgaaatcaaaactctttaattamagagacatgaaatgacaagatyytmmaaacaatcccatgaggagaaggcattctaatttaggaagaactcccccttggaaaaaccatcagtgccggaagatttcctattgtgttgatccatggcaaaggaagactgcagatacacaagggatattatggagcccagacgacctga

SEQ ID NO: 27564 - DNA, 250 bp, Homo sapiens
agcagacagaaaaattcgctgcaagtacagcactttctagattgctcctggagtgtgggaacaacagtctctcctgtccacgttactgaatccagaaaaaagaaacaaattcaaggagcagcagccaaatacctacgttggctttaaagagttctctagaaagtgttcggaaaaatggagatccatctcaaagcatgaaaaggccaaatatgaagccctggccaaactcgacaaagcccgataccagtaa

SEQ ID NO: 27565 - DNA, 181 bp, Homo sapiens
aggacagatgaggcagaaggggaggttagggaggtttgaagagtgagaagaacttctgcagtggctgacttggaagatgaaggaggttatgaaccagggaatgggggcagcctctagaggctgagaacctgctgacacctacccacaaccgctaaggaaatgaagactttaattccacaac

SEQ ID NO: 27566 - DNA, 63 bp, Homo sapiens
gataatatctaagggaataaaactttgaaaaaaactcaccaaacttttttttttttttttttt

SEQ ID NO: 27567 - DNA, 285 bp, Homo sapiens
taaaggttatgaaaactaagttatattaattcatatgtttgatttttaaatcccacctcctcaagctatcgaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctccca

SEQ ID NO: 27568 - DNA, 282 bp, Homo sapiens
  misc_feature 22: s=g or c
  misc_feature 23: m=a or c
  misc_feature 39: w=a or t
  misc_feature 152: m=a or c
  misc_feature 280: y=c or t
  misc_feature 281: k=g or t
tcggctgaggtttttttgaagsmggagaagagcaatgtwacatgccatattccactgtttttgatgctaatccactagcgcaattatttagatttgctcatacactaaagaaaacacaattgttcatatatgtctcagtatttctgtattamatattcataatatgtattctgccctatggtttgcatctttgtaagttaaatattctaatttatcaattagcagaataattatcataagatccaaaaatgtcttccagacacccctgcacacaggccaykt

SEQ ID NO: 27569 - DNA, 236 bp, Homo sapiens
tatgatagttcttttagtgtttcccaccacccttttcagagtaagcaattagacgtctagagtttcttttcctctatctctttgggtaaatagcaaccagtggtgcccgccaccacgcctggctaattttttgtatttttagtagagatggggtttcaccatactggccaggctggtctcagactcccaaagtgttgggattacaggcgtgagcaaccgtgctgggcctaccattt

SEQ ID NO: 27570 - DNA, 133 bp, Homo sapiens
  misc_feature 65: s=g or c
gtaagggatttcacatcattcattatttactaatcgaagtagaaggcaaaatgatatgctgaaasagagatggaggcttaatgagaaaagtgtatgggttgggaagagagtaccataaaagttactgcacagc

SEQ ID NO: 27571 - DNA, 267 bp, Homo sapiens
  misc_feature 246: m=a or c
gtttggatggttggcctcttggttacaagcatgtacattatggttctctccttgcctggaactggatatgagaaatgcttgaattaagatctgtgaattatcttattttcttgtcagaaggatgcagattgcccatacttcatagcagagcaacaggagggacttagggacaaaaagctcaaaggcaaggaagactgaggaagctaagttactggccatatgtttaataaatataagcttaatggmagtgaatgtattaatgtcagc

SEQ ID NO: 27572 - DNA, 142 bp, Homo sapiens
actcctggcctcaggtgatccgcccacctcggcttcgcagagttctgggattataggcatgagccaccatgctcagcccaggctggtctatttctgagctaatcttctggggtgggttttttggagcatcacatacccctca

SEQ ID NO: 27573 - DNA, 182 bp, Homo sapiens
ctttctgaaaatatcagaacaaaccaaagtactttttttctctcactcaacaacaatcaacacagaagacttctgtgaccaaatgtgtgggttttctccccaccacaagcaagaaggcagttctacatcggacaattccaacatcgacaccttctacctggaggtggcctcacaccccacat

SEQ ID NO: 27574 - DNA, 113 bp, Homo sapiens
gagtgagggattttgccatggagaaggagaaggacccatagcagtttgtcaggttcatggaatccgagctggacctaaatgacatcattcaggagatgcacgtggtggcgcat

SEQ ID NO: 27575 - DNA, 192 bp, Homo sapiens
tatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcac

SEQ ID NO: 27576 - DNA, 180 bp, Homo sapiens
aaacttttaaataaatggaatcatagcatttgtgttgtttcatgtttcatacttgcatcctacagttaccatggcttccggttattagctccagcccaaacttctctctttttttgcttagcaatatgtcttgaaagtcttcttacatacacacatacacacacacacacacacacacac

SEQ ID NO: 27577 - DNA, 269 bp, Homo sapiens
  misc_feature 152: n=a, g, c or t
  misc_feature 153: b=c or g or t
ttaaaaaatttttaggctgggtgtggtggctcacgcctgtaatcccagcaccttgaggctgaggaggcctgacacctgaggtcaggagttaagagaccagcctggccaacatggtgaaaccttgtctccactaaaaatacaaaaattagctnbgtgtggtagcaggtgcctataatcccagttactcgggaggctgagacgggagaatcacttgaacctgggaggtgaaggatacatggagctgagatcgtgccattgcactccagcct

SEQ ID NO: 27578 - DNA, 173 bp, Homo sapiens
ttttttttagcatttataactctgtaagagtttaggatagtttagttatgagtgacagaaaaatctaaagcaaactggcttataccaaggagaactaatcagccatgttgagcatgactgattcccttgtggtagcaagatggccacctcccacactcacaccaaattctaga

SEQ ID NO: 27579 - DNA, 220 bp, Homo sapiens
  misc_feature 12: m=a or c
agtggagtgaamactttaaatagcacttgttccttgagtatatatggaaaaaagtgaagtattgataagtgctcagctaatatgagcagcatctcaggagtctccaattcttgaattaccagggagtatttttaccattttcccccagtgaaaggcctattttgagagacttaccctccaaaatgaatgtattaagtcatgttccttttttttttttttt

SEQ ID NO: 27580 - DNA, 357 bp, Homo sapiens
  misc_feature 130: b=c or g or t
  misc_feature 355: n=a, g, c or t
  misc_feature 356: n=a, g, c or t
  misc_feature 357: n=a, g, c or t
cgaggttgtctatctccgttttctgatggaaaagcgtggagttcagaagcattgctcgctccttcagtttctaacaagtcagtaatctcatagcaatttaaatttaaatgtttgaattacctctccttcbctggttcagagccaggtcttggagagaccaggaagccaagagtttcctccaagaatggagattccttgggagcgatgtttgccttgagtaaagaaagatgaatcacatgtggtcaaaggcagttgtccagggtctcaagaaaagagccagaaagaggagctggggctgctgggattgtgggggtcctctctcccacctaaaaagctactactgcctgctgacctnnn

SEQ ID NO: 27581 - DNA, 305 bp, Homo sapiens
atagttgtcagagtgagggggactggggctgcagcagatccgcttgtagagcctgaggataaggccaatgctgggaagggaaaccaaagagaacaacagagatgccaagttcatgataaggtattgttatgctgtccagcacaggctggtgtctaactcctggattaaagccatcctccctcctcagcttctcgagtatctgggactacagaggtagacctcagattgcagaagaccatcagacccaagagtacaacacaccaggatctggactttccactgtttttaaagttttcacaggctgc

SEQ ID NO: 27582 - DNA, 276 bp, Homo sapiens
agttggcgggggcactaccagcccaccccacctctgggacaggggagaccctaggagctaacccccacttccttctctctgcaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggatgt

SEQ ID NO: 27583 - DNA, 373 bp, Homo sapiens
  misc_feature 323: n=a, g, c or t
  misc_feature 324: n=a, g, c or t
  misc_feature 350: k=g or t
  misc_feature 351: w=a or t
tcattttacactcacatgttgccaaaataatctttgttatgtgctgctcccacaataagatctttccccgtgcttttatctcctaaggtggtggacctcaagccttttggtatcaaaacccttgtgtcctcttaagtgattgaggtccccaaggaacttttcttcatgtggatttttgtcttatcattgtctgccagattagaaattaaaaccaagaaatttacacttaaaatagctgtaataaacctattacatgttaacataaaataacatttttatgaaaactgttcacaaaaacaaaaaaatttagtgaaaagtggccnntgttttacattttttgcagatctctkwcatgcctcactgaataaaaaga

SEQ ID NO: 27584 - DNA, 240 bp, Homo sapiens
  misc_feature 126: r=a or g
gtttaaatttatgcacttttagatatcagaatatatgcttgaacaaaggaaatagtaaattagctatatgtctgctggtttcacttcgatgtggatatggatatgtggataaagacagtaaatgarattaaaaccctgctgttttaaatatcattaccagatataattgagggaatattatatcaacaaacatattgaaacttggctttatttgtaacgtaaactatatataatcccatc

SEQ ID NO: 27585 - DNA, 110 bp, Homo sapiens
  misc_feature 24: w=a or t
  misc_feature 29: w=a or t
  misc_feature 30: w=a or t
  misc_feature 91: m=a or c
  misc_feature 92: m=a or c
tgagatgcctctagatttgttctwtttgwwtagtcttgcttggctatgcaggctcttattttgttccatatgaatttcaggattttttttmmtagttctgtgaagaatga

SEQ ID NO: 27586 - DNA, 75 bp, Homo sapiens
aaggaagggagggagggatctcttgacctcttaaactcttagcctggggaactagtgtgaccccatgtctctctt

SEQ ID NO: 27587 - DNA, 200 bp, Homo sapiens
agcaacccgtttggttatctttctgtgctgaggaaggtttgttctttcactctgcactattttgcaataaatattgctattgctcactttgggtttatattgcctttatgagcttgtaacactcaccatgaaggtctgcagctttactcttgaagcttagcgagaccactaacccaccagaaggaagaaactccggccac

SEQ ID NO: 27588 - DNA, 253 bp, Homo sapiens
  misc_feature 8: w=a or t
  misc_feature 14: r=a or g
  misc_feature 15: m=a or c
  misc_feature 16: w=a or t
gacctggwagatgrmwaagaaagaagttgaaattagtcattttaagtttcagtgtaccaacgataagggcatttggaacagtgctatcaggtgagctcagtggtgctgttgtaggttcagaaatggaaatatgtaagggaggtcacacatacactttacctgtatgttcaacctatgttatcaaacaaatcaattcaccaataatagcatgattagtaggaattcccaaaaagtttttaaaaacacgaacagc

SEQ ID NO: 27589 - DNA, 287 bp, Homo sapiens
  misc_feature 183: k=g or t
  misc_feature 184: y=c or t
attgatattaccacatcatcaggaaggcgactttcatgtagatgaaaagcattccaaatggctgcagtttaaccttatcagatgagaagaaaacgggatcaactatctaataagaaaaatcaaggaaactccaactggagagttatggctactgcagtacttaatataacataggctggtcckycaggatcgttgactggagttctgacacacatgacagagcccgacttccgggatgagtgatcactgagcatgcgcaggacctgtgccgtctacaccccgcccaa

SEQ ID NO: 27590 - DNA, 171 bp, Homo sapiens
ccgcctcccgggttcaagcagttctttgcctcagcctcccgagtagctggaattacaggcacctgccaccatgcccagctaatttttgtatttttggtagagacagggtttcaccatcttggccaggctggtcttgaactcctgacctcgtgatccacccgcctcagccat

SEQ ID NO: 27591 - DNA, 265 bp, Homo sapiens
agttggggtgatcgttaacatttagactggagctgtttccctggaggtgcgcccttgggaagggcctgactgtgtgaagagtggacagcagtcctccgccccctgctgggctcgcggtaaagtggtggctcctgtgtccccgctgttccgcctgtgcactggccgactttttaaagccatgccccaaagtgctgtcctcctgcaaaaccgagcccgaagaacagtgcaaagtgaagtcaaactgagtatttacctgggcccgcgc

SEQ ID NO: 27592 - DNA, 287 bp, Homo sapiens
  misc_feature 274: s=g or c
  misc_feature 275: h=a or c or t
  misc_feature 281: s=g or c
aacccgctggggtccctttccacagtgtggaagctttgttcttttgctctttacaacaaatcctgctactgctcgctctttgggttaactgcttttatgagctgtaacactcactgtgacaatttgcagcttcactcctcagcccagcgagaccacgagcctactgagaggaacgaacaactccagacgcactggtttaagagctgtaacacttaacgaagaaagtctgcagcttcactcctgaagccagcgagaccccgaccacatctgagashctgagsacatcc

SEQ ID NO: 27593 - DNA, 201 bp, Homo sapiens
atgagccaccgcgcccggccctcttggagttctttatttgttatcacagcaacgacccaaaagctcagctttggaaagttctgatgtcatgagaaggaaagtatcctcctccaatgctgaagttattatcaaagttgacctacccgtcagaatgggcttcaacagaggttgggcgtcactgagctacctgtgagaatgttt

SEQ ID NO: 27594 - DNA, 111 bp, Homo sapiens
gtgttctcaccattgttccatctgcgaggagcaccctttctgcagaaagtaaaaattgccttgctgaggaaattaaatataggtttgagtgctatttctttgtgacaccga

SEQ ID NO: 27595 - DNA, 440 bp, Homo sapiens
  misc_feature 298: n=a, g, c or t
  misc_feature 340: w=a or t
taaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaantctgatgacgttttcacattcaccagactttttttcctgtawtatttgcatccccaaatatttaatacaagtagattctgcatggcttgggcattcagagattaatagaatgatgactcaattttaattctaaagccatgat

SEQ ID NO: 27596 - DNA, 242 bp, Homo sapiens
taaataaataaataaaatataaggtctcaggaacgtaaagattgacatttactcccaaactattaatatatgtccacccacctttcttgtagcaaaatcttaacttgacgtttgtttcaatagttattaaatttaattataatgtcctagcccaaaatacagtagaggtaaacatccaaggtactggcttgaggccactggccctgtatctataaaggagagggagaccatcaggggcggga

SEQ ID NO: 27597 - DNA, 425 bp, Homo sapiens
  misc_feature 45: w=a or t
atataagagggggcgggagacaagccctatcagcacatcccagawaatgggaaaccgaatcacccaggggatggcaaggaatgaccagagggaaagttccagttctgtccaacatgcactaccagccccattttggaaaagaacagatttaatagacctcaccaagacaagaattgtttttcgtcaaaggaaatcaaaggaacaaacaagaggcagtgaccaccagagacttcaccttttggtgtaggaaaacccaagcagacagtgtctacatccatcaaagcccaatgtattaaatatttattgaataagaacccacggactcttccttaccagagccttagattgccatgtgcgtctgattgctccaaagacaagactattgtgattttggccccatatgcattttagagtaacaagtctta

SEQ ID NO: 27598 - DNA, 273 bp, Homo sapiens
  misc_feature 36: h=a or c or t
  misc_feature 37: n=a, g, c or t
  misc_feature 38: n=a, g, c or t
  misc_feature 145: m=a or c
  misc_feature 195: m=a or c
  misc_feature 224: w=a or t
  misc_feature 252: m=a or c
  misc_feature 254: d=a or g or t
  misc_feature 255: h=a or c or t
agaattttctggtcagtcaacaacttagtccatcthnnggtccttataagtatatcaggacacaattaccacggggttgcccagggtcctggactggaaacatggagtcacttccagttagttccaccgaagctccaccacagamctgcctgaggactctgggtaaataacctcaggccgcttcagtgtctccamtgctgaaaagggggaagtcacatacacawctgcgttattgtacagacgataaatgamadhcttctcagccaacaatct

SEQ ID NO: 27599 - DNA, 61 bp, Homo sapiens
  misc_feature 28: m=a or c
acaatatttaaaggcccttagtaatgcmaatgtggccgggcgccgtggcctcatgcctgta

SEQ ID NO: 27600 - DNA, 94 bp, Homo sapiens
agaacatgaagtctaggaaccggcatgcgcataacctccgtatataaatgatgctgaagagccgttacggtttttttttttttttttttttttt

SEQ ID NO: 27601 - DNA, 277 bp, Homo sapiens
ctgtttctaaagagaatgaatagctccttatctacaagtgtaaattataaagagattttcttttgcaacttcagggaacaggaacttttgctgccaaatttagcaatgtgttttaagtccctcaaatcttctttgagtgctaccaaagctctgagctttgttgttatctcttgttgaaatacagcctggaaaggtcatatcaacagtgccaatttatgggcctgctgagcccagacaggcctagggcagaatagggagttcctaagagtagaggcgc

SEQ ID NO: 27602 - DNA, 268 bp, Homo sapiens
  misc_feature 252: m=a or c
cctaatagccagccttctttgtgatgtggaaataattatcagcatgtaaaagactatatatatattcaacaattctgatcccctgaaaaattcaaatctacaactgatttgcttcctgggctcctgaaaacaactttgtcaaaattgttcagaaatataatcagccaatcgttgccccttggggacgcaggataaagcaagtcagccatgaccaatgaggagtcggccgtgcacaattacatgcagacctgmaggacatcgagtccct

SEQ ID NO: 27603 - DNA, 237 bp, Homo sapiens
  misc_feature 78: w=a or t
  misc_feature 136: w=a or t
  misc_feature 193: m=a or c
attctcctcctgcctcagcctcctgagtagttgggactacaggcgcccgccatcacgccctgctaattttttgtattwttagtagagtcggggtttcaccgtgttagccaggatggtctcgatctcctgacctcgwgatccgcccacctccgcctctccaagtgctgggattacaggcatgagccaccgcgcmcggcccttgtatttttaaactttgactttatggagacgaccacc

SEQ ID NO: 27604 - DNA, 136 bp, Homo sapiens
  misc_feature 74: b=c or g or t
tagctcagcatgggagtgtgcacctgtagtcctcctagctatttagggggctgagatgggaggatcacttgagbccaggaggtcaaggctgcagtgagccacaatcaaaccacattaccccagcctaggtgacagt

SEQ ID NO: 27605 - DNA, 51 bp, Homo sapiens
  misc_feature 7: w=a or t
tcctgcwgccccctcgctaggacccggcggacgctcgtctggttttcacgc

SEQ ID NO: 27606 - DNA, 439 bp, Homo sapiens
  misc_feature 48: m=a or c
  misc_feature 49: m=a or c
  misc_feature 388: m=a or c
catctctgaattggttttactactcagaataagtataaattatagggmmctctcgaaatgtcactgagaatgagcatagcagggatactttgaggataaaggtaggctttcatataatcatacttttctgtcccaagctatatttaaattgtttagtgtttagaagcatgtgatcttatggagaaattaaatattatttagaatttatcactacggtttaatctcatgcgttgtcacaaccaggtctttttcacctttgctgctaaactctgggattaccttaattttgtccttaggagctcagcataatagattttgttacttacactgcccatgttcccgcctgcctcggggcctttgcacttgctcttctcgtctcggtaaccamacttaattcttatcttttcttaagctctgccaccccagtgtcactgccttt

SEQ ID NO: 27607 - DNA, 273 bp, Homo sapiens
catcagaattttcacagagacacccccccaacacacacacccgcagcatgcgctccttgaaagtgctaatagcttcaatatgaggctggcacttctgcatgactgttggtgttcagggccagcctagtcttggggagtaggccatctgtagcagctgcagaaatgtttttgcttattttgagcattctaagtttttcctagccatgaataacaacaaatcgaataaatcatcccacagtgtgtaggatggtcgtttttttgtttttttttttc

SEQ ID NO: 27608 - DNA, 94 bp, Homo sapiens
actcccacttatgagtgataacatgtggtgtttggttttctgttcctgttagtttgttgaggatgcctttttcttttttttctttttttttttt

SEQ ID NO: 27609 - DNA, 63 bp, Homo sapiens
gataatatctaaggaataaaactttgaaaaaaactcaccaaactttttttttttttttttttt

SEQ ID NO: 27610 - DNA, 181 bp, Homo sapiens
  misc_feature 111: r=a or g
  misc_feature 112: r=a or g
  misc_feature 123: m=a or c
  misc_feature 138: w=a or t
  misc_feature 148: m=a or c
  misc_feature 151: y=c or t
  misc_feature 170: r=a or g
agtccgtcctggtttcaggcaagatgaagggagcttgtgtctacaaagggctggcagctcccatccagagcatggctgggcctgatagagccacacctggaagcatttatrrccacacctgamagctccctctggggwggggcacccmagytcccgtctgggccaagagrcctcaaacacc

SEQ ID NO: 27611 - DNA, 308 bp, Homo sapiens
  misc_feature 163: b=c or g or t
  misc_feature 272: r=a or g
gttcttcccggaagtgccctgctggtgctgggagtagggcgcaagatgtcggcggatgcagctccgaggagggtcttgcggtgtcacccaggctagagtacagtggtgcaatcatagctcactgctgcctcaaactcctagactcaagcaatcctcctgcttbagcctcccgagtagctgggactacaggtagatgatgggctccacgggaacagagcaaacgttcgctcctgctcctacacggtgtttcctctaaacctgaggctcagccracttgtcatcacttaaaacccaattcagagcgggta

SEQ ID NO: 27612 - DNA, 198 bp, Homo sapiens
  misc_feature 135: r=a or g
  misc_feature 145: r=a or g
atgttggagctttaaagatacagctgtatcaggccaggcgtggtgactcatgcctgtaatcccagcactttgggagaccgaggagggcgatcgagaccatcctgactaacatggtgaaaccccatctctactaaraatacaaaarattagccagacttggtggtgtacgcctgtagtcccagctactcagggggcggc

SEQ ID NO: 27613 - DNA, 204 bp, Homo sapiens
accagaggatggctgacacgaaggggcacccgagacagcgcctgggctttttcccgcccgcggttccaccgctctgaaaccgatttctaacagagagagacatagtcttgctctgttacccatgctggagtacggtggcgagatcacgactcactacaactttgaattcctggattcaagcaatcctcccatctcagcctcgta

SEQ ID NO: 27614 - DNA, 292 bp, Homo sapiens
  misc_feature 123: m=a or c
aatcccagctggcgtgtgggaacgggcaacgcattttgtacggaagctactggggcaggtgatgcctacccagtctctctcctctgttgaacaaaggatctgttaaaattggaagggcttaamgtcttcttcagaaaagtgacgcatttgttactgggatggtaaggttcagcaaagtctatgtcattctctaatccttttgatccagcggattctttggaggaatttgaatacatattggattttgcatccaggtttgcaagaggaaaatacaaaggtgacttctgggcct

SEQ ID NO: 27615 - DNA, 471 bp, Homo sapiens
  misc_feature 346: k=g or t
  misc_feature 347: n=a, g, c or t
  misc_feature 348: n=a, g, c or t
  misc_feature 349: h=a or c or t
  misc_feature 383: b=c or g or t
  misc_feature 384: y=c or t
  misc_feature 385: w=a or t
accaaatatgtttcattctaaagcccatgctcttcaccaacaaagcccaacttgatttaatttatccccaaacataccaacatccatttgttagttcccttcccaatttaactttaagcgtctcacatacatacactgtttttatcctaacaacaagttggtgaggaactgagctcagagaggttaatccacccactgaaaggcacccagtgtttaagagcagagggaggggcctgacacaggtctttcggagcatgacatgcatgttctgtccacaaggcctgttgctgcctttcccccagaggtccagactgaggacaggacagagtagataaagacagcagtknnhgaggaggcagtgggcaatatggggaatctagggbywgcagtatgctggtcccatataaatcaggcccgggggaggggcccagacagagggtggcagactctctgtactccagcaagacaatc

SEQ ID NO: 27616 - DNA, 87 bp, Homo sapiens
attcctggatattttgtattgttatttttgtgagctaaatctttttgtctccttttttttctttctttttttttttttttttttttt

SEQ ID NO: 27617 - DNA, 125 bp, Homo sapiens
  misc_feature 36: y=c or t
cttattttttattccagatattgatgaattgaatgyaattcaaatagctaccttccttgctaccagccgctcatacattgcttcttccctgctactttctgtcctttttctctacattttttttt

SEQ ID NO: 27618 - DNA, 287 bp, Homo sapiens
caaatttatgcctattgtatttcgccccctgctggtttagctcgtgtgcaagcttgaatttgtgtgtgtgtagaaactagaaattgattttaaacgaacacatgcttgttttcattttacagctctactaaacagaaatatcaaaataagaacatatgactagaccttaaagcagaccctacactaagaacatgtttaaactaaatgaatttaaactgcactccagcctgcgcgacagagtgaaaccctgtctaaaaaaaaattaaattaaattgcacaccccctca

SEQ ID NO: 27619 - DNA, 339 bp, Homo sapiens
  misc_feature 189: w=a or t
  misc_feature 214: k=g or t
  misc_feature 232: w=a or t
  misc_feature 270: w=a or t
  misc_feature 275: k=g or t
  misc_feature 286: w=a or t
  misc_feature 305: b=c or g or t
  misc_feature 306: n=a, g, c or t
caactcttactgaatttgtaaaaaccgtgaataattttgttcaaagggtacatttgtagtttgggacaagttatctgtgaatcataggagaacacatcttacaaaactcatgcacactgttgaacaagctactttaaggatatcccagagcttccaaaagaccacagagtttgatacaaattcaacggwtatagctctcaaagttttctttttkgattcataataacatgawacatattcatcctcatatgaatatggatggagactacwtaaakatatttccaawgagaaaagctgcatatgabncaaatggcaatgttgcagttgcatttgtatatt

SEQ ID NO: 27620 - DNA, 282 bp, Homo sapiens
  misc_feature 15: r=a or g
tttcctgctttccaracacctgggcatctcagtgtcggtccggccagactactgcatacaagaccgctcttcccttttcaaacccaaaccaagtaccctctctcgtgtcttcagagctgccagccggcccaggtcccgcagcttggcgggcagcaccagtccgacggctgctttcaccaccagatagatcatctgtagagggaacatcaccagcgcgcccagccgtttccacaccatcctccgcgccgcgagccgggcagggggcgaaactccccggcgcct

SEQ ID NO: 27621 - DNA, 356 bp, Homo sapiens
  misc_feature 4: k=g or t
  misc_feature 18: w=a or t
  misc_feature 116: w=a or t
  misc_feature 121: h=a or c or t
  misc_feature 126: w=a or t
  misc_feature 128: m=a or c
  misc_feature 132: y=c or t
  misc_feature 133: r=a or g
  misc_feature 137: k=g or t
  misc_feature 138: s=g or c
  misc_feature 146: n=a, g, c or t
  misc_feature 147: s=g or c
  misc_feature 304: m=a or c
gtckcattttgcctttgwaatggaagtcacttccaagtgtctgttctctaggttttcctttttttctcttttagaaattggacacttcaataaaatttgtaattacgtccatctgwgtgahtattwgmattyratgkscatatctnstgccagattgtaaactccgcgagtgcacatatcagatccattatggttctcatcatatccctagctcctagcgcagtgcggggcacgtataagtgctcgaaagctcccacgtggtgatggagctaagcttgcccccttccatgtgtgactacccaamtttctgtctcctcctcttcccggcctctctcagactcctctgtgtgcatccc

SEQ ID NO: 27622 - DNA, 386 bp, Homo sapiens
  misc_feature 123: w=a or t
  misc_feature 133: r=a or g
  misc_feature 187: d=a or g or t
  misc_feature 188: v=a or c or g
  misc_feature 205: s=g or c
  misc_feature 206: n=a, g, c or t
  misc_feature 277: n=a, g, c or t
  misc_feature 278: n=a, g, c or t
  misc_feature 279: r=a or g
  misc_feature 282: m=a or c
  misc_feature 359: k=g or t
atctgcatgaaagtttaccaacaagatccctgcctgccttttgcaggctctcctgcaaccatctacttcatttttgatctcaggaagaccagagctgagttttctggatatgccgcagaaggwtccgtgccaraagcaagcctgtgagatacagaaatgtttacaagccaacagctacatggaatcdvagtgtcaggctgtcatsnaagaactgcgtaagtgttgtgctcagtatcccaagggaagatctgtcgtctgttcaggatttgaaaaagannrggmagaaaacctaacacggaagtctgcatcaaagtaaagttcttctgaagtgctgctccatgtttccaccaaatgaattktttttatcctcctgactcttcaggcca

SEQ ID NO: 27623 - DNA, 331 bp, Homo sapiens
  misc_feature 124: m=a or c
  misc_feature 147: w=a or t
  misc_feature 148: w=a or t
  misc_feature 159: s=g or c
  misc_feature 160: n=a, g, c or t
  misc_feature 161: r=a or g
gtgcggcgccgttgcgggcgggagcggctgcaacgccggtgcctgaggagcgatgccgagggaaatcatcaccctacaagttgggccagtgcggcaatcagattgggttcgagttctggaaaamcagctggtgcgcccgagcatggwwtcagccccgasnrcatcgtggaggagttcgccaccgagggcactgaccgcaaggacgtctttttctaccagggcagacgatgagcactacatcccccgggccgtgctgctggacttggaaccccgggtgatccactccatcctcaaactccccctatgccaagctctacaacccaagggaaac

SEQ ID NO: 27624 - DNA, 143 bp, Homo sapiens
  misc_feature 123: r=a or g
  misc_feature 125: v=a or c or g
  misc_feature 127: y=c or t
  misc_feature 135: w=a or t
  misc_feature 136: m=a or c
  misc_feature 137: w=a or t
acaactatgtgattctttccaagccaataaacatttccagtaatttcttaaaatagtgttcatggcagtcttcagcagtggcttctgactaatgtggcccctgattccgtcgtcctaggagaravcytgacatgwmwggcttt

SEQ ID NO: 27625 - DNA, 203 bp, Homo sapiens
  misc_feature 127: w=a or t
  misc_feature 139: m=a or c
agcaacccgtttggttatctttctgtgctgtggaaggtttgttctttcactctgcactattttgcaataaatattgctattgctcactttgggtttatattgcctttatgagctgtaacactcaacwtgaaaggtctgmagctttactcttgaagcttagcgagaccactaacccaccagaaggaagaaactccggacacgca

SEQ ID NO: 27626 - DNA, 337 bp, Homo sapiens
  misc_feature 122: w=a or t
  misc_feature 123: w=a or t
  misc_feature 124: w=a or t
  misc_feature 131: w=a or t
  misc_feature 132: k=g or t
  misc_feature 135: w=a or t
  misc_feature 277: w=a or t
  misc_feature 284: w=a or t
ccacaggtaaaaaattaagcaaaccaaagacttcattaactcttaggtaattaatattttaaactttgcttttttccactgggttgtcagcatttttagtaaatataatgtttgattttcgwwwtgtattwkggwaatgttttggattgtaaagtaaaatgtatgtagccactttaagtcccagatttggagatgtaatcaaatggcctcaattccaaagtgagtaaccttaaataaatagttatttttttaattgacaaataagttttttacatawtcaaggwctactacatagtgatgtttcaatacatataatgtatagtgatcagatcggggt

SEQ ID NO: 27627 - DNA, 302 bp, Homo sapiens
  misc_feature 120: w=a or t
  misc_feature 139: k=g or t
aatacttaagtcctggcaagtcataagtggggaaaatgtctctcccaagattccaaagagtaaactttgggccatatgataattacattccagtcagtgaattaagcaaaaaatcatggwatcagcaacactttgccckgttatttcccaaaaccacaacggccaggaaccaaaaggagatcaaaaccttctcaaatacgggacaacacggtttctataattgatgaagaacaattaagaggagatcgtagacaaccattatagatgtaccgttctttaatgagaatttctgagagaccatc

SEQ ID NO: 27628 - DNA, 87 bp, Homo sapiens
  misc_feature 72: r=a or g
taaattattgttgattgtaagcaccctgttgtgctatcaaatactagatcttattaattccatctaactatrtttttgtccccatta

SEQ ID NO: 27629 - DNA, 135 bp, Homo sapiens
  misc_feature 7: w=a or t
  misc_feature 37: m=a or c
  misc_feature 78: m=a or c
  misc_feature 105: y=c or t
gattttwatatataaatattatataaataatgtatamaacattaaaagttaactatgtaagatattatttctgaaacmatttagctatatccactatgtttatayactgtgtctcgacctgtgttatttacatta

SEQ ID NO: 27630 - DNA, 85 bp, Homo sapiens
  misc_feature 22: y=c or t
  misc_feature 37: w=a or t
  misc_feature 38: w=a or t
  misc_feature 69: k=g or t
tacaaagttggaaatgaatccyctgtacaagaattgwwacaagatgtgtctaaaaagattattgaaagkattattgaggagagtc

SEQ ID NO: 27631 - DNA, 90 bp, Homo sapiens
  misc_feature 82: k=g or t
agttgctcccaaagaggatttggtttggataacagttgtgatcactgggaaaatgctggtcaaatgtggaaaaacaagagtkggattagc

SEQ ID NO: 27632 - DNA, 222 bp, Homo sapiens
  misc_feature 144: r=a or g
  misc_feature 145: w=a or t
  misc_feature 180: k=g or t
tgactggccagatttgattagattgtaattggagggggcgcgggaagactttgggcccagaaccatctttctattgtttgtgttagccttaccctgtccctgccccaccttggttccccttgtctatggagcccccgccttgtrwgccaggaagcagcgtctcatcaggacagaaggtakgatgaagacatggggtaatgtgagagagtagaacacccccaa

SEQ ID NO: 27633 - DNA, 112 bp, Homo sapiens
  misc_feature 38: w=a or t
  misc_feature 56: k=g or t
  misc_feature 69: w=a or t
  misc_feature 72: w=a or t
  misc_feature 74: k=g or t
  misc_feature 96: d=a or g or t
  misc_feature 101: y=c or t
  misc_feature 103: w=a or t
  misc_feature 110: w=a or t
  misc_feature 111: k=g or t
ttcctgcgaaacttgacacgccatttgtttctacgtcwgacatcctcctcttttckctggtccgtgggwgcwtktgcaagcgggaccaggccccadcaccygwaccagcwkt

SEQ ID NO: 27634 - DNA, 289 bp, Homo sapiens
  misc_feature 141: w=a or t
  misc_feature 214: r=a or g
  misc_feature 215: r=a or g
gcgctcggtctgacgagactaggccatggagctgggttcgccgctgacctctccatctagcgcgcggccccggcgcccaccagtccagtgacccactactacctctttgctcaccagcagctggctgatcttactgccggwgaaatggcagacaaacgtctactctgtgctcttcagagtagacaccaggagcaggaactgtatgcacttcccrrgcccttgctgactgggaatggtctccaccctgagattttaaccagttccggtttagcaaatggcgcctcaccct

SEQ ID NO: 27635 - DNA, 51 bp, Homo sapiens
  misc_feature 17: w=a or t
  misc_feature 18: w=a or t
catagattttacagctwwggctttcattttgtttagctaaagtcatgggga

SEQ ID NO: 27636 - DNA, 183 bp, Homo sapiens
ataagctaaatacacctcttttctttataaattacccagccttgggtattcctttatagcaacacaaacggagaaagacatatgcaatttgccattttaatcatttttaactgtacaatttggtggtattaattatatttacaatgttgtgcaaccgttaccaccatctattaccaaagccct

SEQ ID NO: 27637 - DNA, 410 bp, Homo sapiens
  misc_feature 132: s=g or c
  misc_feature 135: w=a or t
  misc_feature 169: s=g or c
  misc_feature 171: r=a or g
  misc_feature 172: k=g or t
  misc_feature 281: m=a or c
  misc_feature 282: s=g or c
  misc_feature 347: r=a or g
  misc_feature 348: n=a, g, c or t
  misc_feature 358: n=a, g, c or t
  misc_feature 372: w=a or t
  misc_feature 373: w=a or t
  misc_feature 376: r=a or g
cgacagcaaaaaacagggaaatcagtagaagatggacaacaaatagtttgcagaaaacttggtggtaataagtatatgaagtgttactgaaaggaggaaaggaagttaaaataacaggtgagcaaaagtttstgwtcctttatgatctagcagtcttattcctgcgtascrkcgtcagaagaacatatacacgcctgtctatgagggttctatgtcttaggatgtcatttataggatatagagttggagctggttaaaaggatggatgagtaaaatgaagmsattacatactaaaagagtactatgtgagtcagtcccagaagacttaaaagttggttgaaaaaacrnaaacacctangtttatggtagatwwccrtttgtctaaatctctcacacaccccccttctgga

SEQ ID NO: 27638 - DNA, 181 bp, Homo sapiens
  misc_feature 133: w=a or t
  misc_feature 139: w=a or t
cgattttagatctttcctgctttctctagtgggcatttagtgatataaatttccctctacacactgctttaaatgtgtcccagagattctggtacgttgtgtctttgttctcattggtttccaagaacatcgwttatgwctcccttcattttgttatttaaccagtagtcattcaggagca

SEQ ID NO: 27639 - DNA, 136 bp, Homo sapiens
  misc_feature 9: k=g or t
  misc_feature 51: w=a or t
acaccagakatggaagtacatgtgatacaggtgtatccctttctgcctgtwtttctccctctcataaagcagaggtttgccctgcatctgagaaagaattagaacagaactttcctccatttcattccccaccaga

SEQ ID NO: 27640 - DNA, 259 bp, Homo sapiens
  misc_feature 13: w=a or t
tttcttaatgtawttttagttacatgtttgctatttaaaaattttaagttgtatttttacacccaatttataagaatgtttctagaagaaaatatattattctaaaacatataacttaggataaacattttaaaaaataaaattatagcactgtctacctgagtaaaactacaggatatgctttttatactttagaatttcttttttattatatatatcaagaaatatatatcaatatcttcattctctactaggcata

SEQ ID NO: 27641 - DNA, 250 bp, Homo sapiens
acaggggactgaacctcaccaccccacaaacacccccttcaggttttgccaagaatgacactgtaaatgtaacaaagcttctgtgcttgttagtgaacaccaactcagctcttctcctgtattcagaaatcaggatgaaatgaaaacaagaagcaggccgggcacggtggctcacgcctgcaatcccagcactttgggaggccgaggcgggcagatcacctgaggtcgggagttcgagaccaccccaatc

SEQ ID NO: 27642 - DNA, 182 bp, Homo sapiens
  misc_feature 56: s=g or c
  misc_feature 57: r=a or g
  misc_feature 95: k=g or t
  misc_feature 96: w=a or t
  misc_feature 152: v=a or c or g
  misc_feature 157: m=a or c
attggctgggcgtggtggtgtgcacctgtagtcccaggtacccgagaggctgaggsrcgagaattgcttgagcctgggaggtggaggttgcagtkwcccaagatcacaccactgcactccaaactgggcaacagagccagactctatctcavaccamaaacaaaaacaacccagagcacaac

SEQ ID NO: 27643 - DNA, 335 bp, Homo sapiens
  misc_feature 236: w=a or t
cgattcattaacaaagtatgtagtcagtcctcacttgtctccttataattggttcacattattacctgtcaataattctgaaatcccaatgcttttggaaagttatttttttcataagtttgcaactatctcatttggtggcaaaacttgactagaacttacttgatattttttacacttttttttttattatactttaagttctggggtacatgtgtacaacatgcaggtttgtwacataggtatacatgtgccatgttggttagctgcacccataaactcatcatttacattaggtatctctcctaatgctatccctcccccagaccccgact

SEQ ID NO: 27644 - DNA, 232 bp, Homo sapiens
ggtaccccccagtaaacttcctaatgatttcttatgactgttatcaggctttattgggattaggctaaagttgttagtaaacttataaaaggctgctatggtaacactaaacctaagtggtctcttgtctattagtttggtttgaattattagtactatcctgtagacccagagacatagtttatataagaattgctaaagctgaagttcaacttggctgagtgaagaacac

SEQ ID NO: 27645 - DNA, 90 bp, Homo sapiens
  misc_feature 8: m=a or c
gaggccgmgttgggtggatcacgaggtcaggagatggagaccatcctggctaacacggtgaaaccccgtctctactaaaaaaaaaaaaaa

SEQ ID NO: 27646 - DNA, 246 bp, Homo sapiens
  misc_feature 121: y=c or t
actgaaggtaggttcacagtcaggccaggcagcctttaggaacagcgtgccaatcacagtctgaggtacaccctgactggatcattagcctctacatcacttacctagaatttcttacctyaaagtaatttgtggccaggctcggtggctcacttctgtaatcctaacgttctgggaggctgaggcgggcggatcagttgaggtgaggagtttgagatcagcctggccggcgtggccaaaccccat

SEQ ID NO: 27647 - DNA, 250 bp, Homo sapiens
ctttgtaccttggtttcctcatttataaaatggggctaatattccaacctatctcctagggctgttgtaaggattagatgaacttagtgctgagaacaaaaacaatgcctgacacagagtaagtgtattcatattagctattgttattgacaaataattgtttggcatctactgtgccaaatactttgctaggctttagtagctggaggaggaagaatgatgttctcgggacagtggggtggggggctct

SEQ ID NO: 27648 - DNA, 111 bp, Homo sapiens
tttttttaagctcatcagctttcattagtgttagtgtattttatgtgtggcccaagacaattcttcttctttcaagtgtggcccagagaagccaaaagattggacacccct

SEQ ID NO: 27649 - DNA, 88 bp, Homo sapiens
  misc_feature 25: k=g or t
  misc_feature 26: w=a or t
  misc_feature 27: w=a or t
  misc_feature 28: w=a or t
gggaagggctgtcgtttcttagtgkwwwtctctgctattaatgaatccaaaaccatgaaacttggaagatggatggagctggagtgct

SEQ ID NO: 27650 - DNA, 320 bp, Homo sapiens
  misc_feature 103: y=c or t
  misc_feature 108: m=a or c
  misc_feature 169: s=g or c
  misc_feature 170: m=a or c
  misc_feature 174: m=a or c
  misc_feature 253: s=g or c
  misc_feature 254: w=a or t
  misc_feature 259: w=a or t
  misc_feature 262: h=a or c or t
  misc_feature 263: v=a or c or g
  misc_feature 296: m=a or c
gaagaggcaggactgcccggcccagccttggaggaagacttctgggcagaagcggaacacaggagcagagacacatagtcttggctccagtttcgtttcagtyatgcmcaccctttcagtgttcatggatgtgcccctcgcccacaagctagagggcagcttgttaaasmcctmcaaacaagatgattacccgaacaagatattcttagcctatagagtctgccatgacaaatgaaggccatccctgggtttswctcgwgghvcagaagactcgactacagatttcacaggatccmtccctgaattatgagtacttgcct

SEQ ID NO: 27651 - DNA, 369 bp, Homo sapiens
  misc_feature 164: m=a or c
cggtatttattcacttgtacttatcttagaatatgttcttttatttttattctaggcatacatacatactttaaggttattacttcggtgatgttcaggattttggttgggtaattactttcaaatcctggctagctaggtcactagctaggtgacccttgggmagattgtataacctttctatgaacttcagttacctataaattaactataaattggagatatgatgttgggatgattgcaacaaatgttttaagtgcctggaacatactagcagctcagtgaatggtagctgaaaggagcaaagccattaaaatttgttatgtttttataggtcttaaaagcatacaataggctgggcatggtggc

SEQ ID NO: 27652 - DNA, 133 bp, Homo sapiens
  misc_feature 86: s=g or c
  misc_feature 87: w=a or t
  misc_feature 117: r=a or g
acgtgatgcgccggctgtgcactcccctcgggcgggcctcctgttgcgcccgcctggcgagttccatcactgtcaccggctctgcswatccaagacagtatgcaaggccacgacccrcgagatcacggggcca

SEQ ID NO: 27653 - DNA, 130 bp, Homo sapiens
ctctttcactttttccctgctgagtgccccctcccacccctcccactccacacacaccctgtttgcccgtgagcctggggaacttgcagcttaaagccagccacccccacggcaacatgtaccccagctc

SEQ ID NO: 27654 - DNA, 335 bp, Homo sapiens
  misc_feature 247: m=a or c
  misc_feature 276: n=a, g, c or t
  misc_feature 293: n=a, g, c or t
  misc_feature 316: y=c or t
  misc_feature 323: w=a or t
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccamgttttgttgacccattcacccatcaaggnacccaagttgcttccanattttagctacagtgaataatgytactagwaacataagggca

SEQ ID NO: 27655 - DNA, 194 bp, Homo sapiens
  misc_feature 16: s=g or c
  misc_feature 96: v=a or c or g
  misc_feature 106: m=a or c
  misc_feature 146: r=a or g
  misc_feature 156: k=g or t
agagcctggcgcggascggcgagattttggtggggtctcacctgttgcgtgactcccccacagtccggccgcgggagtccgaccctgaatgcccavggagtgttgmgagaaatctggacgagtttcgggtcccgctcccttgggarcacgtggcckaccagcctctcgattgcagggttgggtggtcgcgacac

SEQ ID NO: 27656 - DNA, 110 bp, Homo sapiens
  misc_feature 54: h=a or c or t
  misc_feature 55: n=a, g, c or t
  misc_feature 61: k=g or t
  misc_feature 69: m=a or c
  misc_feature 70: m=a or c
atgggactcttcggcctaggcagccgggacccagccagccctgcgcctcgcgchngtcgckcatgcgtmmtggatgactgcaagagcaaacgacagctttaaggaaagaa

SEQ ID NO: 27657 - DNA, 137 bp, Homo sapiens
attctcctgcctcagcctcccgtgtagctgggactacaggcgcgcgccaccatgcccggctaatttttttttatttttagtagagacggggtttcaccgtgttagccaggatggtctcgatctcctgacctcgtgac

SEQ ID NO: 27658 - DNA, 113 bp, Homo sapiens
ttattcattgtgctaattagattttcagagccctgtatttttgtattatgatttaataaaaatatacaatctttctcttaaacacacacatattatacaagtcttacagaggc

SEQ ID NO: 27659 - DNA, 277 bp, Homo sapiens
  misc_feature 128: k=g or t
  misc_feature 275: n=a, g, c or t
  misc_feature 276: n=a, g, c or t
  misc_feature 277: n=a, g, c or t
agtaatggatggctccaccgaggccaggttggggaagttcagcctcgaggacactaggggacgaaaaacttcaaaaagaagactctttttattaatattttggcgttctttttggagaggaacttttkggatgtagcctttacctgtttcctgaatttgacatccaaaaagccttttggaaaacaccattctaaatttatcctgttctgaatcatcatcgcttctgatagatgcagttgcttgctgacatcgtgatctttgattttgtacaacgnnn

SEQ ID NO: 27660 - DNA, 246 bp, Homo sapiens
  misc_feature 15: w=a or t
ataaatgcttgctgwaaagttgcagttcacaagaatcttctgcttctgttatgtaaaaaattatttgtaaaagtccaataaggttacactaatgtttatgttttgaaaatattacctcttcccatttagtactatatgtattaaataaaattagatggtgattttttttggctttataatgtggttcagatttttgtagaaagtctggctgtgtctacattgccttaaagcaatgggatatttctc

SEQ ID NO: 27661 - DNA, 309 bp, Homo sapiens
  misc_feature 4: r=a or g
  misc_feature 130: w=a or t
  misc_feature 140: w=a or t
  misc_feature 141: w=a or t
  misc_feature 144: w=a or t
attratctatgtgtctgttgttatacgaatatcatgctgttttggtttctatatccttgtaatatgttttgaagtcaggtagtgtgatgcctccagatttgttctttttggtcaggattgctttggctgwtttgggttcwwttwtggttccatacaaattttaggattattttttctatgtctgtgaaaagtggcatgggtattacattcaatctgtagattgctttggatagtatggtcattttaactatgttaattcttttaatccatgagcatggtattttcttttcacttgtttgtgtcctcttc

SEQ ID NO: 27662 - DNA, 228 bp, Homo sapiens
  misc_feature 5: r=a or g
  misc_feature 94: w=a or t
  misc_feature 97: w=a or t
  misc_feature 102: k=g or t
  misc_feature 106: w=a or t
  misc_feature 110: w=a or t
  misc_feature 120: s=g or c
  misc_feature 128: r=a or g
  misc_feature 134: r=a or g
  misc_feature 172: s=g or c
  misc_feature 175: m=a or c
  misc_feature 187: k=g or t
  misc_feature 192: m=a or c
gcagrgtgggccggagggcgggcgccgccgctgcctgtgctgcggcgatggcccagtgtgtacaatcagtgcaggagctaatcccggactcctwcgwcccckgtgwcgcwgcgcctgtgsagcgacgraagccragcggctcactcgtctcaatcacctcagcttcgcggastgmttaagcccttckcccgmctcacttccgaggttcacatgagagatcctaataat

SEQ ID NO: 27663 - DNA, 202 bp, Homo sapiens
  misc_feature 114: w=a or t
  misc_feature 117: w=a or t
  misc_feature 122: w=a or t
  misc_feature 124: m=a or c
  misc_feature 125: w=a or t
  misc_feature 150: w=a or t
  misc_feature 156: v=a or c or g
  misc_feature 157: k=g or t
caattagtcctcccacctcagcctcctgagtagctaggactacaggtgtgcaccaccacgcttggctaattttttagtttttttgtggaaagagggtttcacattgcccaggcwggwctcgwgmwcctggacttaagtgatcctcctgcwttggcvkctcaaagcactgggattacagacgtgagtcaccgcacccagccaa

SEQ ID NO: 27664 - DNA, 271 bp, Homo sapiens
  misc_feature 125: w=a or t
taatacagatcatttaacatttttcattaattattacatatcaccttgtatcctggagttaatttggatgtacattgaagtacaagtgtgttttattttgtccattagatgactgtgaaaatgtwatatgtaaaattgaatttttataaattttcataaatagtactgctatttaaaaatgtataatttcagtaatgtttaatttttgctttcattcattagtgagtctttgtggtttaccttaactttttctaatattcctttctttttt

SEQ ID NO: 27665 - DNA, 295 bp, Homo sapiens
  misc_feature 191: d=a or g or t
  misc_feature 238: y=c or t
  misc_feature 239: n=a, g, c or t
gacagatgttctaccagtgaacagtttcaccatctgtgagattctgcctctttagttgcaatggtagaagaagagagattagagaatctcacatgggctttccactacccctgcccagaagtctcagacatcattccttctcaagtccatgggctagaactgaccacaggacccaacctacctgcaaggadgctgagaaatgtgggaaggtgaatggaatattaaatggagtctcgcyntgtcacccaggctggagtgcaatggcgtgatcttggctcactgcaacctccaccca

SEQ ID NO: 27666 - DNA, 321 bp, Homo sapiens
atccttagaaagacatgggagggcaggggcaagaacggcagcctctccctagctcacatctcaccagggttggctaagcagtcctccccttgccccacgagtggcaggacagctccccaacacttctctaggcttaaagtacatgtggaagggcgagcctcccaggattctcaaacagaagcagcctgccaggctgagccatccagaagcccataagctggaacactaatgtggcaatgaccaagttttagccgtagagatgaggccaacaccctgtggaacaccggagcaaagtaacaagatagagcagccagtgggtac

SEQ ID NO: 27667 - DNA, 214 bp, Homo sapiens
  misc_feature 121: m=a or c
  misc_feature 122: s=g or c
  misc_feature 130: r=a or g
  misc_feature 134: w=a or t
  misc_feature 137: s=g or c
  misc_feature 143: b=c or g or t
  misc_feature 145: w=a or t
  misc_feature 147: k=g or t
  misc_feature 193: r=a or g
agttggggagcgcagatccgaagcagcgctgggagcgtaagtgcgggcagagcactgcgccgtttgggaacgcaactttgaggagacagtgcggtggacttcagtgaagttccttaatgamstcccctgraaawttscttccbtwakcatgggggcaaatgaaagtaaaaggctctaatacaacctataaggrctgcaaagtatggccagggat

SEQ ID NO: 27668 - DNA, 210 bp, Homo sapiens
caaaaactagttgggtgaggtggtgcacgcctataatcccagctacttgggaggctgaggcaggagaatggtttgaactcaggaggcggagttacagtgagccgagatcacaccactacactctccagcctgggcgacagagcaagactccatctcaaaaaataaaatgaaaggccctgctgcatcagagattcagtgaccaacccctct

SEQ ID NO: 27669 - DNA, 285 bp, Homo sapiens
  misc_feature 154: k=g or t
  misc_feature 155: w=a or t
aacttcgcggacttccggttcaagccggaagttgtggttaccaaggcgacgcaacgccgcccggccaggtatcattagactcttttatttttataaggaaggactttacctagtcaaagccatcaatgaagtggatgataccagcaagcaaackwcctgtataaagatggagatctctcaaggaggggactttgcagccttcctcctacaaggagccggagatatttggctggatgtgtataaattgcccaaggagacttggctcaagaaactagagcaccctcc

SEQ ID NO: 27670 - DNA, 61 bp, Homo sapiens
  misc_feature 15: w=a or t
agttagcgacagggwgggatgcgcgcctgggtgtagttgtgtgtggttttttttttttttt

SEQ ID NO: 27671 - DNA, 305 bp, Homo sapiens
  misc_feature 111: r=a or g
  misc_feature 112: m=a or c
  misc_feature 119: w=a or t
  misc_feature 277: m=a or c
  misc_feature 295: m=a or c
agcccacatctaaacaaacagcaatttgcccatatgtgactaaggcagagaaagacaggtgactagaaatattaaaacaaaaacaaaaaaaaagagagagagagaaaaagrmaagagawaaatacatatttcttccccttactaagctagcgaaaataaaatttaaggcaactgaaatatgcacccaatcaatgtgagacgagaccccagcatccctatctatggactccgacagtccatcttattaaataccaggcttcaggactgctatgtggamtcaccggctctcaccaamatctggaagt

SEQ ID NO: 27672 - DNA, 114 bp, Homo sapiens
  misc_feature 15: d=a or g or t
  misc_feature 99: m=a or c
tgaatactgtaacadatatatttcacatagagcaaatgtttgcacgtagctcctctgagatggggtcccgtggtttctgtttggacctttccagggacmaggaactcccacatg

SEQ ID NO: 27673 - DNA, 403 bp, Homo sapiens
  misc_feature 16: k=g or t
  misc_feature 144: k=g or t
  misc_feature 146: w=a or t
  misc_feature 228: m=a or c
gagtagtgatgtctakagggagctattttgtgctgaggccactatgttctgtaaatatataattttaagagcaacctcacaatccctgctaagtggagtttattatttgaagactaaaatggaattcatagttcctgataggtkawattctgagttattattctgagttatctacaaacatttttgagatttgtctttacactctgattgtagtttccagcagcccamgcacactgccaagtaagtctcattttttcctgttagaaatggtgaaatatcatataatcacttataaagaaaactgatatgaaaaaattttagagttgtttgctttatggtcactcaagtagggtaagtgttccacaagttccacaagttgatagtttaacatggatgtctgaaa

SEQ ID NO: 27674 - DNA, 112 bp, Homo sapiens
  misc_feature 58: k=g or t
  misc_feature 112: r=a or g
gagactgccacctgaacactttgggctcctcatgcctctgaatcaacgggcaaagaakagagttatagatcctaaccacccaggagaaattcggtggccactacacaaacar

SEQ ID NO: 27675 - DNA, 68 bp, Homo sapiens
ttattatacctcaataaagttgctgctgctgctggtttttgtttttgtttttgtttttttttttgaga

SEQ ID NO: 27676 - DNA, 112 bp, Homo sapiens
  misc_feature 80: k=g or t
ttattatacctcaataaagttgctgctgctgctggtttttgtttttgtttttgtttttttttttgagatggagtctcgckgttgcccaggctggagtgcagtggcgcgatct

SEQ ID NO: 27677 - DNA, 450 bp, Homo sapiens
  misc_feature 129: w=a or t
  misc_feature 131: w=a or t
  misc_feature 440: v=a or c or g
tgatagtaaagttactttcttaggttatgcaggaaattgggggaagggaggcaggatggtatcaatgcgaggaaaataatccacatggttctatttttaactagtcagttgttgtttttttaatcacawtwctaaaattcccttttgataagcaagaaccagccatctaatttgactctttccttgttattgggttggaattgagacctggtgattccattcagatgtttgtaaatactttattgcactgaagtctggtatgtgtatctaggccctcttttcatttccctttgaagcacctcaaaaatacaccttaattttcctgtctcttctcaccactcctttatattgctttttagtgagattttaggaatgtgagtaggatgaattgtaactgagcttagctgctcttttagctttctggagcttcccaaataatvaagaaaggca

SEQ ID NO: 27678 - DNA, 135 bp, Homo sapiens
agagcaaagaggcaatctgaagagaaaagcataggaaaggaaacagtggtaataggaattggggtaaaatgaggatccttccccacaaacattgctattattcagctcatttcaaaggattccgctgctgccaaa

SEQ ID NO: 27679 - DNA, 169 bp, Homo sapiens
ccctcaaacacagtatttctgattctgcctctagatcagggggtcataaggacctttaaggttcattatacatggtactttatggaacagattgtcaatgctgtggaagagaatcccaatagatggaacatcataaaagtccggaaggattacatcattgaagatgccc

SEQ ID NO: 27680 - DNA, 339 bp, Homo sapiens
  misc_feature 16: d=a or g or t
  misc_feature 107: w=a or t
  misc_feature 202: k=g or t
  misc_feature 203: y=c or t
  misc_feature 257: r=a or g
  misc_feature 328: m=a or c
acttatttttgtatgdcttggaatttcttatgaaaactaagattttggttactatatgaatttttgcacagggatgagaaatgacatgtgttgacttctctctctcwctttttccctagaatactctctaagtggtggaggaacttcatcccactgaaattcctttggcatttggggttttgtttttccttttttccttctkyatcctcctccttttttaaaagtcaacgagagccttcgctgactccaccgaagargtgcgccactgggagccaccccagcgccaggcagcccgtccagggacacacacagtcttcactgtgctgcmgccaagatgaa

SEQ ID NO: 27681 - DNA, 185 bp, Homo sapiens
  misc_feature 136: w=a or t
tggatgacagcgagaccatgtctctaaaaaaataaagtaataaaaagtcttcatttataccccacaatgaatgagttcaaatctgtttttacccagtgttgcagataattattgcccaggacatttgggaaatacwatccaacacttatagtttgcatctgttgtagcacttaaatcccctcaac

SEQ ID NO: 27682 - DNA, 269 bp, Homo sapiens
  misc_feature 17: w=a or t
  misc_feature 226: d=a or g or t
tcttgggaaaaaacggwgaaatattaattggaaagttgatttttatgataatatggaaaacctaaccattataaaaaagcaaacttgagtttcctaaatgtaagcatttaaagtaatgcatatttgttttaaaaaattatttcgctgtcatttatgatatgtgttcattggggatctcttggtttgcctgatactgacttcagcaaaagcacagggctgtaaattdccatttactagactagccaaatagtcttagacatttcccagaa

SEQ ID NO: 27683 - DNA, 129 bp, Homo sapiens
tatactttaaatcacctccagattacttataataatacaatgtaagtggtatataaatagtggttatagtgtatagttttttcgtggtgtaattttttactggtttttcttttggattttttttttttt

SEQ ID NO: 27684 - DNA, 140 bp, Homo sapiens
  misc_feature 123: w=a or t
ttcttcatcacctatggcaaacagccacatttggacatgaaatacaccgtatttcatgtccaaatgtggctgtttgctctcaatgaagttgaataaaccaggaggcttggcatatcccctttwtgttaaatcccaggcta

SEQ ID NO: 27685 - DNA, 238 bp, Homo sapiens
  misc_feature 149: d=a or g or t
tgatatttattgggcacttaccatgtgccaggcactgtcccaagcactttatgtgtattagttcactgacttctcacggcagccctgggagataggtattcttttcatccccactctagagatgaagacactgagccctgaggtgttadcttgctccaggttgcatagtaagtggcagaggcaggactgatacataagcaggctgacccagggcccgcactctcaacccctgccccca

SEQ ID NO: 27686 - DNA, 243 bp, Homo sapiens
  misc_feature 143: m=a or c
atttttctaaaggccgtcttgaagaaaattaaaccagaaagatcaagaaaggctggagtgcaatggtgtgatcttggctcactgcaacctccaactaccaggttcaagcaattctcctgcctcagcctcccgaatagctgggmctacaagcgcatgccaccatgccaggctcatttttgaatttttagtagacacggttttgccttattggccaggctggtctcaaactcctcacctcgggat

SEQ ID NO: 27687 - DNA, 99 bp, Homo sapiens
atttgtagcagctcttttgtgatgacttagtctctaagcccgtgaaagaaaaagaaaactctcggtggcaaggttgaagtagaaatgacgaagatgaat

SEQ ID NO: 27688 - DNA, 318 bp, Homo sapiens
  misc_feature 123: w=a or t
tagaggtaggctggctatttatttatgtatcttgttgatgggaagattcaaattgatatacataatcacccccataaggatttcaggtaaaaaacaaacaaacaaaggtttagatggttagawatattttacaattaccacaccagtctttttactacagcatctagtaacacatttaccatagatttagatggaaattttcatcccataagcctttgttagtatttttaaaattgaatactcaataaatagtggccaagttgaatctcttagaggaatctcactcaaactacagtcatattttccaataggccccat

SEQ ID NO: 27689 - DNA, 287 bp, Homo sapiens
  misc_feature 23: w=a or t
  misc_feature 37: r=a or g
  misc_feature 52: y=c or t
  misc_feature 116: k=g or t
  misc_feature 145: y=c or t
  misc_feature 163: r=a or g
  misc_feature 225: w=a or t
atcagcaaagtattttttttttwaagaaataaattgrgatttgtatgttctyccttttaggtttgaagcaaagaagagatgggaaaccaaaagcaacatgggatacatgtaacttkccagagtgcttcaagacatttgtagaccyaaatgctcaatttactgrgaatgttttcctgcctatgttaatatgtcagaaaattgatagcactaaaacaaaaataagcwtaaaatttgggattttgaattatcagctcttttcagtctttctttaaggactttgtcctatt

SEQ ID NO: 27690 - DNA, 96 bp, Homo sapiens
gctttgaggttttgctcaacagggtaaagtcatgtaagttttacctggtagactgataggtgtttctttatctggaaaacctggtgtcaccgacaa

SEQ ID NO: 27691 - DNA, 267 bp, Homo sapiens
  misc_feature 17: w=a or t
  misc_feature 115: s=g or c
  misc_feature 222: k=g or t
  misc_feature 223: d=a or g or t
  misc_feature 225: d=a or g or t
  misc_feature 258: k=g or t
  misc_feature 259: w=a or t
ccaagaactaatagagwtgttagaattagcagacaaggacatggaaacagtttttataactgtattccataaacacagaggtaagtagagaaacaaaagacgtgaaaatgcctgsgtctaaactttctagagataacaactacaatttctgaggtaaaaaaaatgactggatgagattaatagcagattagatattgcagaagaatagatcagtgaatcgakdgdcataacaatagaaactataaaaaaaaaccacakwggaggata

SEQ ID NO: 27692 - DNA, 91 bp, Homo sapiens
agccggctgcaggggaagtcccggcgcccggcgaaaccaccctcccctgaccggagcgccaacacctcccccgagagcagcagccgcctca

SEQ ID NO: 27693 - DNA, 64 bp, Homo sapiens
cacacatgtaatatagcagcaatgaaaacatagaagttttaagtcatgagtggggttgcacagt

SEQ ID NO: 27694 - DNA, 128 bp, Homo sapiens
  misc_feature 16: n=a, g, c or t
  misc_feature 17: w=a or t
  misc_feature 110: w=a or t
  misc_feature 118: k=g or t
tgtgattggtgggtanwtgtttgattggtgggtattgtgattggtgggtatttgtttgattggtgtgtattgtgattggtgggtatttgttatgattgattggtgggtawttgttgtkattggtgggt

SEQ ID NO: 27695 - DNA, 106 bp, Homo sapiens
  misc_feature 2: s=g or c
csgagcaaacttttggcacccaccgcagcccagcgcgcgttcgtgctccgcagggcgcgcctctctccgccaatgccaggcgcgcgggggagccattaggaggcga

SEQ ID NO: 27696 - DNA, 193 bp, Homo sapiens
  misc_feature 15: k=g or t
  misc_feature 136: d=a or g or t
  misc_feature 137: v=a or c or g
tataggtatttgatkagagattatatttagtttgtagatcactttgggtagtatgagtgttttaacaatactaattctcccatgaacatgaaacgtctttccattcatttgtgtcttcttcaattttctttcatcdvggtttttatagtttttcagtttagagatctttaacctccttggttaagtttattct

SEQ ID NO: 27697 - DNA, 262 bp, Homo sapiens
aacactcactcctctgcctctgcaagagaaaagcccaagggcctaggtaaacaatggacagcatcctggatgatgatgcaattttaagcctgaaaagaatatttggtcttcaatcttggcaagcatacctgtaaagtagatggtaaggctgctgatgagaaccatttgagaaaaaatgatcaatgagaaaattgcaccagaggacccacattgggacttttgagttgaacacattacttagcaaatgctaacatgggaaatt

SEQ ID NO: 27698 - DNA, 293 bp, Homo sapiens
  misc_feature 141: k=g or t
  misc_feature 145: b=c or g or t
  misc_feature 146: w=a or t
gaggacgctggcggctccgcgacgagctttgttttttcggttgggcatgctgcttaccgcaggatgatggaagcgacggcccgtacaaagacagaagcgttggtttcactgagtcagtgctgatctctcaataagagcttkaagbwtaaatcttcatttttgtttcaacaaaacttcgaaacaaaatggaagaaaataatctacagtgcagtagtgtggttgacggtaattttgaagaagttcccagggagacggcaattcagtttaaacctccactatacagacagcgcccc

SEQ ID NO: 27699 - DNA, 184 bp, Homo sapiens
  misc_feature 125: w=a or t
  misc_feature 126: w=a or t
  misc_feature 128: k=g or t
  misc_feature 147: y=c or t
  misc_feature 167: k=g or t
  misc_feature 170: y=c or t
aaaacaaattgagcctgctcagggttccgcatgggtggctcacagggtggtcttgggcatacccactggtttgggatgatgactttctcagtatcaggagaggagtggaggcattggggactggwwckggcttgtcccttgggaaayttttgcctctctcttgttckaaycctaacaggagtat

SEQ ID NO: 27700 - DNA, 433 bp, Homo sapiens
  misc_feature 433: w=a or t
ccaaataaagcaaatagctcaatatttttgaatttgtcatatgactagcagtctaaactcagactaaattaaggtgaataaaagcagaagaattatcattgccaacatgtttttgtaatgaaacttgaaaggtgtttattcaaaataaaagaaaaaaaatagctgagtctggcacagtggctcacacctataatcccagtgctttgggaagcaaagtggggaggatcacttgaggccagttcaagatagcccggacaacatgacctaggactacagcacaagcctataatcctagctcgttgggaggctgaggcggaaggatcgcttgaccccaggcttcaaggcttcagtgagctgtgatcacgccactgcactccaagcttggtcaacagaacaagactctgtctccaaaaagtaaataacttgtttttaw

SEQ ID NO: 27701 - DNA, 74 bp, Homo sapiens
  misc_feature 9: r=a or g
  misc_feature 10: s=g or c
  misc_feature 15: r=a or g
ataaacggrsatgcrgtcagggaggtttcatatctcccagattcctatcccagaaaagcagatgttcatagctc

SEQ ID NO: 27702 - DNA, 195 bp, Homo sapiens
  misc_feature 126: y=c or t
acaaaatgacctcccctggcaggacaggatctaggcagattcatctctaactcccaaagccccagggtctcactgtcacccaggctggagtgcagtggcgtgatctcagctcactgcacctccacytcccgggttcaggagactctcctgcctcaggctcccgagtagctgggattacaggcgcccgccaccaca

SEQ ID NO: 27703 - DNA, 260 bp, Homo sapiens
  misc_feature 17: d=a or g or t
  misc_feature 127: w=a or t
  misc_feature 133: r=a or g
  misc_feature 150: n=a, g, c or t
  misc_feature 186: n=a, g, c or t
tctttaatgtttagagdctatcaggctaaactgaatctattttagtttgcatatacaccatcttttatttatttatttattttagagacagggtctctgtcacccaggctgcagtgcaatggtgtgwtcacarctcactgcagccttganctcctgggctcaagtcatcctcccacctcctgagtnactgggattataggcatgagccactgggcctggctacgtatacgccatcttttcttgcaaagtattttgggcga

SEQ ID NO: 27704 - DNA, 157 bp, Homo sapiens
acacacgccccaaacgcacctcggcgagccacccgaggaggaaaactagtggggcagagcctgaaccacctctctttctccataagcatctcaagacttggaaactaagaggacagaccttttcctcctccttccccccgccctccttcccacccaa

SEQ ID NO: 27705 - DNA, 212 bp, Homo sapiens
  misc_feature 21: r=a or g
  misc_feature 83: m=a or c
  misc_feature 85: w=a or t
  misc_feature 153: w=a or t
  misc_feature 165: m=a or c
  misc_feature 174: r=a or g
attacacagtccttaagctaraaatgccagagatatgccatacagatctactgcacctatttgggcaccatgaggaagaggcmawcaaaattctaagagaaggcaacccagtgctctggcagtattgaggctccaaaccagccctggaaagtwctacagtggaamtctatcatratgtgcattaaactgaattgaaatcaatacgactcagc

SEQ ID NO: 27706 - DNA, 122 bp, Homo sapiens
actaaaatcaaaagcttgtatatcagatttatttcttaattttaacttttgtttttgattcagggagtacatatgcacgttcgttatgatggaatcagttgtaccccaaacctcaggaccac

SEQ ID NO: 27707 - DNA, 147 bp, Homo sapiens
attcgtcatcgcgggtgagtgatccccgcgtccgcccgcagattgctcaaaacgccgacaacagctcacctcccatggccgctcggcttggcagcctctatacggaccgctccatgctttgctataagatttattcaaagtttttta

SEQ ID NO: 27708 - DNA, 136 bp, Homo sapiens
  misc_feature 65: m=a or c
agttccagggaggggcggggcctgaaatggggcggtggcaccgagagggaaggcggctgctgggmcgcagccggaggatttgagggcgaataattcccagcccggctccccgggagacgggctgcggggcgggcac

SEQ ID NO: 27709 - DNA, 300 bp, Homo sapiens
  misc_feature 45: n=a, g, c or t
  misc_feature 46: r=a or g
  misc_feature 52: w=a or t
  misc_feature 63: h=a or c or t
  misc_feature 183: d=a or g or t
  misc_feature 247: w=a or t
  misc_feature 254: w=a or t
  misc_feature 261: w=a or t
  misc_feature 273: w=a or t
  misc_feature 274: w=a or t
  misc_feature 298: m=a or c
atagggaatgttggctctgaacaaacttttgaaaacttggttganraatttwggatcaactghaaaaagcatgacttttgaaatctctgaatgccttggttctcagtattatcattctttattgaatttatttcttattaaaatatgtagtttttaagactttttttctgacagtattatgtdattttttagcgtgggtagatgggagtgtcgcttgtatgttatcgtacagctgacatgtattttwgtctatwctttatwatcttagtttcwwgctatgtatgtaccataaaccaamgc

SEQ ID NO: 27710 - DNA, 260 bp, Homo sapiens
  misc_feature 117: r=a or g
  misc_feature 148: w=a or t
agagcaagggtcttgagcttctggagcagccttccaagtgggctaagtctatgggacagtttgttgccaactttgcaggaatgtgaaggctggagcaacagcaaccctcttggtccrgcaagaggactggtctagcaaccctctaggwaatcttgagggtggaaggcacacagtaagagggtggaccaagcaaggatggaaggaccctgggtcccatgattggagctgtccggcagccaccagaccagactatcgccaac

SEQ ID NO: 27711 - DNA, 162 bp, Homo sapiens
  misc_feature 16: n=a, g, c or t
  misc_feature 17: w=a or t
  misc_feature 115: m=a or c
  misc_feature 121: w=a or t
  misc_feature 127: y=c or t
  misc_feature 134: s=g or c
  misc_feature 135: v=a or c or g
  misc_feature 137: w=a or t
  misc_feature 142: r=a or g
tccgtcacatctaggnwgtgaggagcgtctctgcccggctgcccatcgtctgagatgtggggagcgcctctgccccgccgccccatctgggatgtgaggagcgcctctgcccggmcgcggwcccggyctgggasvgwgaggragcgtctctgcccgaccaca

SEQ ID NO: 27712 - DNA, 271 bp, Homo sapiens
  misc_feature 165: b=c or g or t
  misc_feature 220: y=c or t
  misc_feature 234: r=a or g
  misc_feature 235: m=a or c
  misc_feature 248: m=a or c
tttatgattcaaaactcagttattttataaaataataatattaagtggataaagaaacgccagttgtactatcagctaaacattagaaaccttctcatcaggccaggtgaggtggctcatgcctgtaatccccagcactttgggaggccaaggcgggcggatcabctgaggtttgggagttcaagaccagcctggccaaccatggagaaaaccctgtctytactaaaaatacarmattagccaaggcmtggtggcacatgtctgtaaaccc

SEQ ID NO: 27713 - DNA, 198 bp, Homo sapiens
  misc_feature 118: k=g or t
  misc_feature 120: y=c or t
  misc_feature 123: w=a or t
  misc_feature 129: y=c or t
  misc_feature 133: r=a or g
  misc_feature 135: w=a or t
aaaaatccccagaatctcaggctggtgggtccagctgagcatcctagttttcactttctcctcccaaaaaggaaagaaccttggtcactaaattctacgccttctggaaatcactctkcyaawtgactycctrawtgatcgactgagaccaacagctggcccagccctgcatggaggagtaagaaaccctcatctgtc

SEQ ID NO: 27714 - DNA, 178 bp, Homo sapiens
  misc_feature 118: w=a or t
  misc_feature 119: m=a or c
  misc_feature 122: y=c or t
  misc_feature 125: r=a or g
aaggggcgggctggttaagcgtcaggttccttggatcgaccggtcagcccagtaactgactccttttctcccttctctagggtcctagcacagtgtctgatggagctttcctaccagwmccytgraaaattcacgcatcaggcgcgggaagcgtgcgagatgaggacagaagcacgac

SEQ ID NO: 27715 - DNA, 191 bp, Homo sapiens
  misc_feature 14: r=a or g
  misc_feature 126: m=a or c
acaatatgggaggraaagtgaagattgtgatggtgtaagagctaaatcctcatctgtcatatccagaaatcactatataatatataataatgaaatgactaagttatgtgaggaaaaaaaacagamgaccattggctaaaagagttaaaagtcattgctctggagaattaggagtgatggggcaagggact

SEQ ID NO: 27716 - DNA, 261 bp, Homo sapiens
  misc_feature 15: k=g or t
  misc_feature 187: d=a or g or t
  misc_feature 188: b=c or g or t
  misc_feature 240: w=a or t
cagtggctttgttckatcctagtctttactggtgacctatgtccccatgtggaagacgaatagagtcaggaagttcttcctttataattaacccaagtctctctcatttccgtctgtgtcctcttgttcttactgcagagaagatggaataaatccccttcagtctttcctcttagctaaatgttcdbagcttctttaagttgcactcgggttctaattctggaagtttttaactttgtwctttatcatcacccctctcac

SEQ ID NO: 27717 - DNA, 212 bp, Homo sapiens
  misc_feature 16: k=g or t
  misc_feature 17: r=a or g
  misc_feature 118: w=a or t
  misc_feature 120: k=g or t
  misc_feature 122: w=a or t
  misc_feature 128: k=g or t
tgaagaaaggcccctkrgaatggcaagattacatttacaaagaggtccgagtgacagccagtgagaagaatgagtataaaggatgggttttaactacagacccagtctctgccaatawtkgwcctggkgaacttccttgaagatggcagcatgtctgtgaccggaattatgggacatgctgtgcagactgttgaaactatgaatgaagggga

SEQ ID NO: 27718 - DNA, 272 bp, Homo sapiens
  misc_feature 16: s=g or c
  misc_feature 17: r=a or g
  misc_feature 119: n=a, g, c or t
tataattttctatgtsratacaaaaatacatcacagccttctcaaacagctcaagcaatatattgtatattgccatatcgtctggtgaaagggttaaattacttcacctcttgcacttntaagatgcaaatcagtttttcatttctgtaatagaaaattattcacgtatttttacatcatttgtttttcctgaccagtatttaaaaccaaaaggatattctgaaaaatggccaacaatttttttagaagtagcatcccaagcagcgtgcctt

SEQ ID NO: 27719 - DNA, 335 bp, Homo sapiens
  misc_feature 17: k=g or t
  misc_feature 125: w=a or t
  misc_feature 130: r=a or g
  misc_feature 156: n=a, g, c or t
  misc_feature 157: v=a or c or g
  misc_feature 327: s=g or c
gcctttctggacttggkactccttgggagtcgtttctcggccatttgacccgtgggacttgtgggttttgtgctgctttttctttctttcttccccttttccaacttcagcaatacacccaagawgttartcgagtcacgtcccgccgccctctgnvcttgaaatgctggcaagtacgcagccccgcgatcgtcacgtgacgccggggttcagcgtatccttgctgggcaaccgtcttagagaccagcactgctggctgcaccatgaatgtgatctacccactggcagtccccaaggggcgcagactctgctgtgaggtgtgcgaascccagcct

SEQ ID NO: 27720 - DNA, 195 bp, Homo sapiens
caagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaac

SEQ ID NO: 27721 - DNA, 231 bp, Homo sapiens
tgttcaaattaatgtatatacttaagtgattttaaatataattaatttcaaaggacaatataaggcttcaagattgctcagcactatgtgaagaggaagaagatgaagatgaaggagaagctgcagatatggaagaatatgaagagagtggattgttggaaacagatgaggctaccctagatacaaggaaaatagtagaagcttgtaaagccaaaactgatgctggcgggc

SEQ ID NO: 27722 - DNA, 381 bp, Homo sapiens
  misc_feature 8: r=a or g
  misc_feature 126: k=g or t
  misc_feature 132: s=g or c
  misc_feature 138: k=g or t
  misc_feature 166: m=a or c
  misc_feature 266: r=a or g
  misc_feature 293: v=a or c or g
  misc_feature 294: r=a or g
  misc_feature 321: h=a or c or t
  misc_feature 322: w=a or t
  misc_feature 324: n=a, g, c or t
aagcagaracaccagcgttgctgcgaccgcgttggcgatggcgcacgaaggctcggtgagcttcagttcagctggggatgcgccagagccagggtcggccgttaaggtcggtgtcgggaaacagtkggctgsctctgkgccgcccagtgcccctacttgctcccgmccaccgcgcgggagtttagatgaccaaggaagccacgtcggtactcgggcagaaaacctacacctgcacggtgcccactcaaacgctttgttacactcaragccatgagggaaagggtcagtgggtvrtgtaagagcccgagaacaggaagtgghwtntgaaacaagctaatgaatgtagtaagtctcttacatggtggtgcgtatttaaatgga

SEQ ID NO: 27723 - DNA, 120 bp, Homo sapiens
ctttttttaaacttttttattttaaaaaatgtattaacttttaatggacaaaacatttataatatacaacatgatgctttgatatatgtgtacattatggaataattaagtcaggctaat

SEQ ID NO: 27724 - DNA, 181 bp, Homo sapiens
  misc_feature 121: y=c or t
  misc_feature 127: h=a or c or t
attttggggacgccgtgagggagtcagcgttggggacagggagagggaggaaaagagcctgggaaattgaggcacgcggcaccttgagggctggagcgggggaatggaggcacgggaaccyttttghggtttccccgagggtcagagggagaaagtgaaaccacttagcgcgatgggtaga

SEQ ID NO: 27725 - DNA, 58 bp, Homo sapiens
  misc_feature 11: w=a or t
  misc_feature 18: m=a or c
  misc_feature 29: w=a or t
  misc_feature 35: m=a or c
  misc_feature 40: m=a or c
agagcttgcgwggcgcamagagcccccawggcctmatggmgcagaaacctctcagcac

SEQ ID NO: 27726 - DNA, 61 bp, Homo sapiens
  misc_feature 33: m=a or c
  misc_feature 34: m=a or c
gaggctggccggtgcagagttaagggttcagtmmatgatttctgcatccatgaaaggggga

SEQ ID NO: 27727 - DNA, 104 bp, Homo sapiens
ccttacaacaaactccagcggagccgagtattctagcagcaaaacttgcattccagaaagatatgatgaagcctttggccccagccttcctgtcctcacctctc

SEQ ID NO: 27728 - DNA, 95 bp, Homo sapiens
  misc_feature 36: v=a or c or g
  misc_feature 52: s=g or c
gtcgcccagcgccgccccgtcgtcgtctgccttcgvttcacggcgccgagcsgcggtccgaaatatgacagatacctagcatctagcaaaataat

SEQ ID NO: 27729 - DNA, 91 bp, Homo sapiens
  misc_feature 39: s=g or c
  misc_feature 71: y=c or t
  misc_feature 88: m=a or c
accccgcgcgcgcctctctgtcgtggcgcggcttcccgsgtcttctctgcaaatgggctccgtggcctagygcccccgtccccgccamcct

SEQ ID NO: 27730 - DNA, 54 bp, Homo sapiens
ggcggcggtggcgacgacggccgagacgtggggatggcgggcgccgggagcgaa

SEQ ID NO: 27731 - DNA, 184 bp, Homo sapiens
  misc_feature 121: w=a or t
catccaaacaagctcctgcaaggctctgcagcttattgctattttataattagaatttagaaataaaatggggacatgagttgacattccaactggaatattgtatttctctgaaaaagtwactcttacttggctgattagtttggtgttagcaactggcattgccattaaacagtgtggtacc

SEQ ID NO: 27732 - DNA, 311 bp, Homo sapiens
  misc_feature 49: m=a or c
  misc_feature 149: r=a or g
  misc_feature 257: r=a or g
atttcaagtatccatgtccattgcagctgctctggaactcacaggaagmtctcagtttttgcaaactcatggaagaatcacctggcatgatggaagtggttcattgcatgatattcaactgtcattgccatccagtccagaaccagaaratggtgataaagtatataagaatgaagatttattaaatgaaataaaacaaattaaagacgaaataaagaaaaaagatgaaaagatccaactattagaacttcagcttrcaactcagcatatctgccaccaaaaaatgtaaagaggaaaaatgcacttatgct

SEQ ID NO: 27733 - DNA, 89 bp, Homo sapiens
ctggggagcggtcccaaacccagataggtatttgtaggtatttgctgattccactagagcaaatattcttttttttttttttttttttt

SEQ ID NO: 27734 - DNA, 71 bp, Homo sapiens
  misc_feature 17: w=a or t
  misc_feature 37: w=a or t
aaaaaataatacccagwtcttcaaggttggcaaagawgagaaaagctccttgggaacttagttaccaggtc

SEQ ID NO: 27735 - DNA, 87 bp, Homo sapiens
  misc_feature 8: k=g or t
  misc_feature 44: w=a or t
  misc_feature 46: y=c or t
cacaatckatttttctgaacatctgtatgcttttcgtatttaawtyattgtttaaagaatttttgcggtttctcttgtgtttagagt

SEQ ID NO: 27736 - DNA, 123 bp, Homo sapiens
  misc_feature 9: r=a or g
  misc_feature 36: r=a or g
  misc_feature 70: v=a or c or g
  misc_feature 117: m=a or c
acattttaragtcagattctaatgttattatttaaratatataatgatgacaggaaataacataagtaavattaagcacacccactatatgagattttagtcttcttttcccaccamaggggt

SEQ ID NO: 27737 - DNA, 101 bp, Homo sapiens
  misc_feature 35: w=a or t
  misc_feature 53: h=a or c or t
  misc_feature 57: w=a or t
  misc_feature 59: w=a or t
  misc_feature 76: w=a or t
  misc_feature 83: m=a or c
  misc_feature 84: h=a or c or t
aacaatttgaaaaagtttttaagcaagttgaagawccttgacaaacaagcaahgcgwgwactgattaactgaattwgaaagamhaaaaacctgaaatggta

SEQ ID NO: 27738 - DNA, 110 bp, Homo sapiens
agggagcggtggccagggccgaggcgtcgcagcagctaggacggttcttctgccactgctgctccctggacaccgtcccgcgcctatcggattatatctgcccaagatgt

SEQ ID NO: 27739 - DNA, 92 bp, Homo sapiens
  misc_feature 18: w=a or t
  misc_feature 19: k=g or t
aaatattgaagttttagwkgaataacccatggatcatggtcccacagtgggtgggaagtagttgattcattgacaggtagtagccttgtaga

SEQ ID NO: 27740 - DNA, 138 bp, Homo sapiens
  misc_feature 5: w=a or t
  misc_feature 65: w=a or t
  misc_feature 66: y=c or t
gccgwgtagttgggattacaggcgtgcgccaccacgcccagctaattttgtatttttagtggagwygcggtttcaccatgttggccaggctggtcttgaactcctgacctcaggtgatccgcccacctcggcctccac

SEQ ID NO: 27741 - DNA, 395 bp, Homo sapiens
  misc_feature 327: k=g or t
atggcaacccaggggataggcgctgtggctctccgggatatgcgggggtgacttcagggagaagaaaaggctccccggaaaagccacagggaggaaggaccctcccatgcacacggtgggtatgctgggaggaccagctcccgctccaccctgctccccctgggaggaaggctgacccctgcgtgggagtgtgactgctggaaaggcatccttgctgcagctgtgagtgtgatgggacagcagagtcactcctgcatgggattctagggctgggggtcccagaggggtggcctccgcccctcctgggggccgaggactgtcaccatktcactacggcactctccagctgctgaccaaagccctcgctaaccgcagccctgccatactctgggtct

SEQ ID NO: 27742 - DNA, 59 bp, Homo sapiens
tcatcatctcgtcatcgttattattctgattaatgactttcctaatttctttaactttt

SEQ ID NO: 27743 - DNA, 94 bp, Homo sapiens
actgacttcaagaatgaagccgtggaccctcacgtggtcccaaagataaccaattgtttagagcctagaggaaagggaagaacccacatctacc

SEQ ID NO: 27744 - DNA, 173 bp, Homo sapiens
ataaaaaccatgtaattccatctgtttaaatatattaaatgcaaacagtaatgtatattgttcgagaacatgaatatatatttaagagtataaaacatacatggtaatcatgcacatcattattatgataatggttatccagaggtgtggtttgagctatgtctatactgtat

SEQ ID NO: 27745 - DNA, 195 bp, Homo sapiens
  misc_feature 109: r=a or g
  misc_feature 141: w=a or t
  misc_feature 157: m=a or c
  misc_feature 158: m=a or c
  misc_feature 163: m=a or c
  misc_feature 171: r=a or g
ccacttacccatttataatggtgatggcctttgaggaagctgatgtggtgtcctgagctgcatttcaggtttgcaggtgaggttaggcttggagcttctccacagcagrttatacacatgcgaccagcctagcccatagcwatgctcccaacaagcmmtcagmgacctcarccaccaagcatacatttctgcgta

SEQ ID NO: 27746 - DNA, 109 bp, Homo sapiens
agaagctcccctactgagcatcttgtgacccccgcccctgccccccagagaacaaccccctttgactgtaattttccattaccttcccaaatcctataaaacggcccca

SEQ ID NO: 27747 - DNA, 220 bp, Homo sapiens
  misc_feature 47: r=a or g
tgttgttgttgttttttaagcttggttaaaagctactgtttaactgrggagagctaagcaggtacttctttatatagtgacagttttccttcctggctattgtagagctgaaaagagggggaaagggtgagagtaaaccttttcagaaccggaaaaccacaagccatcttcttgacaaactctcctgtcatttcctttattcatttgattttttagatcc

SEQ ID NO: 27748 - DNA, 201 bp, Homo sapiens
ggcatttgtaaaccataatggtgctggtgaacgtgtcttttagcatgctaatgcattataattagtgtaatgaggagtgaggactaccagaagtcactttcatcacatcttgattttggtaaaataactgctctggaaaagaaggcaagaaagtaaaacaaggcaatttcaccacagccatcatcaggaactcaggggcgc

SEQ ID NO: 27749 - DNA, 272 bp, Homo sapiens
  misc_feature 46: r=a or g
  misc_feature 47: r=a or g
  misc_feature 169: w=a or t
  misc_feature 244: m=a or c
  misc_feature 245: m=a or c
cccaaattcttctcatcttggaaaactgaaactctatacgtattarrcttcccattcccccagcccctgacaatcaccattctaccttctagctctgtgaatgtcacaagtacatcattatgtgggatcatacagtatttttttgtgactggcttattatacttagcawgatctacgttgtagcaggtgtcagaatttcgttcctttgaaaggctgaataatattccactgggtttagatacammacgttttgttgacccattcacccatca

SEQ ID NO: 27750 - DNA, 180 bp, Homo sapiens
  misc_feature 48: b=c or g or t
  misc_feature 49: h=a or c or t
  misc_feature 50: y=c or t
  misc_feature 98: m=a or c
  misc_feature 113: w=a or t
  misc_feature 124: m=a or c
  misc_feature 125: w=a or t
  misc_feature 144: m=a or c
ttctgttccattgttctacatgcctaattttataccagtaccgtgctbhyttggtaactataggcttgtagtataatttgattgggtaatgtgatgcmtccagatttgttctwtttgcttagtmwttgctttggctatgagggmtcttttttggttcatatggattttgggattgtggct

SEQ ID NO: 27751 - DNA, 235 bp, Homo sapiens
cattgtgaattggctaaaaataaaaacacggcatttcataatttctggatgcaactaaagcattgcctcaatggaaatttgtagccatagatgcttacactaggaaaggagacttgtttcaattcatgagctatgttctgtctcaaaagaagaaatcaaagccaaagtaactagaaaggagaagaaaataaagatcagaaattaatcaattttacaacaatggagaaaacccagt

SEQ ID NO: 27752 - DNA, 172 bp, Homo sapiens
gttgtttcttctacatttattttttagtgacttttcatatgagtttgaactcatgaatatttattttattctttgggttataatccaatactatcttaatttactttgttgctcaaattcttctagttttggccattgaaagttttttttcagattggttcttccgccctac

SEQ ID NO: 27753 - DNA, 343 bp, Homo sapiens
  misc_feature 254: w=a or t
ttttttttgctgttttataggatttcagatgggaaggagggtagatatgcatgtttagacaacaatctcaatccaattgctttcttttagtttctgtgtaattaaaaaattctattctgtttcttccaaatcatatggaaaggagaaaataactttatagcctgtcttgaaatatttgaatgacagaaaagtattgggtcagggaggaaggaaggagctaatgttcattgagagtctactactcatcaagctgwgtctttagtttggtgacaactgagttccagatggaaaattttgtttaatatggataaagtaatgagataaattacacacccacacccac

SEQ ID NO: 27754 - DNA, 139 bp, Homo sapiens
tatgttcatatttctccacttgtcccagtaatgtcttttatagctattttttctaagtccaggattgatctagggtcacacatggcatttagttatagtgtcattttaaaatcatttaatctaggggagtttctagccc

SEQ ID NO: 27755 - DNA, 166 bp, Homo sapiens
acgtaggagttggtgaggtaggggtcggtggtgttctgccccgagaactcctcgtaccaacaggggctcttactgtttggaaggaatttgttggggatgactgaaaacatctgcaaggaaacagaggaggagagacacagaggaggggaaaatgagcaaagacacc

SEQ ID NO: 27756 - DNA, 146 bp, Homo sapiens
aaaatctctgtgctgaagaaaatggagcaataccaacaaaaattgggagtttggaactggaaagtaaacaggaaatactgctaaaatacccagccagactatgagaatggagttagtactaccagcattttataacagcccttccc

SEQ ID NO: 27757 - DNA, 309 bp, Homo sapiens
  misc_feature 234: h=a or c or t
gaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggthgattcgagggaagtggtgaaaaattttttttctcccattttcctccctgcatctggggacacagctgccgtgacc

SEQ ID NO: 27758 - DNA, 283 bp, Homo sapiens
  misc_feature 188: m=a or c
  misc_feature 215: w=a or t
tatggcaaaatgttaacaatagttgaatgagtcagtcagattaaaggttacatgagagtttgtataataaaattcttacaagttttctgtagcccttacattttttgaattaagaatttttttttaaattatactttaagttctagggtacatgtgcacaacgtgcaggtttgttacatatgtatacmtgtgccatgttggtgcgctgcacccawcaactcatcatttacattaggtatatctcctaatgctttctctcccctcttcccccaaccccacacct

SEQ ID NO: 27759 - DNA, 112 bp, Homo sapiens
cattctggaattacagcttcctagtgtgtctgaggaaatccaatctctcccactccagcccgcctactcattgaacatggctgctatctctgtcttctggaaacacggctat

SEQ ID NO: 27760 - DNA, 272 bp, Homo sapiens
ctaggccagtcagagagtaaatagtaatttcattaactgcagatagataatatggtatgagaagcagatgtcagggaaaggagagaattaatttagtttgggatatccaaaaggatatctcatggaactgtctcctgacctctagtttattctgaatcataggacagagaagacatttaaaagcatatctttttagtatgctgtgtaagtttgaacagatttatctttcttcttttatttaacttaatattgaaatctgtttatatcttttt

SEQ ID NO: 27761 - DNA, 394 bp, Homo sapiens
acacacacccctgattccagaaacacaacaggagctgactcaaaagggagtgtctggtgcaggcatgcagggaggaagaatgactctgagcttgaccattcaacttcgaaactttaacatcaatggatcagcacacactggtgtacggtctgctatgcatgcagccctgtgctaggcaaaagaagtatcagaccaggaactgacagcctcactgcaacaggaagagaggcttcacacaataagcgtttcattcaaccaggctggacctgtgcttattgagttgaacatcactgagcacaaaatgcaagccagacaccataagagctgtaaggatgataaagatgtctttctaccctcgagagctctaagtgtggtcaggagagaaacacatggc

SEQ ID NO: 27762 - DNA, 314 bp, Homo sapiens
  misc_feature 67: h=a or c or t
  misc_feature 165: m=a or c
  misc_feature 166: m=a or c
  misc_feature 205: s=g or c
gcttccgttgctagggacgcttcggccgcaggataccgcaatggatcaggaagaggggctgaaggchttggacaatattgtcactcaattcaacgcctatgaagatttcctggactcgcagatcactactgtggacttgtactacctggaggatgaaaccctggmmcgccagttggtggagctaggctaccgagggactggagasagagtgaaaagggaagattttgaagcaaggaaagcggctataagagattgcaagactggctgaaagagctcagcaaaagacgctaacaagtgctggtaaagacctacaa

SEQ ID NO: 27763 - DNA, 284 bp, Homo sapiens
agtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacagagccatacatgtgaaatctgatttttatgtgtgttattcgtttgtctggttttactacctttgcaaaaacaaaataccccttgt

SEQ ID NO: 27764 - DNA, 395 bp, Homo sapiens
  misc_feature 276: b=c or g or t
  misc_feature 277: k=g or t
  misc_feature 331: y=c or t
  misc_feature 336: w=a or t
  misc_feature 337: y=c or t
  misc_feature 370: m=a or c
  misc_feature 382: w=a or t
  misc_feature 383: m=a or c
  misc_feature 395: m=a or c
aaccctctcaggtacctttctaggttgtggtggctttgttcttttgctctttgcaataaatcttaatgttgctcgctctttgggtctgtgccgcctttatgagctgtaaccctcacaatgaaggtctacagcttcactcctgaagccagcgagaccatgaacccacggggagggtcgaacaactctggatgggaggaatgaataactgtggacaccacctttatgaactgtaacattcccctggaaggtctgcagtttcagtcctgaggccagcgbkaccaggaactcaccggaaggaacgaacaactccagatgtgccacctttaagagytgtawyactcaccgttaaggcctgcagcttcactcctgmaagtcagcgagwmcatgagccccam

SEQ ID NO: 27765 - DNA, 352 bp, Homo sapiens
  misc_feature 155: n=a, g, c or t
  misc_feature 248: m=a or c
  misc_feature 249: n=a, g, c or t
ttttgtgtgcttagtggccatttgtatatggccatgttctacttctttggagaaatgtctgttcaagtccttggcccatttttaaaatcatgttgttttttctttgttgttgttgtagtttaggaaacttttaaattaaagtttaacaagactgnccttatgagtttccttgtcttgagcatgtttgtggagtgacttatcaaatcacttgggctggcagcttagggacttttcaggtctaatccaamntccaacattccttcacagtgtaatcatagaatcttagaattaaatgagccttacagagccaccagtccagttctctcattttgcagataaagaaactgcaccc

SEQ ID NO: 27766 - DNA, 202 bp, Homo sapiens
gtaaaagactggatttcagaaatggaagagagaaaagagaccaggagaactaggattgctgcctcctgagagtcagttagtgaccaagagtactcattaggcctctagatatcagggatattcttggcagtgagagcagagagaacaaagctaaaggtgctgaagtaaggtgacagcgctttaaagaagaagaaaaaaaaaa

SEQ ID NO: 27767 - DNA, 224 bp, Homo sapiens
tactatgacaaaggaaactgcaggtgtgtggaatagatcaggaagaagtgatatggaaagtgaaacttgaagagtaggaattagttgggagaagagggcacagaggtatgttattgagaaaacaaatatgtatgaaggcccagaacaggggaaaagtttaatatgactttttgagcaggagagtggagtgtgggatagaggtaaaaattgagatttcaggagta

SEQ ID NO: 27768 - DNA, 445 bp, Homo sapiens
  misc_feature 273: b=c or g or t
  misc_feature 274: b=c or g or t
  misc_feature 275: y=c or t
  misc_feature 348: n=a, g, c or t
  misc_feature 349: n=a, g, c or t
  misc_feature 350: k=g or t
  misc_feature 370: w=a or t
  misc_feature 371: r=a or g
aacgctcgccggggtcgcccgaggcctgagccaagggggacgctgtgggcgcggctcaggccaggccctcagtgctctggctattgctgaaaacaccttctagttccaccttgtaactggactcccaaaagatgaatgctgacatcttctgatgcttaacaagaaataaaaatagtcaccttaatcatcaaaaagttccggtggtgaggagacctttccaaatataagaggaataaagaagtcacctccccagctgtcatcatcttccagcabbycgagcaagaatattttgagcactacaggaaagacagtccatcaaacccgagatgatgatcagccacgtgaaannkttcaagaagaggaatagggwraatgaatctcatcagaaaagcaagcaatatgaatgctggcccatcttggaataaagtgcaacattcaaagaatt

SEQ ID NO: 27769 - DNA, 434 bp, Homo sapiens
  misc_feature 126: b=c or g or t
  misc_feature 127: w=a or t
  misc_feature 128: b=c or g or t
  misc_feature 129: k=g or t
  misc_feature 206: m=a or c
  misc_feature 306: s=g or c
  misc_feature 334: b=c or g or t
  misc_feature 335: k=g or t
aaagaggcatataacgtttttttttggtcttatttccaagttttagttaatttttctttcctgttttcttgagacatggtcttggtctgtcgcccaggttgaagtgcagtggcacagactctgctbwbkgcaaccttcacctcccgggcttaagcagtcctcccacctcagcctgccgagtggctgggcctacaggtgcgtgccamcatgccccctgctaaagtttgtattttttgtggagatggagtctcgctatgttgcccaggctggtctcgaactcctgaacttgagcgatctggccacctsggcctctcaaagtgctgggattacaggbktgtgccaccacacctggccaataattttctttaacaaaataaatcacaattgagttcaagaactaaaagatgactagatcatctgaggtggaaaagagt

SEQ ID NO: 27770 - DNA, 127 bp, Homo sapiens
tctaatttagctttattttgtaattcattttggtaaattattatttgcctccttttctagatttttcttttctagcatttgaattataatctcagaggatgtccttgatagtggaagtatggggttc

SEQ ID NO: 27771 - DNA, 459 bp, Homo sapiens
  misc_feature 118: b=c or g or t
  misc_feature 329: r=a or g
  misc_feature 343: r=a or g
  misc_feature 368: m=a or c
  misc_feature 387: h=a or c or t
gtaaattaaatagtatattaggtgataggtggagaaaaaagagaaagataagtgggggttgagaaatggagataaggttacagttttaaatagggtgatggaggccacactgaaaagbtgacatttgaacaaagacttggaagaggactgctctaggcaaagcagtggaaatgggagtgttcttgtatctcctgtgaagccaccagaactaggtaatattacttgaaaaatcttgccaaatctggtaatctataaaataccttgttgtaatttagaattttttgcccatttttaatattagattgttgatctttttcttgatcttaagractctttattaagratgtatcctagccaggtctggtgamtcgggcctgtgatcccaahgtgttggaattacaggcgtgggccactgtgcctggccctcctttgctttttacttttttttgagacggggcc

SEQ ID NO: 27772 - DNA, 204 bp, Homo sapiens
gcgcgggcaggaagaccgggtgggagccccacccagccccagccccaggaggaggagcctgtctggatggacgcagcctgaactgacccacaaacagaccaaaaaagtcactctcaaagagctctcggcacacagaccccagctttacaaggaccccagctccttaacacagatcccagctccgaggaaactcgtccccccctt

SEQ ID NO: 27773 - DNA, 173 bp, Homo sapiens
  misc_feature 86: m=a or c
  misc_feature 90: m=a or c
aacgttttccttcttgttttgtgtgcatggtgcttgtgtgagaaagtggacacacagtaagtgcggcttccagatgcgtccgccamctgmcctccgtgccacgcgcttccccctacctaggggagcctccaccagacagggaacccacgccttgccacccttctctctccctc

SEQ ID NO: 27774 - DNA, 84 bp, Homo sapiens
atttttaatgttgaatacagcaaacattttattagtcgagaatctgcattgtaatcagctcatacattctcatgatgactgaca

SEQ ID NO: 27775 - DNA, 138 bp, Homo sapiens
gccgagtagttgggattacaggcgtgcgccaccacgcccagctaattttgtatttttagtggagacgcggtttcaccatgttggccaggctggtcttgaactcctgacctcaggtgatccgcccacctcggcctccac

SEQ ID NO: 27776 - DNA, 138 bp, Homo sapiens
  misc_feature 84: y=c or t
  misc_feature 85: y=c or t
  misc_feature 94: y=c or t
  misc_feature 95: m=a or c
agttctgcttttcagctgtagggtgtgtctcttttgaaactgttttttttaattcaagaaaaagcttggaaattttgtattttyygaaagaatymtttgctatgcgtattaaaatagacgagcaaaacaccaaggact

SEQ ID NO: 27777 - DNA, 118 bp, Homo sapiens
atctttgttgatgtgtcagctccgcaggggtttggggaaacggccgctgagtgaggcgtcggctgtgtttctcaccgcggtcttttcctcccactcttggctggttggaccccgctat

SEQ ID NO: 27778 - DNA, 218 bp, Homo sapiens
atctttcagtataaagtttaaggctcaaagttcagaaacattgtttcactcaccagcatctattttttgcttttgtttttgtttttttttgaaacagagtctcactctgtcacccaggctggagtgcaatggcgtgatcttggctcactgcaaactctgctcctgggttcaagcaattctcctgcctcagcctcccaagtacaggattaccagcgcca

SEQ ID NO: 27779 - DNA, 286 bp, Homo sapiens
atgggtgccttttataacggtagaatttttttttgacggagtctcgctgtgtcaccaggctggagtgcagtggagcgatcttggctcactccgcctcccagcaggggcggggtttcaccatgttagccaggatggtgtccatctcttgacctcgtgatccgcctgcctgcgcctcccaaagagctgggattacaggcctgagccaccgcgcccggccgtacagtttgtattctaacaccaactcataaggtgcttcatgaagagagaagagccaaaggagcctgta

SEQ ID NO: 27780 - DNA, 216 bp, Homo sapiens
attctctcaccactcagggtacctctccagtttctccctgtgttcctccttctgtgctgccatgtcctcctccctcctcatttgccttctcttctgactagatgttcatctttctggaggcatctgccagtctctggggtctcttagtcctcaggagtaaagacagaaagcatcatgttcctgcaaagagaaaaataaggaaaaaatctgcaaaac

SEQ ID NO: 27781 - DNA, 70 bp, Homo sapiens
  misc_feature 8: d=a or g or t
  misc_feature 9: s=g or c
  misc_feature 10: b=c or g or t
  misc_feature 50: y=c or t
atcctgadsbctccccttcaatcctctaccttcccaaagcattgcttccytttacaaccttaggcttttc

SEQ ID NO: 27782 - DNA, 292 bp, Homo sapiens
  misc_feature 228: d=a or g or t
  misc_feature 229: n=a, g, c or t
  misc_feature 230: n=a, g, c or t
  misc_feature 231: b=c or g or t
  misc_feature 270: v=a or c or g
cagggtccatttatattgtagcatttatcacaacttgattcctttttgtggctgaataatattctattatatggatataacacattttgtttatccattcatctgttcatagacttgtgggtgttttctccttttggttatcttaaataacgctgctgtgcatatttgtgtacaagtacctgtttcagtccctgttttcaattctttgggggtatacacctaggaatdnnbattgctgggtcatattctatatttatcgttttgaggcavtgatttcttaagtatgacccca

SEQ ID NO: 27783 - DNA, 353 bp, Homo sapiens
  misc_feature 300: n=a, g, c or t
agtggaacattgaaataaaggaagtgttccttagttcccgtgtgaaagcagaggaacccatgacatccaagggcgtgaaaggatcagagctgactggacatagtgagctgccttcttgcgttcgggtgcacccctgttaaacctgatctgtgtcataagtgactccggatgcatcagtgtccaccagttggaagcaatgacaaggatggctggctggtgtttttcagccttccggtttatagactgtatttatctagtggattcctgcaggccccatactgagcctggactgaaagtatncactcggaccatctgttatctctctacactgaaaataaaacctcttccaccca

SEQ ID NO: 27784 - DNA, 87 bp, Homo sapiens
tagggaataaaagcaggctgcctgagccagcagtggcaacccacttgggtcccttttcacactggcgaggctttgttctttcactct

SEQ ID NO: 27785 - DNA, 131 bp, Homo sapiens
acagcgcaaaatcagaccatttgggacagtcttaggagtgcgttccgggctcggacgccataccaggccactttgactccccggaaacactttgactccacggaagtaccttttttttttttttttttttt

SEQ ID NO: 27786 - DNA, 197 bp, Homo sapiens
aacatatccacaagtagagcatgaaccagcagaccccatgaacccatcatctgtgttcctgagttggataatttcaaacatatccacaagtagagtatgaaccagcagaccccatgaacccatcatccatcctcggcagatacccactcacagccagtcctgtttcatctatacactacccctcactccctgctata

SEQ ID NO: 27787 - DNA, 107 bp, Homo sapiens
  misc_feature 1: w=a or t
  misc_feature 89: r=a or g
  misc_feature 91: s=g or c
wggggaggggggcagccgggagaggggcttcaaatcccaagctctacagggcctctctggggctcccagagcaccttctacactgggarasgtttccacacggggca

SEQ ID NO: 27788 - DNA, 177 bp, Homo sapiens
ctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagcc

SEQ ID NO: 27789 - DNA, 93 bp, Homo sapiens
aaagaagattgcttgagcttgagtctgagcccacagtgagctatgaccgcaccactgcaccccagtctgggtgacagcacaagaccccgacaa

SEQ ID NO: 27790 - DNA, 96 bp, Homo sapiens
  misc_feature 44: r=a or g
atgggaagacacagagggaagatggccatggaaaagctagagaragagagttctcagaagaagtaactctgccaacaccttgaatctcagattttc

SEQ ID NO: 27791 - DNA, 227 bp, Homo sapiens
tgtgaatagtgccgcaataaacatacatgtgcatgtgtctttatagcagcatgatttatagtcctttgggtatatacccagtaataggatggctgggtgaaatggtatttctagttctagatccctgaggaatcgccacactgacttccacaatggttgaactagtttacagtcccaccaacagtgtaaaagtgttcctatttctccacccctctccacaccccttt

SEQ ID NO: 27792 - DNA, 317 bp, Homo sapiens
acaacagtatttccctctagcagctcctgggactgggttttctggcatttctatctcccccaaatatctgtaacaggcggtgttcatatctctaaatcagagttctggctgctgaggtagcaggactgagaccggggctggaccctgactgagacccaggagccagcagcctctagccactccagtcacaggcacagcccagggacccaccgccacgccctcctgcaagataaaaggaagcagcaactcagacatcaggacacacccaccaaaacacaaggagaggccctgaaaagtaacctggaaagtcacagacc

SEQ ID NO: 27793 - DNA, 92 bp, Homo sapiens
tagtacaacagcgatggctgaactgttggagtcgatggaaggtgcttgccggagaacacgtgcctttttttttttttttttttttttttttt

SEQ ID NO: 27794 - DNA, 204 bp, Homo sapiens
ataaggagaggctggtcaattctcagagacagcaacgggcccagccaggagtatgcctgtgacatgcaaactaaccaatccagagtcacaactcctctatctggccccaacaccctaaaaggcaatagccctctgccttaatcatgccagggccaggttctaggtaaactagggaccaactcctatagcttggagccactgaaa

SEQ ID NO: 27795 - DNA, 238 bp, Homo sapiens
  misc_feature 138: b=c or g or t
  misc_feature 139: r=a or g
atctcatgcccagaggcaatgaaaagttgaaagtttgactcacatacatgcatctggtcaacaggttgtattgtgccatatacctgggaccaaattacaagcacaatgatgaatcttttacctggagtcaagacatgbrcaggatgatggaacttatcactggacctttccacagtgttattgtgacatatgcctttgcccaacatgtggtgatttgactccccagactgggtccact

SEQ ID NO: 27796 - DNA, 222 bp, Homo sapiens
tcttgaaaaaacaaaagcgactacattttccacccatgcaactggcaaacaagatgcactgtgacaacaagcatatggggaaacaggccactcctacactgctggcagaagggtaaattgacacaacccatggtgggaagtttaacagtattacaaatgtgcatacacttgatccagcatttccactttaaggaatttatcctgcagatatgttcaccacct

SEQ ID NO: 27797 - DNA, 61 bp, Homo sapiens
agccgaggtgctacactccagcctgggtgacagaacgagactgtctaaaaaaaaaaaaaaa

SEQ ID NO: 27798 - DNA, 222 bp, Homo sapiens
  misc_feature 189: m=a or c
aatcaatccagaagaagccaagtgatctagttcttgggaagctttcattttttaacactcaagttacagtcagccttgcatctgaaagaatggacagaaacacacacatgacaagacaaacacaagaggcaaagcaagatagtcaaatggaagcctccactgtccaccccaccccacagaaacaccaamttgaaaaactatccatacaaaaaagcaccaagc

SEQ ID NO: 27799 - DNA, 214 bp, Homo sapiens
  misc_feature 7: m=a or c
aaatggmagggcagcgcgtggagggaactcaaggcctgattggttcttcctaagcaggacacgatctcgttggcagggcaaccggcctttagttggtggccttcagtgggtggcttaagttggtggcatttggttgcctttcctggggagaggcggcaggtgctcagctctgcagacgtgggggcaagagaaggcccaagctgcctcgagaaga

SEQ ID NO: 27800 - DNA, 333 bp, Homo sapiens
  misc_feature 163: r=a or g
  misc_feature 205: n=a, g, c or t
  misc_feature 282: w=a or t
  misc_feature 295: m=a or c
  misc_feature 308: v=a or c or g
  misc_feature 318: m=a or c
agaattatcgtcttcaactgacaggataatcattaagagtaatctttagttcaccatttactgctggaagtgttgagaaaaactgggacttctttttcattcttctgactgttggctgaacaaagagtaatcaagaattatgtgaacaccatgaatataacaraactatcactgctgtgcaaatacattccagaaacctgactcngactggctgagccactggagctgtgtgagatcttgaccggacatttggcttcattctggactaattcttggtactgwttgactaccctamaatatcaggagavaacaggtatmagcaaccgaatagta

SEQ ID NO: 27801 - DNA, 225 bp, Homo sapiens
  misc_feature 212: k=g or t
  misc_feature 213: v=a or c or g
  misc_feature 221: r=a or g
  misc_feature 222: m=a or c
agagtgggctggtaggaaatactgggagctggaggtttgacatcctagcttttgtcagcaggagtgtgtggccaagctccttcagcttttggagcctcgggtagtttacccacttaaaggcaggtgatagcagcaagcccactgagtgaatgagagcttcagctggtgtgcagagaagggtggcatgtcacagcactgttagtctgggtackvgcactacrmaca

SEQ ID NO: 27802 - DNA, 160 bp, Homo sapiens
aaaggtccatgtaagtgcagctgcccaggactccccttgctatccagacataggctctcctacctgcttccaacttcagttctgtggcatttccaggaaatatgggtagttaacacataaccatgctcaatgagagccaacctgtggctgtgcggccctt

SEQ ID NO: 27803 - DNA, 241 bp, Homo sapiens
atttttcataaggaaggggtttcaccatgttagccaggctggtcttgaactcctgacctcaggtgatccacccacctcagcctcccaaagttctgggattataggcatgagctaccgtgcccggccctatgaattttgacaaatgtaaacatccacatccatgttgccatcatctgaatcaaaatatgggacagttctattatcctagaaagtttcaggcacactccgccccccgccccca

SEQ ID NO: 27804 - DNA, 188 bp, Homo sapiens
  misc_feature 175: s=g or c
  misc_feature 176: y=c or t
aaaaataaaaaaatgggtgactccagaaggccagaggacttggggacatttgaggtgcatgtgtaaggcaacatcaaaaagaaaaagcccctgtgacattttcattaatccacatggttgggatgtgagctacaaaagaggctcctcacagcttgagggcaggctcgggaaaacsytagaagcggcta

SEQ ID NO: 27805 - DNA, 179 bp, Homo sapiens
cattctttaattacaatttaagttttgttcaggaggtcactgataaacacattatctttttttcccttccaagaatcgtttgggattttagcatgtttgttaagatgtactctgccgaatgcgtctgatagtgcaaatttatttattttttgtgtggtacaatgtcattgtgtgtaggc

SEQ ID NO: 27806 - DNA, 283 bp, Homo sapiens
  misc_feature 196: m=a or c
  misc_feature 197: k=g or t
  misc_feature 198: v=a or c or g
accaccacagcccctagccacttcttatcagcacaggattcgactccaaacgacctgtgccacccccatcatgtgtctctaaagaccccagactcagtcagtagaggggagatggcctgactttggggaggagacagcctgacttcagggaagaaatggcctgacttcgggacaaagacctcctgacttcaggggmkvacaacgagcggcccttcccatcccctctccaactcccctctccgctgagagctgttttcatcactcaataaaattctctgccccc

SEQ ID NO: 27807 - DNA, 130 bp, Homo sapiens
cttattttttattccagatattgatgaattgaatgtaattcaaatagctaccttccttgctaccagccgctcatacattgcttcttccctgctactttctgtcctttttctctacatttttttttttttt

SEQ ID NO: 27808 - DNA, 145 bp, Homo sapiens
cgttccgctacactcccttgtacctactccttgccctctgcctcagggttatagaacagctgccttcagctattctcccccagggctctgcagaaccttctgaccttttagaaggcctgcatctttccctatagtttctcccacc

SEQ ID NO: 27809 - DNA, 421 bp, Homo sapiens
  misc_feature 15: w=a or t
ttcttgtcaccttgwaagggaaagcccacctgagcacgacatccacactgagggaaggacacagagtcagagagttgggagagagtccaggtgacattattaagcacccacgtgcagccaaggtacagttaccccagaacattctcactgggatccaggtggctgtgaaggtcacctagagaggtcagcagagctcctccagcctctggagttgacagctgtgaagtcgatataataagggccccgaatcacccaacctcaatcagctccttccagtgactgccatcgtgggcactctacactgagtcatgtagcatgccagctggggcagctacttcactacatcctagagccccaccaaaagcaggaggaaagaggcctgaggcaagttccggcaaatactatctgccctacagtacca

SEQ ID NO: 27810 - DNA, 168 bp, Homo sapiens
agggactcttaccctcaaagaccttgcaggctagtggggacggcagacctgctgagagattgcgcctgttctcagcccattggaaggcaccaagatgactgtgaataatctgcaccctcgagtcactgaggaggacattgttgagcttttctgtgtgtgtggggccct

SEQ ID NO: 27811 - DNA, 240 bp, Homo sapiens
caaatgaagaaattaaggcacaagacagttaagtaatttgcctaagattatacagttgctgggcgcggtggctcgcgcctgtaatcccagcactttgggaggccaaggcgggtggatcacctgaggttgggagttcaggaccagcctgaccaatatggagaaaccccatctctgctaagaatacaaaattagctgggcgtggtagtgcatgcctgtaatcccagctactcgggaggcaga

SEQ ID NO: 27812 - DNA, 370 bp, Homo sapiens
  misc_feature 209: w=a or t
tcacaaaggtttttttcagttctcttttacgaatagccatgcatcacttaatggaggggatacattctgagaaatgtgtccttaggtgatttctttgctgtgtaaacaccacagagtgttcttacacaaaccaagatggtttgcctactatatacttaggctatatggtatggcctgttgttctgaggctacaaacctgtgtagcatgwtactgtactgaatattttaggcaattgtaacacaatggtaagtttttgtgtatctaaacatagaaaaggtacaaaaaaatatgatataaaaggtaaaggaaatactatacaggttacttaccatgaatggagcttgcaagactggaagttgctgtaggcat

SEQ ID NO: 27813 - DNA, 154 bp, Homo sapiens
  misc_feature 6: w=a or t
  misc_feature 19: w=a or t
  misc_feature 28: y=c or t
  misc_feature 29: m=a or c
  misc_feature 52: s=g or c
  misc_feature 84: w=a or t
  misc_feature 107: m=a or c
aaatawaagaatcttatgwataaagtaymtaaccacctcaaaatacatatgsaactacatgacattacctgggactctagggawgtgaatgtttgagatttctgtgmaatggtaaaagatgcctttcaactttgtaaaacaatgatttgtttct

SEQ ID NO: 27814 - DNA, 144 bp, Homo sapiens
  misc_feature 28: s=g or c
  misc_feature 34: m=a or c
  misc_feature 35: k=g or t
  misc_feature 88: w=a or t
  misc_feature 111: m=a or c
  misc_feature 121: m=a or c
  misc_feature 126: w=a or t
agtcagtcctgggttgtacccggcgcastgggamkcggctgcttcctccggggtcgtatctccgcccggcatggggctgctggacctwtgcgaggaagtgttcggcaccgmgaacctttamcgggwgctgggcgtgcgacgcga

SEQ ID NO: 27815 - DNA, 200 bp, Homo sapiens
  misc_feature 48: w=a or t
  misc_feature 75: m=a or c
  misc_feature 133: m=a or c
  misc_feature 145: m=a or c
  misc_feature 151: m=a or c
  misc_feature 168: s=g or c
  misc_feature 178: m=a or c
  misc_feature 179: m=a or c
  misc_feature 182: w=a or t
  misc_feature 195: w=a or t
gtcggcgcctggcagttcaggtgaacaacagtaacttctcagagctgwtctccactcctgacttctcccagcctmgagaattgataacacactcttctggatcccagcagtgtccagaagaagaccaaaggamcagaacagagamtagctmtcggtgagattggacasattttgggammgawcatgacgagccawcaacc

SEQ ID NO: 27816 - DNA, 210 bp, Homo sapiens
cccttaagactcaagtcttgatactttgtctgctctctggctctttctttgtcattactattatttttatcttcttgatgttgactcttgctaaaattttttgtcttccttattgttaatgcttatagaaaatgattccttgttatcttttagcccatgtcatccgaatcatttgctgtttctagcctaggtgctttgactatgccaacc

SEQ ID NO: 27817 - DNA, 242 bp, Homo sapiens
gggtactcattttatgacataattgcatagtacatagcggttcccagagaaagtccttctttattagcctaaggatcagctggcagagaaaggagaagcagctggacactggagactacagttgggtgtcagagagaagtggcttgacttcagagggacagcttgacagcatagcttcagagaggagtctggccaggaagattattttccctctctgtccccttttcagcttcccctcccac

SEQ ID NO: 27818 - DNA, 530 bp, Homo sapiens
  misc_feature 492: m=a or c
aatcagtggtgtggttaagaaggctgtgagaagaaccgatgtgacctgcattagtatattgtatcaggaaaatgcaaaatctagaatgagaaaggttgcatcactggctttcaggtataggctgggtcactagtcttaaaacatttcttcttgagaatgtctaaaagactgtggaatctgttagatcttatatacttttaagttggcacctgaaacttttcatcctagatttacatagttggtctcacgtgtgaaacatggctacagattggctgggaagtattgtgtccatcaattgtggagatagcttgggtgtctatcagggaagagtgtcagctgtggatcaggtcagccagaccatttctctcacccggcctttccataatggagtgaagtgtcttgttccagaaagtcaccttcagggcaggtgacattacggagttaaaaaattctggagataccaggacctggagacaaccaacattttggagmcttcatcaaacagaatttaggcccctctggtgctggct

SEQ ID NO: 27819 - DNA, 209 bp, Homo sapiens
atttccttcctgatagaagccacatttgctgctttgcagggagagttggccctatgcatgggcaaacagctggactttccaaggaaggttcagactagctgtgttcagcattcaagaaggaagatcctccctcttgcacaattagagtgtccccatcggtctccagtgcggcatcccttccttgccttctacctctgttccaccccctt

SEQ ID NO: 27820 - DNA, 315 bp, Homo sapiens
  misc_feature 270: m=a or c
  misc_feature 312: n=a, g, c or t
aactgtccgctgctctctggtctctggatatgaggcaggagggcttggggacaactgtggggacatggcccagatgatctgatcctggcagtagtgactgttggggaccagccattacagcagcagatcatcagactccaccaagagcttgggagacagaagtctctgtgggctgatgttcatggaaaactccggagtcatatagatgctttgagggagcagaacatggagctccgagaaaagctgaagagctctgcagctgccagcggmtggaaagccaggaagaaatctgcagcgtccccacacgcgggncct

SEQ ID NO: 27821 - DNA, 194 bp, Homo sapiens
  misc_feature 168: s=g or c
  misc_feature 169: n=a, g, c or t
attttttggtggagacggggtttcgctgtgttggccgggctggtctccagctcctaaccgcgagtgatccgccagcctcggcctccagaggtgccgggattgcagacggtgtctggttcactcagtgctcaatggtgcccaggctggagtgcagtggcgtgatctcgsntcgctacaacctccacctcccggcc

SEQ ID NO: 27822 - DNA, 148 bp, Homo sapiens
  misc_feature 88: k=g or t
  misc_feature 89: r=a or g
  misc_feature 90: s=g or c
  misc_feature 105: n=a, g, c or t
  misc_feature 106: r=a or g
  misc_feature 110: w=a or t
caagaagagattacaatcctaactatatatgcacccaatacaggagcatctggattcataaagcaagtccttagagacttacaaagakrsttagacccccacganrtaawaatgggagactttaacaccccactgtcaacattagaca

SEQ ID NO: 27823 - DNA, 90 bp, Homo sapiens
gactttctcacccgctctctccaagtcccccctcagaatcgccccacccacttccaacccctccccatgtcagggaaaaaaaactccaaa

SEQ ID NO: 27824 - DNA, 55 bp, Homo sapiens
gtggttaccaaggcgacgcaacgccgcccggccagcttttcagtttcatagaggt

SEQ ID NO: 27825 - DNA, 133 bp, Homo sapiens
  misc_feature 122: k=g or t
agtctcaggctgtttgttcccccgcggggcaatgcgactgcgcgtcgcttcctgattggccgagagttgcgggctgcgtgcgcaggcgcctacctctgttacttagggcgggagcggtcgakggcgccggtgc

SEQ ID NO: 27826 - DNA, 81 bp, Homo sapiens
  misc_feature 15: k=g or t
  misc_feature 29: k=g or t
  misc_feature 40: k=g or t
tatgttactgatttkcattagcttaattktcttgaacttkctgacgtggttttaatgttagtcaaggtgcagttctgctta

SEQ ID NO: 27827 - DNA, 106 bp, Homo sapiens
  misc_feature 16: k=g or t
  misc_feature 22: h=a or c or t
  misc_feature 64: w=a or t
  misc_feature 99: r=a or g
acacatgcgagggtakaactghgtgttcagggttttctctgaaagcctgaagggattgtgtacwtttacattgaacttgactgcagttagaaccattarcctagat

SEQ ID NO: 27828 - DNA, 147 bp, Homo sapiens
  misc_feature 144: w=a or t
ttggaaaatgttatttactcatttagaaggccaccgtaacgactgggcacttgaggcacaaaagtagtagcaaataggggagatacttaaaaagtgtcagctgtccaggacttattgccacttctctgacaaaacacaggtgawcac

SEQ ID NO: 27829 - DNA, 63 bp, Homo sapiens
tccatcttgaagcgttcttttgggagtgggtattttctaatacagtttcaaaagccagcatca

SEQ ID NO: 27830 - DNA, 140 bp, Homo sapiens
  misc_feature 94: k=g or t
  misc_feature 113: s=g or c
  misc_feature 124: m=a or c
gtccccgccggcagtgcgtgtggtgaggcaggacatggcggaggcaggaaaagtgcccttgagcctcgggcttaccggaggagaagcggcagaktggcctctgcagcggtacsccgctgcatamcctcaaacaccagaga

SEQ ID NO: 27831 - DNA, 72 bp, Homo sapiens
  misc_feature 37: w=a or t
  misc_feature 49: k=g or t
  misc_feature 50: y=c or t
  misc_feature 66: y=c or t
tacatttttaaagctgtaatgcttccaggagcaagawagccagcagcakyactgaaacctagtgaytgggaa

SEQ ID NO: 27832 - DNA, 101 bp, Homo sapiens
attttgatattaaaaatgatatttttatagtatccctagtgtctggtacatactagacactcagatatattaaatgaataaatggataatacactaagcca

SEQ ID NO: 27833 - DNA, 150 bp, Homo sapiens
  misc_feature 82: r=a or g
  misc_feature 83: d=a or g or t
tgggaggccgaggtgggtggatcacctgaggtcaggagttcaagaccagcctggccaacacggtgagactccgtctctactrdaaacacaaaaattagttggttgtggtggcaggtgcctgtaatcctagctactcagcagactgaggca

SEQ ID NO: 27834 - DNA, 171 bp, Homo sapiens
  misc_feature 72: w=a or t
  misc_feature 125: h=a or c or t
  misc_feature 126: w=a or t
ttaaaatcttgatttccagctaagtaaggctgatagtaagcattgatttacatcttttttaatgatataagwaattacataaatataaaatatggctataaaattcttcatctataaagtgaaghwatgtagactaggtgatattttaaaagctgcattcagttctcaaaa

SEQ ID NO: 27835 - DNA, 341 bp, Homo sapiens
  misc_feature 154: n=a, g, c or t
tattcaacaggctaggcagaaatgtctcagatggaagaacattttcctgaaagtgttacatgagaaatgttacagtggatgctgagttatggtctgaatttatttttatcttagtttagaatatgttttctctaaagtaggcaaaaactataantttgcttccataagcagtgtggtaattaattctcatactatgaacatttcaggttgaaaccacactcagagtttcagaaatggagggatcttagaaatcatcttgttcaaattctgtattcttcacatttaagatatcgcaggtgccttctttttttcttccttgagacagagttttgctcttgtta

SEQ ID NO: 27836 - DNA, 79 bp, Homo sapiens
agaggtgaggctagtgggagtgggactgggactgggagccagcaggcatctggatttccgggtgtagttggagtgggac

SEQ ID NO: 27837 - DNA, 292 bp, Homo sapiens
  misc_feature 179: r=a or g
  misc_feature 185: w=a or t
aaagtagatgagaacaaaagctacaaaaagtaggagagcaaactaaagtgacacaaagtaattgagagtcctcacgttaaaaaaaataaagtggtctgccaaggccttctatcagatctaaagccaaatgtataaatgaatttacttaaacagtgtaaataaaccctgatttatcaggraatgawcattctgttgttcaaaaaagcagaacgacatttaatacattgagaaaagaataaagattacaataaagtatgaaaataggtatagtttagagaaacaaaccctccgt

SEQ ID NO: 27838 - DNA, 148 bp, Homo sapiens
  misc_feature 138: k=g or t
tagctagccttggttaaatctcagttgtaaagagaaaatatgaagtgtacttttactcatgtgctattgaacagctatagaacaagcaaaacagaaaaggcagacaacttagcttccagttaaatcctttcccagtckatacatggat

SEQ ID NO: 27839 - DNA, 293 bp, Homo sapiens
  misc_feature 187: m=a or c
  misc_feature 190: y=c or t
  misc_feature 201: m=a or c
  misc_feature 203: r=a or g
aatccaacctctgtcctcttaggagaaggaacctgtccttggttcagatggctgggcatgaggaggaaaatttccattagtgtagaaaagtgctggacagaatccggtttggaaaattacaaatccagttggtcaaaataggccatttcctatgtgtgacctattcgtggtatgccaactggactgmttyctaaacaggamgraggaaagtgaggaatatttttatatgaaagccttagcctgtctggcacccatgaaaaaaactatttatgcactcctactttcaccgtcaa

SEQ ID NO: 27840 - DNA, 55 bp, Homo sapiens
ctgttcctgtgttagtttggcccctgaatctacaatgtgggcagagctcagcaaa

SEQ ID NO: 27841 - DNA, 62 bp, Homo sapiens
  misc_feature 14: d=a or g or t
  misc_feature 18: r=a or g
tttcttggtatatdctarctatatgtttgatatattcatgacacattatgtctcatgattat

SEQ ID NO: 27842 - DNA, 233 bp, Homo sapiens
  misc_feature 3: y=c or t
  misc_feature 37: k=g or t
  misc_feature 106: y=c or t
  misc_feature 107: k=g or t
  misc_feature 178: k=g or t
  misc_feature 189: b=c or g or t
  misc_feature 194: b=c or g or t
  misc_feature 196: w=a or t
  misc_feature 220: k=g or t
ttygtctatttttgcttttgttgcctatagttttgakgtcttacccaagcaatctttgtgcagaccaatatcctgaaggatttctccaatgttttcttctagtggyktcatagtttcagaccttacatttaagtctttaatccatctttatttgatttttgtatatggtgaaagatakgggtctagttbcattbcwtgtgccattagagatgttcagttkttccaagcaccat

SEQ ID NO: 27843 - DNA, 116 bp, Homo sapiens
aagcagttgaggaatgtatagtatttgagaaataagcacatccacacatgaacacttttcttgctcccagattcttgttgaaaggtgtaacagttggatttatgattatatacttt

SEQ ID NO: 27844 - DNA, 98 bp, Homo sapiens
tgtgtaattctgttagtttcagatttctctcctgtttttgcaaattgtgggaaagattgacaatgcaaatgtgtcaaagacatactgttgggtgctta

SEQ ID NO: 27845 - DNA, 265 bp, Homo sapiens
  misc_feature 159: m=a or c
  misc_feature 161: h=a or c or t
  misc_feature 177: s=g or c
  misc_feature 182: k=g or t
  misc_feature 183: k=g or t
  misc_feature 203: y=c or t
  misc_feature 206: w=a or t
  misc_feature 227: s=g or c
  misc_feature 236: k=g or t
  misc_feature 253: y=c or t
atcacagttttttgtcccatcaactgcaaccactcaccattagcgtaccctgagcactccccactgccgctactcgggacactctgggccttagaggatccgtgtcccgtcaaccgcgagtcccttgctcgccccctgctgcggggactcggcagcgtmahctgccggaaacacccsgaatkkttcatcccgcgcgcagtttytgwgatgctgggtgaaggcgaccscgcagatakggtctgtgacagacgcytaaagcgccgaa

SEQ ID NO: 27846 - DNA, 197 bp, Homo sapiens
  misc_feature 137: m=a or c
  misc_feature 151: r=a or g
  misc_feature 167: r=a or g
  misc_feature 180: d=a or g or t
catcaacatgccttggctgttattgtataggcccttgccctgtggctctcaagagtcctggataatgtacaaaggacatagcttagtctggcttgcagaattgtagtattctattgactcctcagtacctccactgmatcatgggcacaarcaatgctctctaccarggcctggcaacadagtccgatctggcccta

SEQ ID NO: 27847 - DNA, 141 bp, Homo sapiens
  misc_feature 15: y=c or t
  misc_feature 16: w=a or t
  misc_feature 49: k=g or t
  misc_feature 50: k=g or t
  misc_feature 52: r=a or g
  misc_feature 105: k=g or t
  misc_feature 123: m=a or c
  misc_feature 129: w=a or t
agagagatcccttgywagttccaccatgtgaggatacagggagaaaatkktrgtctatgaaccaggaagcaagtcttcaccagaacccagctgtgctagcaccckgaactcaggctttcagcmtccagwactatcctcaga

SEQ ID NO: 27848 - DNA, 156 bp, Homo sapiens
gtctggcagcgggtttccgtcctcgccgtatgcctcttcctctggcctgcggggtggccggggacagaaggtgtggtcagtgcaagttcctccccagctcggcgaggatccaaatcacgtaatgatcgggtatcagaaaaagacgtcagcatccct

SEQ ID NO: 27849 - DNA, 195 bp, Homo sapiens
  misc_feature 179: s=g or c
  misc_feature 180: y=c or t
  misc_feature 181: y=c or t
  misc_feature 191: w=a or t
  misc_feature 193: r=a or g
  misc_feature 194: m=a or c
acattactcatgttgaggaactaataggtattgtctaaagagatagaaattacaaaggtaaccattagaacaaagctataaaccttcctagatattgaaagaactacaaaccagttaaaaataaaacatcatttagtgaaaaaaaattcttatataaccacatacataaccaggcaggsyytaagacccawgrmc

SEQ ID NO: 27850 - DNA, 159 bp, Homo sapiens
  misc_feature 101: m=a or c
  misc_feature 102: r=a or g
attactagggtgtccaggacattgtgtgactcaggaaacagctcagacgtgaggcttgcagcaggccgaggaggaagaagaggggcagtgggagcagaggmrgtggctcctgccccagtgagagctctgagggtccctgcctgaagagggacagggacc

SEQ ID NO: 27851 - DNA, 176 bp, Homo sapiens
caggtatatttgctcacttccatgatatcacagatgacatttaacccgaatatgacatcactgcgtaatatagatcatcattcttctcatcttccaataatattttccccattacctaccacctggctctgaggccagtagctcatattttatgtctttttgaagtcatcacccct

SEQ ID NO: 27852 - DNA, 313 bp, Homo sapiens
  misc_feature 186: r=a or g
  misc_feature 195: w=a or t
  misc_feature 198: w=a or t
  misc_feature 204: y=c or t
  misc_feature 205: m=a or c
taaacctttagttatttggcaagtagtatgagggcttctagctgtctttgaaaaacttaagatttgtaagacaaggaagagcagagaatataaatagtaaagggcctggcaacaatgtgtctttgtttttaggtaacgttggttggcagtcagcaaaaaggccaggctcaggcagtcttaacttgraaaccgctwacwggaatymcccaaaactatgtatacaactcctgctgtgggttttttaaatatcaaagattaccgattttaatggtagggtaatatagactgaaatccccacattcctccaccctca

SEQ ID NO: 27853 - DNA, 170 bp, Homo sapiens
  misc_feature 90: n=a, g, c or t
agtggctcgtgcctgtaatcccagcactttgggaggctgaggcgggcggatcacttgagtccaggaggtcgagaccagcctggtcaacanggtgaaaccatgtctctattaaaaaatagaaaaattagctggatgtggtggcaagcacctgtaatcccagctacttggga

SEQ ID NO: 27854 - DNA, 259 bp, Homo sapiens
  misc_feature 182: b=c or g or t
  misc_feature 183: v=a or c or g
  misc_feature 187: m=a or c
  misc_feature 188: s=g or c
  misc_feature 201: k=g or t
tacatatattcctaggtacatcatatatttggatgccattataaatatcttttttggaaatgtcatttctggtatgtgggaatataattcagttttttcataacattggaagccagttgtcttacagaatgtctcacattatttatctgattgcttcctcctggtatcgtctgacgtgttcbvgtamsataaagttggaakttagtctagcagtacagttttctttctgacagctttactgaagtatttacacagctac

SEQ ID NO: 27855 - DNA, 106 bp, Homo sapiens
  misc_feature 94: m=a or c
agtgggagctgccgggagttggagcctgcggagttcgagaccatgctgctgttctgccccggctgcgggaacgggctgatcgtggaggagggamaacgctgccacc

SEQ ID NO: 27856 - DNA, 99 bp, Homo sapiens
  misc_feature 39: y=c or t
  misc_feature 42: w=a or t
  misc_feature 81: m=a or c
ctttgcaggagaatgtgcttgttcttaacatgtacatgyatwtgctggtcaagtgaagtgatgtctgcaagttaatttcamatgattaaaaaaggaaga

SEQ ID NO: 27857 - DNA, 102 bp, Homo sapiens
  misc_feature 17: d=a or g or t
  misc_feature 48: w=a or t
  misc_feature 78: w=a or t
catacaatgaatcaaadagatcagaatctcttatggacatacatcatwaaaagttaaagagtaaggctgctgaagacwaaaataagcctcaagagagaatac

SEQ ID NO: 27858 - DNA, 153 bp, Homo sapiens
  misc_feature 102: m=a or c
  misc_feature 134: k=g or t
cctagatttctcacaccctgctctttgactccagtcctccacattggaatttttggatggcctgcagccagatgtaggcactggggagtcaggagtgtaacmtttagctcacctatctagagaccaatttattkcacattcctgcattctcca

SEQ ID NO: 27859 - DNA, 105 bp, Homo sapiens
  misc_feature 16: r=a or g
  misc_feature 17: r=a or g
  misc_feature 53: m=a or c
  misc_feature 58: w=a or t
  misc_feature 59: m=a or c
  misc_feature 85: n=a, g, c or t
  misc_feature 86: h=a or c or t
tttataagtatctgcrratattatgtaaatttttagtcacacataaagtagcmatttwmtttttcacttgggttgaatttacttnhaagtatatgagtcatatac

SEQ ID NO: 27860 - DNA, 144 bp, Homo sapiens
  misc_feature 92: y=c or t
  misc_feature 94: w=a or t
  misc_feature 102: s=g or c
  misc_feature 106: w=a or t
  misc_feature 115: v=a or c or g
  misc_feature 130: r=a or g
tagttttaattgacgtaaacatgtaaggtgctcttcattcatgtaacaaaaaagcaaggtaggtatataataccagtataactctattttcyawtccttagsctawgtgcttccvaagctgtatgtgaarctacattactgtgt

SEQ ID NO: 27861 - DNA, 118 bp, Homo sapiens
  misc_feature 83: v=a or c or g
tacttaacctttctttgcctattttctgacctactaaatagggataaaactagtttggtctagggttttggaaattaaatgavatgattgatcccaagatgtgtaatttttatcagga

SEQ ID NO: 27862 - DNA, 166 bp, Homo sapiens
attcatacaagagagaaatgctacaaatctgaagaatgtggcaaaacctttaaccactgctcagacctcaatgtacctgagaaaattcatacctgagaaaaatcctacaaatgtaaaaaatgtggcaaagcctttaatacctgctcatgtcttactcaggaccaat

SEQ ID NO: 27863 - DNA, 129 bp, Homo sapiens
tgggtagcagagttttgcctaatgcattgtcgctaaaagggatgaagggcatcgggatctacaggagatggaaaaagtagtgacaggatagtagtgggaaaaactaggatcggatcaaggcactggaaa

SEQ ID NO: 27864 - DNA, 163 bp, Homo sapiens
  misc_feature 133: b=c or g or t
taagataaccactggatctcttccttatgaaggtatgtcaggaagtaatccattcattggtgctttggcaccatgggtactatctcatcccccaaaacttttcacctaatagttttagcatctattgatgatbcttgtgctattataatggcagtcgcaaaat

SEQ ID NO: 27865 - DNA, 60 bp, Homo sapiens
  misc_feature 10: m=a or c
  misc_feature 48: m=a or c
agactcgagmagtctctggaacacgctgcggggctcccgggcctgagmcaggtctgttct

SEQ ID NO: 27866 - DNA, 251 bp, Homo sapiens
  misc_feature 190: r=a or g
  misc_feature 194: k=g or t
  misc_feature 197: y=c or t
  misc_feature 198: w=a or t
  misc_feature 204: w=a or t
caatttattaagagctatgtgtggatgtttgctatctggcaattcagatctcctgaccaaacccatgttcattcactgagtgaggtatagtgtgggttacagagaaaatcggtcatagtgttatttgtttatgtcctatctacaaaagttgcaatgatggaatttggaacccttctgtggataaaatagratckgcywataatwattagcattttgtctctgaacctacagagaggagaccacatgaacaa

SEQ ID NO: 27867 - DNA, 125 bp, Homo sapiens
cttcctcagtcacccaggctggagtacagtggcataatcatggctcactgcagcttagaactcttgggctcaagcagtcctcccatctcagcctcccaaagcactggaattacaagcgtgagcca

SEQ ID NO: 27868 - DNA, 380 bp, Homo sapiens
  misc_feature 186: y=c or t
tcagagccattggtgtgcagattccaatcctttaaaaagtaaacacatgccttttgataaagcggaattgaggtgatcagaaattctgttgagaacccagctatttgtgtgagtatattttagctatcccaaaaactttttctgacctttctctttctgggataggatatgtgtgcttagagtatyattccgaaagggtactaatagttaatctgttaattagttacatcaggtttcaaatactaggtcagtgatatgagagcgagagagagagatttgaattgtcaaatgtattgtcagatgcattcacaagagcaggactgctttatctgttttgttcactactgtacccctagcatctaaatgaatacctagcccat

SEQ ID NO: 27869 - DNA, 149 bp, Homo sapiens
  misc_feature 149: k=g or t
taactttttgttttactatgaaagtgtcaaaaagcagccaaaaatacggcacagaatattaagacacactgcaattatttgtaccagtcggtctttaaatgtacgggccactgtctgcagaagtaattctcttgaaaatgaagaaggck

SEQ ID NO: 27870 - DNA, 107 bp, Homo sapiens
  misc_feature 16: y=c or t
  misc_feature 17: s=g or c
  misc_feature 71: k=g or t
  misc_feature 90: m=a or c
  misc_feature 91: m=a or c
cacacaggagagaaaystttcaaatgtgatgagtgcggaaaggccttcagtcagagtacgagcctctgcakccaccagagagtccacacmmaggagagaaaccatct

SEQ ID NO: 27871 - DNA, 122 bp, Homo sapiens
aatataacattgctcatcaggctcagagcagcactgctggagaggcctgcccttgcagatgaggcagctgagtcctggaaagagaggccttcttgggaatcacagccgatgcaggggcctga

SEQ ID NO: 27872 - DNA, 263 bp, Homo sapiens
  misc_feature 182: k=g or t
tagaattcacttcaactagttggttttttacttttattttattattattatttttagatgaagtctcgatctgtcgtccaggctggagtgcagcctctgcctcctgggttcaagtgattctactgcctcagctactcaggaggctgaggcacgagaatcgattgaactcaggaggcagaggktgcagtgggcagagatctcgccactgcactccagcctggatgacacagtgaaattctgtccactcccaccctcccgtccac

SEQ ID NO: 27873 - DNA, 149 bp, Homo sapiens
tctcggtcgcctcacttctcccctttgcctgtgtacttctgaaagtactttttatccttggtcttcttcctctctcagtatcttatctactctgccaaatgcaaattccaccctctgcagataactctgaagcttccatcctttccccc

SEQ ID NO: 27874 - DNA, 89 bp, Homo sapiens
attttttttttttcttcttcgtcagcctcccttccaccgccatattgggccactaaaaaaagggggctcgtcttttcggggtgtttttc

SEQ ID NO: 27875 - DNA, 239 bp, Homo sapiens
  misc_feature 149: n=a, g, c or t
  misc_feature 182: h=a or c or t
  misc_feature 183: w=a or t
  misc_feature 188: y=c or t
  misc_feature 191: w=a or t
  misc_feature 193: k=g or t
  misc_feature 199: m=a or c
  misc_feature 200: m=a or c
  misc_feature 204: w=a or t
tgactaaaaacctaaataaactgattaggttttaggcgttctttcaaagaggttcttgagaagattgagaactatcctatttggtgcttagtgaaaagattttgaattactgtacgtaccagttgttgccatttctttattaaattcgnaagtttttttgccaaataacaatttttcaatchwcttcygtwtkgtagammtctwactgggtgatgaataatcctctaagaaaccctcga

SEQ ID NO: 27876 - DNA, 166 bp, Homo sapiens
  misc_feature 111: h=a or c or t
catgaggcatttacttggtactagacatttagatgattgtttctcggaataacttggttgactaacatctttctgcttcctgtcgtcatgatcacttctgcaaaggacgahgcctagtacattttctggtagaatcttatataccataagatttagttgaaacatt

SEQ ID NO: 27877 - DNA, 163 bp, Homo sapiens
aatattacttattacaatgaggctatatctgtggtctcatataatgcttaataattggtatgtattagagtctcctagaatgcctgttaaagataagattcagaccatacccacaaatctaatttatttttgaatttgtctgtactcttatatggcagttgtc

SEQ ID NO: 27878 - DNA, 143 bp, Homo sapiens
  misc_feature 15: s=g or c
  misc_feature 16: r=a or g
  misc_feature 128: w=a or t
ccttttgaaaaattsracctcaatgcagctgagttaagagataaaagcactggcctacacctggggccacaggatctctgagcagctaaggggtcaggtgggatggaggcaagagaggttatggtggwgaatttgggtgcacc

SEQ ID NO: 27879 - DNA, 110 bp, Homo sapiens
  misc_feature 14: w=a or t
  misc_feature 15: r=a or g
  misc_feature 19: w=a or t
  misc_feature 64: r=a or g
  misc_feature 76: k=g or t
ctatactaatttgwractwaacattttttaaaatttttaattgtgataaaatacatgtagcaaracttactatctkaaacatttttaagggtactgctcagtagtgtaaa

SEQ ID NO: 27880 - DNA, 159 bp, Homo sapiens
  misc_feature 78: w=a or t
  misc_feature 79: m=a or c
  misc_feature 94: m=a or c
  misc_feature 135: b=c or g or t
  misc_feature 136: n=a, g, c or t
  misc_feature 154: k=g or t
taaaaaatgttttcaagatttttatttttgctgctctactaggcaaaagagtagtcttctgttttgtagctgtctagwmtgagctgtgaaaggmtttgggttagggctttgagaagatcagaggaacatgtttgbngcctcctgcagctttgtkggcat

SEQ ID NO: 27881 - DNA, 160 bp, Homo sapiens
  misc_feature 15: k=g or t
  misc_feature 16: r=a or g
  misc_feature 44: m=a or c
  misc_feature 141: y=c or t
tgagataatcacatkrtttttgtgtttaattctgtttgtgtggmgaatcacatttattgatttgcgtatgttgaaccctatatatatgttttttgactggcttatttcattcagaatgtcctcacatttcatccgtgttgyagcatatgtcagaatttcc

SEQ ID NO: 27882 - DNA, 196 bp, Homo sapiens
  misc_feature 129: k=g or t
  misc_feature 130: w=a or t
  misc_feature 131: k=g or t
  misc_feature 132: n=a, g, c or t
  misc_feature 176: k=g or t
ctcctttcacagtgtgaaaggtttgttgttttggtcttcacaataaaccttggtaccgccaactctttggtccctgccatctaaaagcgctgtgacactcaccgcgaaggtcccggctttattcctgakwknacgaacccaccggcaggaaccaactccagactactatgtgctakagagaacttcttcaggcctt

SEQ ID NO: 27883 - DNA, 165 bp, Homo sapiens
  misc_feature 58: w=a or t
aaaaaatctgccgggcgcggtggctcacgcctgtaatcctaacactttgggaggctgwggcgggcagatcacctgaggtcaggggttcaagaccaacctgaccaacacagcgaaatctcatctgctgaaaatacaaaaattagctgggcgtggtggcttgcccct

SEQ ID NO: 27884 - DNA, 284 bp, Homo sapiens
  misc_feature 113: b=c or g or t
  misc_feature 114: m=a or c
ttccagatttcgatgtttcttaagtctaggtgaatttatatatatatttttttgcttttcattttctaaagttagttattatttccattgaagcttgttttctttttttcttbmcattttagctactgcagtgcttttgtttcacacttgatttgtaaaaattttatatatatgtatttaaaatgtgccattttattgctaagtgaagtatgtcctgttttctgctataattctttctcggtcagattgcaatgtcagcagttactgccacactcctgtcagct

SEQ ID NO: 27885 - DNA, 326 bp, Homo sapiens
  misc_feature 125: r=a or g
  misc_feature 126: w=a or t
  misc_feature 152: w=a or t
  misc_feature 153: w=a or t
  misc_feature 260: w=a or t
  misc_feature 282: r=a or g
  misc_feature 283: m=a or c
  misc_feature 296: y=c or t
aagaggggtatatacgtatatatcatcgcacggtgtgtcccggaaggcttgatatgctagtcccgcgggacaaggcgagccgaggagtttgtgtggaagtttgcatctgagagtgcgagagctgrwcggagtgttacagagccgcgatgccwwctcgttttgttttgttttgtttttgatacagtgtctcgctcttccgcccagtctcgagtgcagtggtgagaacacggcttactgcagcctcaaaatcctggacccawaagatcctcccacctcagcctrmcctcccaggtagytgggactacaggcgcacaaacaccatcgct

SEQ ID NO: 27886 - DNA, 212 bp, Homo sapiens
  misc_feature 182: k=g or t
acacctcccaaataaactacttacattcacatctttgtctcagggtctactcttaagaaaacataaacttagatgctgacaaaggcaaaaaagttataaaacctccgcctattttggctcataattaagtcccttccaatacctgtgccctaagcaattggtctttctaagctcgccacttktatatatatttttaaaaattcacaagcctc

SEQ ID NO: 27887 - DNA, 173 bp, Homo sapiens
  misc_feature 85: k=g or t
  misc_feature 101: w=a or t
  misc_feature 126: k=g or t
  misc_feature 130: r=a or g
tcttccttaaaaaggaaatacagtgatttgagctagatgaatccagctacattttacttttttttttgagaccgagtctcattckgttgcccagggtggawtgcagtggtgcaatctcggcttackgcartctccacctcctggggtcaagtgattcttgtgcctcccaggta

SEQ ID NO: 27888 - DNA, 211 bp, Homo sapiens
cattgtttattttttaaaaaattatatgcagttgtacaagatactacattccattgaaatgttggctatgtcctaaccaggcaaccagataacaaaaacattttgagtcttttatctaggtagttctaattattcagctacttagtttaacaaaggaaaatatcctgacttctctcatttcatttgtagacttttcattgtataggcacac

SEQ ID NO: 27889 - DNA, 78 bp, Homo sapiens
tggtacccatttccttttcttaccctgatctccccagaagcctcttgtggtggtggctgtgcccctatgccctgtggc

SEQ ID NO: 27890 - DNA, 288 bp, Homo sapiens
  misc_feature 181: k=g or t
  misc_feature 182: s=g or c
  misc_feature 209: w=a or t
ctataaatacaaaaattagctgggtgtggtggcacatgcctttaatcctagctacttgggaggctgaggtgggagaatcgcttgagcccaagagttcgagaccagcttgggcaacatagtgagaactcgtctctacaaaataaaacaaaatttgatgggcatggtggcacatgcctgtagksccagctactcaggatgctgaggcaggwggatcatttgagcccaggagacagtggctgtggtgagctgagatgtgcctggcaacagagcaagaccctgtctcaaaca

SEQ ID NO: 27891 - DNA, 244 bp, Homo sapiens
  misc_feature 90: k=g or t
  misc_feature 143: y=c or t
  misc_feature 144: b=c or g or t
  misc_feature 145: r=a or g
  misc_feature 148: w=a or t
  misc_feature 184: n=a, g, c or t
  misc_feature 200: k=g or t
aggaatcggtctcccgcaggctggcgagacacagtgagaacgaggaaactccagacggcctccgggcaggccccttaccagcctggggcktcttcctcgataatggaactgagaatcagtccctacctgcccggcaagaagaybrgawaaacctccaactaccttggaggaaatcaataggatnacgaggttaatgccakagcaggctgagtgacagttaccaaataaatgatcttgggtggac

SEQ ID NO: 27892 - DNA, 234 bp, Homo sapiens
  misc_feature 86: s=g or c
  misc_feature 196: r=a or g
  misc_feature 201: v=a or c or g
  misc_feature 212: r=a or g
  misc_feature 230: k=g or t
  misc_feature 231: r=a or g
agagtgacccgcccaagatcacacagcttcagatggaggcccgtaggctacagagcccagctccctgccgctgcgtggagaagaasctttcccagctgtggccagagagagatgtgacaccaagggaaaggatcagagagtggctgaagacagagggaggggccaagagtcaaggaacataagtgacttcgggaaratggvaaatgcaggaracagaatctcccctagakrccc

SEQ ID NO: 27893 - DNA, 76 bp, Homo sapiens
  misc_feature 16: k=g or t
  misc_feature 45: m=a or c
agcaggcggagaagckggccaatcagggggcgcggcttcgccttmaccgtcggctccctgctcctgtcagaacctc

SEQ ID NO: 27894 - DNA, 215 bp, Homo sapiens
  misc_feature 89: r=a or g
agaggagagtagcccaattcagggtcctgtaagaaaactgaaccggatccccgccggagaagaaaatccagttcgggggttcctgtttraggggagaggtcaggtctctgggtccccgagtgaagaaacaagctaggtcgacattcttgtctgatggagacacggtgaacccggagcccgtggagttacctcataccctcactcaccgaggaaaa

SEQ ID NO: 27895 - DNA, 58 bp, Homo sapiens
  misc_feature 15: m=a or c
  misc_feature 16: r=a or g
  misc_feature 17: r=a or g
  misc_feature 20: k=g or t
  misc_feature 31: w=a or t
  misc_feature 40: k=g or t
aaggtcgtgaaaaamrrggkcttggtgaggwgccgccatktcatctgtcctcattctc

SEQ ID NO: 27896 - DNA, 167 bp, Homo sapiens
  misc_feature 121: m=a or c
cctctcccacctggatctccagctccacgagtctcacagaacagccacactggctccttcattgtcttcagctccacaacctaagacatcagtgggagcactggctcctccctggacctcmagctcaacgactctcatagacttaaaaggcagcacctgctcctccc

SEQ ID NO: 27897 - DNA, 102 bp, Homo sapiens
  misc_feature 11: m=a or c
ctatatcttgmaccttgtgatttgcccgcctcggcctcccaaagtgctgggattaccggtgtgagccactgcgcccagccttattctttttttttttttttt

SEQ ID NO: 27898 - DNA, 57 bp, Homo sapiens
tctttcggccacggagccgcgcagatccggttcccgggtgaccactctgtcgccatt

SEQ ID NO: 27899 - DNA, 114 bp, Homo sapiens
  misc_feature 16: w=a or t
  misc_feature 30: w=a or t
  misc_feature 50: r=a or g
  misc_feature 90: k=g or t
  misc_feature 91: h=a or c or t
agacttcatcacagcwggagccgtgaggawgaagctctgggatcaattaraatgccaggcttttccaggctggtttccagcgcatctgtkhatgattccacataaatttaggga

SEQ ID NO: 27900 - DNA, 414 bp, Homo sapiens
  misc_feature 209: d=a or g or t
  misc_feature 268: k=g or t
  misc_feature 269: m=a or c
  misc_feature 392: d=a or g or t
ccttctagactctgaatattgtgttttcattgtagcacacttagtatcactctttgtgtttatgtgctgcagaaggcagggcttccagccgtctgtagctgtgtgtatatgtctgtgtatgcatatagccataagaatgtgtattcttgtgtatacacatcagtacatgtgtactcatgggtatatgtgtgtgcattcttacacacacdttaaaaagtgacagccatctcaagaaagacatttaattttccctgaaataaccttagckmtctttgctctgattctggatatactaagtaaacattggctttgtaaaagccgatttgtggcatctttggggccaggtttccagtagtgcctcaaatcttgccttgatgaggtggaacgtggcdtgtaagagcccctcgttcacgt

SEQ ID NO: 27901 - DNA, 309 bp, Homo sapiens
ttttctttagctgcatttacatcaaaataaacacttggatctacttgtgttatattcttgtactgtggcactaaaatgaaagaggaatggttattttcttgaggaacttatgtactttatatgtttatgtgtctgtctcttttttaaatgtcagtaaaatagtattatgatagagacaagatcagagcagtactattaatccagtttatttacatctttccaaaattatgtactgctgtcacttctgggtttcacttgatgttacacttctcttaagaatgccgtctggcaactccctgcacttccccc

SEQ ID NO: 27902 - DNA, 346 bp, Homo sapiens
ctcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctccccac

SEQ ID NO: 27903 - DNA, 320 bp, Homo sapiens
  misc_feature 268: n=a, g, c or t
  misc_feature 269: n=a, g, c or t
agacatgaaaaaacaagaaagacagtttgcagagaggagagaatgaaacaggactgtagagagaagcagagacaagaaatggatcttcccatctcgtcatgagcttccacttccagaccctgtactcagtggatcagctggcaccacgcagatggataaactggctcatctggtcttctggccccacccaggaactgattcagcacaagaggacagcttcaccttcctatgatttcatctgtgaccccaccaatcagcacaccccacnntccaacccactactcaccaaattgtccttaaaaaaccctgatccctgagta

SEQ ID NO: 27904 - DNA, 170 bp, Homo sapiens
  misc_feature 32: r=a or g
  misc_feature 33: m=a or c
acttctctggagtcttccctgaatgctctagrmaggtataaatgagaaaattgttcctctcttcccctctttattcctctcactgtgcctccaaagtactttgtccatacctcggtgatagtacttattctactgtgattttattgtagctttgtgattgtctgccccct

SEQ ID NO: 27905 - DNA, 90 bp, Homo sapiens
  misc_feature 49: m=a or c
  misc_feature 50: m=a or c
acagtgcgcgtagtcccgcaccctcgctttctccctctgctcctccgtmmgctcccgtcggacggggacattgcaatgaggcgggatcgc

SEQ ID NO: 27906 - DNA, 85 bp, Homo sapiens; identical to SEQ ID NO: 27148

SEQ ID NO: 27907 - DNA, 380 bp, Homo sapiens
  misc_feature 298: s=g or c
catgtaacttgtactttgctttgcagcaccttaggatgaagagggactgactgaggttattgctgggtcctgatggtctttagcatctgtagccttggactccattcctttggctaattttgaccatcagtctttcagactttgattttattggcatcctgaccaggaattgatttgtcttatttatttatttagttgtgtggttttctttgttattgttgttgtttttagagacagtgtctttctgtgttgcccaggctggactcaaactcttggcctcagatgatcctcccatctsagcctcctgagtagctgggactacacctataccactgtacccagcttaacatataaatttaatttgcttccttcctaccacc

SEQ ID NO: 27908 - DNA, 402 bp, Homo sapiens
tttccttgcccagctttctatgcctgccctgctgtggtgcctacagcatttgctctccaagcttctatctgatgggccgtcacttatctatattatttcttaggcaaagcatcacctagttgaaattaagtttaagaaaagcatagaggtgacaaaagctccagtgttcatgaggttaaaatgataagtcttcaaatatcatgagttaggcccactcatgtatacattaagttttgcatatatgcttgagaggttcaaatctttgctataattagggctattgaaatattgccctagatactgaggttataaaaggaagcctcctgcaaaatacagcaagtcttttagtcctaggcagctgcagggagaaggttgggaacatatatgcatgaaaaggccgca

SEQ ID NO: 27909 - DNA, 182 bp, Homo sapiens
ctcagaggcctatgtaagcgttcctgccagaaggagccatcgtcagaggctccagttgcatgactgcttggagtttgatgtcctgaaggcaagaacagacaaacagagttattagaaaacatttatccaaatgaaacaagtggaggggtttgaaactgaaagaagtgaagaaaaggaaaagt

SEQ ID NO: 27910 - DNA, 367 bp, Homo sapiens
  misc_feature 53: b=c or g or t
  misc_feature 217: w=a or t
  misc_feature 276: w=a or t
  misc_feature 279: m=a or c
  misc_feature 302: r=a or g
  misc_feature 308: w=a or t
  misc_feature 316: y=c or t
  misc_feature 335: w=a or t
  misc_feature 366: m=a or c
acagcccctcgaggcgacagggccccgccgaccagagcagtggtacaggcatbgatggggaagaaatgcagcgtatggatgttcctacctcttgtatttactttgtttacttcagctggattgtggatagtatacttcatagctgtggaagatgacaaaattttaccaattaaattcagctgaaaggaaacctggtgtgaaagcatgcaccatatawaagcattgcaggtgatgatccttcctgcaagctgtgtgtttagttcaagttatgaacawggmagccttcctagcccttgtggtargctgtwctgcgctycatacaaactgaaaccgawgttttaaacccgtggctgaatattagtggamt

SEQ ID NO: 27911 - DNA, 489 bp, Homo sapiens
atttttgagatggagtctctctctgttgcccaggccggagtgcaatggcacgatcttggttcactgcagcttccacctcccaggttcaagcgattctcctgcttcagcttcccgagtagctgggattacaggcgcccaccaccacgcctggctaatttttgtatttttagtagagacgggctttcaccatgttggtcaggctggtcttgaactcttgacttcaaatggtccacccgcctcggcctcccaaagtgctgggattacaggcgtgaaccaccacactgagcccaggactaaaacatttttaatgtaggtacttgtataaaggagttccatggggcatttcagatgttggcacaatgtggctgatttccctttaacactgtgatgttaattgtatggctctaagagttcatgctgagcagtagtaatgttgtttttaaagattgagtcgaaatgactttttactcaaaatgatttttaaaaatt

SEQ ID NO: 27912 - DNA, 119 bp, Homo sapiens
  misc_feature 32: m=a or c
  misc_feature 47: m=a or c
  misc_feature 88: m=a or c
  misc_feature 89: v=a or c or g
  misc_feature 107: m=a or c
gaggcgccgccgaaaggggcggagcgggtcgmatatggtaaaagagmgcccgagcttcgcgcctgggtctggaagaggtcttgcgaamvcgcactcgagcgcgctcmgcgactgctggt

SEQ ID NO: 27913 - DNA, 186 bp, Homo sapiens
  misc_feature 95: s=g or c
  misc_feature 96: y=c or t
  misc_feature 137: m=a or c
ttctcatcttgcattcatgatgggggcgagggagtggagaggaggctgaggcaccacggacagaaaaccctcacctgggaggggtgccgaagggsytaatgaagtcaccttgattcgtgtcctttttccctgacctmactttcccttccgtctattcctctcgccccaggccgttactgggtagat

SEQ ID NO: 27914 - DNA, 221 bp, Homo sapiens
tgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaa

SEQ ID NO: 27915 - DNA, 298 bp, Homo sapiens
  misc_feature 15: y=c or t
  misc_feature 44: h=a or c or t
  misc_feature 172: k=g or t
  misc_feature 255: m=a or c
  misc_feature 275: w=a or t
acagtggacccatgyaaaaggtggctatattggcagggttggghagctcttcatgggttcaacaataaggtctttccctttacaagactgattggctactgttattgctgagtgcctaatcagccaactgcagagtccaacattgagtccctgatatggcaccattcactgkggaaccagccagccatctgctagtggttgattatattggacctcttccatcatggagggggcaaagatatattctcacagggmtagtagcatattctgcatawggatttgctttctctacctataa

SEQ ID NO: 27916 - DNA, 129 bp, Homo sapiens
  misc_feature 16: r=a or g
  misc_feature 17: k=g or t
aaagtatacatgtttrkaagtgcagcatacctgaaatcttgatatttgtcaatacttatggttgcttcaaagataaatttatgtgattatttttgaaagatgtgtattaatttgaataatacccagatt

SEQ ID NO: 27917 - DNA, 201 bp, Homo sapiens
  misc_feature 12: r=a or g
  misc_feature 85: w=a or t
  misc_feature 134: w=a or t
gtcttcagaggrgcgctgtttctggaggagttaggggaaggaggctgcctggtaagccaggaaaggggcttctggccgttctgtwggagcgcctctgactgactgtcccccatgtgtccgtgtggccacaccgwgctactttcagaggcagtgggcttttcgctaagggataaaaagaagtaaaaccttgcctttagcgca

SEQ ID NO: 27918 - DNA, 155 bp, Homo sapiens
  misc_feature 16: b=c or g or t
  misc_feature 17: n=a, g, c or t
  misc_feature 68: k=g or t
  misc_feature 102: d=a or g or t
  misc_feature 121: w=a or t
  misc_feature 146: k=g or t
acattagctctaagcbncagttcctggtggtcgccagggacctgggggtgggggtaactgaaccagaktgcagaagcgaggccagttgcccatgggattgcdgacttctctccacacaggwgtctgagagggctgaggtgggcaakgcgctgaga

SEQ ID NO: 27919 - DNA, 184 bp, Homo sapiens
  misc_feature 16: w=a or t
  misc_feature 17: w=a or t
  misc_feature 120: n=a, g, c or t
  misc_feature 121: y=c or t
aattattttatttttwwatgtaatctttttttttaatttattattattatactttaagttttagggtacatgtgcacaacgtgcaggtttgttacatatgtaaacatgtgccatgttggnyggctgcacccattaactcgtcatttagcattaggtatatctcctaatgctatccctcccccta

SEQ ID NO: 27920 - DNA, 210 bp, Homo sapiens
  misc_feature 17: k=g or t
  misc_feature 167: n=a, g, c or t
  misc_feature 199: m=a or c
  misc_feature 200: b=c or g or t
caaaaactagttgggckaggtggtgcacgcctataatcccagctacttgggaggctgaggcaggagaatggtttgaactcaggaggcggagttacagtgagccgagatcacaccactacactctccagcctgggcgacagagcaagactccatctcaaaaaataagntgaaaggccctgctgcatcagagattcagtgmbcaacccctct

SEQ ID NO: 27921 - DNA, 111 bp, Homo sapiens
  misc_feature 2: r=a or g
  misc_feature 18: r=a or g
  misc_feature 104: w=a or t
artcccaacactttggaraagccgaggtgggcagatcatttgagctgaggagttcaagaccagcctggacaacatgctgaaaccccatctctactaaaactacwaagaatt

SEQ ID NO: 27922 - DNA, 220 bp, Homo sapiens
  misc_feature 17: d=a or g or t
aaaacgaaagcggccadgtagagctccgtcctgacgcgccgcctcccgtgggctccggccggctaagccgcggcggacaactatgctgaaagccaagatcctcttcgtggggccttgcgagagtggaaaaactgttttggccaactttctgacagaatcttctgacatcactgaatacagcccaacccaaggagtgaggatcctagaatttgagaaccct

SEQ ID NO: 27923 - DNA, 373 bp, Homo sapiens
tattttcttctgcaacaccgcttggccccaatacaaactcgacaatgattccaaatagccagaaaacggcactttcgagttctccatcctacaagttctagataattcttgtcataaaatgggcaaatggtctgaggtgcctgacgtccaggcattcttttacacattggtccctccctagtctctgctcccaatgtgactcatcccaaatctttcttctttctctcctttctgttccttcggtctccaccccaagttccgagtcctctgaatccttcttttctatggactcatctgacctccccccttctccccaggctgctcctcgccaggctgagccaggtcccaattctcacttagcctctactccccc

SEQ ID NO: 27924 - DNA, 221 bp, Homo sapiens
actctatgtgaatgctatgtgaggacactcaggcatccctaagcagaggtccacttggtgaggaactgaagcccctgccgacagcaagcacagactccccgccatagtggtgacctgtctcagaaccagagcttctaggcccaggcaaaccttctgatgactgcagccctagccaaaatccagactgcagcttcatgacagactctgggccagggccaccc

SEQ ID NO: 27925 - DNA, 439 bp, Homo sapiens
  misc_feature 297: h=a or c or t
  misc_feature 298: n=a, g, c or t
  misc_feature 299: n=a, g, c or t
tcaatttggttactatatagtcttgtacacttgttcaattatttcataaattccaaggaaattttgcccccagagataatttgatgtcattaatatcatgtatagtctagagatattttatgcataaaatacatgctgatactactttacctttttttatacaaatggtatcctataaacaatgttcctataccttgcttttttggtatcatactatacacattgctgttgtacgttgcttgttttccctcaacattacattggtgatccatccatatctgagggatatgcagttthnntaggcttgtgatacattcagtggtatagcattatttcctgtcttctgttggcttccaggcagagtcctgccttcagtgttcctatgtactttccttcttgagttatccctcagatagcttttttcctccttctcccccca

SEQ ID NO: 27926 - DNA, 376 bp, Homo sapiens
  misc_feature 230: d=a or g or t
  misc_feature 311: n=a, g, c or t
  misc_feature 312: k=g or t
caatgaaattcagaatttggtggagttggtaaaagattcagatgattaaatgttagacaaggctatctaacagtaaattattgtcccagtgagaaaaaagggtgataccaatcagaatgtggtcaagtaaagtaccagaattattgatataaaaaaaattaatgtgagtgatgaagtggaatattagtgattgtagtcaaagaacaaagttcagattttagagatggagdagccaatagccactatggggaaagggttggaaaagattagaagtggaggccattggttgagacgcctatggaacagatgankttaggcagctgtatgtgttatcatcagggatggaaaaatctcaggataatgacaggagtggggc

SEQ ID NO: 27927 - DNA, 174 bp, Homo sapiens
ttcccccacctttgcacaggtgctttcaatagttttaaaattatttttaaatatatattttagctttttaataaacaaaataaataaatgacttctttgctattttggttttgcaaaaagacccactatcaaggaatgctgcatgtgctattaaaaattgttccaaatgtccat

SEQ ID NO: 27928 - DNA, 230 bp, Homo sapiens
  misc_feature 9: w=a or t
  misc_feature 39: w=a or t
  misc_feature 40: k=g or t
  misc_feature 45: r=a or g
  misc_feature 46: r=a or g
  misc_feature 110: m=a or c
  misc_feature 126: m=a or c
  misc_feature 202: r=a or g
  misc_feature 221: s=g or c
  misc_feature 222: s=g or c
ataattgtwtgttcccaaattcctgttccctgatcaacwkcctgrragtttatatcccctcaggataatctattctctagcttaggtatctgtgactcttgggcctctgmtctggtgggaacttamttctctatagcccactgagccccgagacagagaacctgcccacagctctccccgctacaggctgcaggcactgcarggcagcgggtattctcctssccacactc

SEQ ID NO: 27929 - DNA, 344 bp, Homo sapiens
  misc_feature 221: w=a or t
  misc_feature 222: w=a or t
  misc_feature 229: w=a or t
  misc_feature 230: w=a or t
  misc_feature 335: w=a or t
  misc_feature 336: r=a or g
cacctctagttgtcagttcaactttttacctttagttttctctgaactcttccccttgttccaaggggaagctttcaaaaagtgaattatgtcaccatttgcatgttattgaatagaagtgcactcttaacatcccatttatccagtgtcaaagctatgatacattgttgctttatgtggggtctcccacactgaaaagaaaaacccggacttcatttatwwagttatwwatttatttatttatttattactttatattgctaatgtaaacctctgctagaagtaaataggctctcgcaaatattcaaagtgatacagtaataaacatcaaatawrtttgagaa

SEQ ID NO: 27930 - DNA, 302 bp, Homo sapiens
  misc_feature 260: n=a, g, c or t
  misc_feature 266: w=a or t
  misc_feature 269: y=c or t
  misc_feature 295: w=a or t
ctaaattatcatgcctcagcctcccgcatagctgggattagaggcgtttgccaccatgcctggctaagttttatatttttagtaaaaatggggtttcgccatgttggccagactgttctcgaactcttgacctcaggtgatccacacgcctcgtcctcccaaaatgctgggattataggtgtgagccaccatgtccggcctgattggccagcttttcatttggaatggggataggacatagttggaagttggtgtctttnggttawttycctaacatgtccaagcatcctaaagwatcagtc

SEQ ID NO: 27931 - DNA, 147 bp, Homo sapiens
  misc_feature 132: r=a or g
  misc_feature 133: k=g or t
  misc_feature 136: s=g or c
  misc_feature 137: y=c or t
ggttggcgggcggcctgcgctctcaacctgggcgccttggaatcgcggtcccgtgctgtcctccaaacttcagactcacctcggacgcgtcaacctctttgaagacttttcagtcgccagatgagccttatrkgasyttagccccac

SEQ ID NO: 27932 - DNA, 124 bp, Homo sapiens
  misc_feature 84: n=a, g, c or t
  misc_feature 93: m=a or c
ctgtacattttcaaggaatttttgagaggttcttggagagattctgggagccaaacactccattgggatcctagctggaatatnaagaatggmttatcagtggagaccatcgacagttgagaaa

SEQ ID NO: 27933 - DNA, 159 bp, Homo sapiens
  misc_feature 104: b=c or g or t
gtgtgtgtgtgtaggtattaaagatgtgttgttggtttccaaaaaggaacactggcaaaataaattttgaatgtttatgttctcagaatcaggttgacagtccbttgctgacatggctttgctttgtgtaaatacagtggatctcaatcttcggggtgc

SEQ ID NO: 27934 - DNA, 125 bp, Homo sapiens
  misc_feature 82: w=a or t
  misc_feature 83: m=a or c
ctggctaatttttgtatttttagtaaagatggggttttgccatgttggccgggctggtctcaaactcctgacctcaggtgawmcacccccttcggcctcccaaaatgctgggattacaggcgtga

SEQ ID NO: 27935 - DNA, 127 bp, Homo sapiens
tagggtttcactgtgttggccaggctggtcttgaatgcctgttctccattgttttatctggcattaaaatgcagggtttaaaaaaagaatagcttgccgggcgcagtggctcacacctgtaatccca

SEQ ID NO: 27936 - DNA, 152 bp, Homo sapiens
  misc_feature 15: k=g or t
  misc_feature 34: h=a or c or t
tataaataatttttkttccttttttgtgatggahtctcactctgttgccaggctggagcgccatggtgcaacctcagcctcctgggttcaagttattctcctgcctcagcctcccaaatagctgggactacaggcatgtgccaccatgccca

SEQ ID NO: 27937 - DNA, 294 bp, Homo sapiens
  misc_feature 117: w=a or t
  misc_feature 182: d=a or g or t
  misc_feature 183: w=a or t
  misc_feature 239: w=a or t
agtagtcgctgctgcgcggccgccggcgggactggtctgaagagacgcggggaccaagtggcaacgacttggacatctgagctgtcactgccgaaaacaggccgcaagagagataawcaatatgcatttccaagccttttggctatgtttgggtcttcttgttcatctcaattaatgcagadwttatggatgatgatgttgagacggaagactttgaagaaaattcagaagaaattgawgttaatgaaagtgaactttcctcagagattaaaatataagacacctcaacctata

SEQ ID NO: 27938 - DNA, 192 bp, Homo sapiens
  misc_feature 85: s=g or c
  misc_feature 87: d=a or g or t
  misc_feature 132: y=c or t
  misc_feature 133: b=c or g or t
  misc_feature 149: r=a or g
ggggcagggagggaaggtcccggcggccggccggcctcggggctgtttttgtccgctttccgggggtcgtgaggggccggtggcsgdcaacagtggcttcagttaccacaggacaacacaagatatacagcybatggcatatccagtarccaggaaaacaagcattctcacgacccagccgaactccttcta

SEQ ID NO: 27939 - DNA, 92 bp, Homo sapiens
agctggcgggggcggaagatggcgacgcccctcgggtggtcgaaggcggggtcaggatctgtgtgtctcgctttagatcaactgcgggacgt

SEQ ID NO: 27940 - DNA, 73 bp, Homo sapiens
  misc_feature 26: m=a or c
acctttataacttcttaagagccagmtcatctaatatgttcagaccagaccacttcttgactattcagagatc

SEQ ID NO: 27941 - DNA, 167 bp, Homo sapiens
ctgcctgtcagatgcctcattcccacctgtgatgctcagagagaaaccatgagccctcaaaaacaccatattgttttgtgatgtcacctctggaatgttctgagtgttttggtgaccaacttctgcataggacctatacctggcaactcacattgcactcaaggcct

SEQ ID NO: 27942 - DNA, 114 bp, Homo sapiens
tatagaaggcactgagtttcccccttttcatcaaaatcagtcaccctgctcagtacggtggtcctttacgtgcttgttggttcagctatatgaagaacccctaaatggccaaaa

SEQ ID NO: 27943 - DNA, 252 bp, Homo sapiens
atcaatgccaaggaaaatcgaagaacacctgggaacgaggagggtgcctgagccttagtccaagccacattttgaaatgcctgccagaggattaaagaggatggaaacattcttattgtagaatatacgaaaggatatttcagagcaaattgaggcctgtagtgaaaaacagaatatactgtgataaaagctagaaacaaggttgcagacagtctaattctggaacgtgttaaaagacatttcaaggcccat

SEQ ID NO: 27944 - DNA, 89 bp, Homo sapiens
  misc_feature 35: m=a or c
  misc_feature 39: r=a or g
  misc_feature 40: m=a or c
  misc_feature 47: m=a or c
  misc_feature 76: m=a or c
aaagaagattgcttgagcttgagtctgagcccacmagtrmgctatgmccgcaccactgcaccccagtctgggtgamagcacaagacccc

SEQ ID NO: 27945 - DNA, 391 bp, Homo sapiens
taacctatgttaaagcagggctgttattgttatccccatcttaaaagtgaagaaaccatgaatcagagatgacaagaatgtatctaagactaagcagccaataaataggcatggaaacaaagtctcctgacttggattcttttagagactgatgcttctttgtttttcagcgcttctgtaatggctatttgattaatgacattgaactaatctgtgtcattctgtctcccatctttttgtactgtggaactcagtgactgttacccagagtttttgttgttgttgtttgtttttagagacagcatcttgctgccacccaggctggagtgcagtggtgcagtcttagcttactgcagcctcaaacttctgggctcaagtaatcctcccgcct

SEQ ID NO: 27946 - DNA, 212 bp, Homo sapiens
  misc_feature 104: m=a or c
  misc_feature 128: m=a or c
  misc_feature 133: w=a or t
  misc_feature 144: w=a or t
  misc_feature 177: m=a or c
cccactcgcggtgtgaacatactgggtctcgcctctcctttcccctcccctcggcctggtgctgaatcatgagcccaatgtctccaaaagacggagctgcgggmggaggctccatgttgggaagcggmgccgwtcgtgcttgtwagcgggaatccgggagccgcggggtgagctggmgggggccgggccctaagtgaagatggaggccccat

SEQ ID NO: 27947 - DNA, 88 bp, Homo sapiens
  misc_feature 20: w=a or t
  misc_feature 23: w=a or t
  misc_feature 29: w=a or t
  misc_feature 32: w=a or t
  misc_feature 40: y=c or t
aagactatactttcagggawcawttctawagwgtgttacyagcagaagtttctctgaacgtgtagagcaccgcataaaccacgaggca

SEQ ID NO: 27948 - DNA, 194 bp, Homo sapiens
  misc_feature 39: s=g or c
  misc_feature 40: m=a or c
  misc_feature 192: n=a, g, c or t
taagtactagaaatgccgtttttatcacttgaaaaatasmttagaaatgtttttcttttcccagaattgtgtgagtttgttttgaagccttgaataccggtacatggttaacaggcagcttgtgcccaatcccaaagcgggaagaaaggcctggctttggctcactgatgataaagtctcctcccactgccnga

SEQ ID NO: 27949 - DNA, 415 bp, Homo sapiens
  misc_feature 38: s=g or c
  misc_feature 53: r=a or g
  misc_feature 161: y=c or t
  misc_feature 254: r=a or g
  misc_feature 381: y=c or t
  misc_feature 384: s=g or c
  misc_feature 390: r=a or g
  misc_feature 400: w=a or t
agcaggtgagccccgggcccggatggtgggactgggcscaggttcccaccgcrtcgtccgcctcagccagaaccttctggtccccgcccccggatagggacccaggaggcccaagccccttcttccggcggggagtgggagcctctcgcactctcggcagytccagaccctcgggatctccgtttacagttcaggacctcagctgcactttggcgctaacgccctgtttcccagggctgtgagggaccaaccaratatgaagctgttgatttctccaaaataaccatcaaaagtctgatgagataaagagcacactggaaactgggaatgctttgatggaaattctgcaagtaatggacgctctggcttgccttggtgacygtsaaataraagcaagtawatactcagttctctc

SEQ ID NO: 27950 - DNA, 138 bp, Homo sapiens
  misc_feature 26: w=a or t
  misc_feature 78: w=a or t
  misc_feature 82: w=a or t
  misc_feature 98: w=a or t
  misc_feature 121: w=a or t
  misc_feature 124: w=a or t
  misc_feature 128: w=a or t
catctttgcttttgtgagtttgtgtwaccgcacaactcccagacttttaactgcctgtaccttggaaatgtctgctgwtcgwaacttcttcagtttgwataacagtgctgcagctgtattwggwtttwacctctcccc

SEQ ID NO: 27951 - DNA, 360 bp, Homo sapiens
agaaaagaaacaagctgcggtacaactgtcctcaccagccctcgcctcccgagtcactgcagccaacccttcagcaaggagttgagggagaactgtaggaacaccttgggaagcctttactggttgtcctcttaagaagagctggataatgtactgagaatacctgtcctttcttggtcctggagggcagacagcagctacagcaggactggtggaaccagcttcctggcaggaattaccctcccccaaagctagggacccaggaagatgccctgtccagcatagactttaaagagagtcaaactctacggaagaggattgtaacggaccatttctgaataaagtgatgatcagccaact

SEQ ID NO: 27952 - DNA, 125 bp, Homo sapiens
tgttgtacttttagtagagacggggtttctccatggtggtcagactggtctggaactctcgacctcaggtgatttgcccacctcagcctcccaaagtgctgggattataggagtgagccgcccga

SEQ ID NO: 27953 - DNA, 458 bp, Homo sapiens
  misc_feature 166: d=a or g or t
  misc_feature 167: s=g or c
  misc_feature 174: k=g or t
  misc_feature 389: r=a or g
  misc_feature 404: w=a or t
  misc_feature 406: h=a or c or t
  misc_feature 407: h=a or c or t
  misc_feature 408: h=a or c or t
  misc_feature 418: w=a or t
  misc_feature 419: k=g or t
  misc_feature 442: w=a or t
  misc_feature 445: w=a or t
gaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgdscacaatkaacatatgtgtgcatgtgtctttatagcagcatgatttataatcctttgggtatatacccagtaatgggatggctgggtcaaatggtatttctagttctagatccctgaggaatcaccacactgacttccacaatggttgaactagtttacacgaacatgcctcatcataccctccagcattaacatcaacacagaccttaaggctgataagaarcatttacaatctatwchhhtctgaagtcwkctacctggaggcttcatctgcawgawaaaactttggtct

SEQ ID NO: 27954 - DNA, 290 bp, Homo sapiens
  misc_feature 100: r=a or g
  misc_feature 101: w=a or t
  misc_feature 108: k=g or t
  misc_feature 111: w=a or t
  misc_feature 121: w=a or t
  misc_feature 130: y=c or t
  misc_feature 131: k=g or t
  misc_feature 257: k=g or t
  misc_feature 258: r=a or g
tcattctcttcctgcttctgctctgggccggtgggtggctctcagaaaatacttgctgctggcaaaaggcctgtactcaggcatttgctttgacttgatrwtgccaakggwctgaggccawttggcaggykttagtaccacctgctcctcatcttaggagtctccttttcaaataattaggctctgttcccattttaaaactctgatattggccttcacctgtgactggacactttactagaggcccatttttcackraacaataaaatctaaataaattggaaggaatt

SEQ ID NO: 27955 - DNA, 344 bp, Homo sapiens
  misc_feature 219: m=a or c
  misc_feature 270: w=a or t
  misc_feature 292: m=a or c
  misc_feature 299: m=a or c
  misc_feature 321: m=a or c
  misc_feature 338: n=a, g, c or t
gcgcaagtgcggctctgcagggaggagggagggccgaggggaaggccctcgagagagtggagggcaacagtggccacggttcctctgtacttcgtttcttccctttatagaattgagagattgctgagcctaaatacatgttgctgcattgcctccgagaatggccggacctatccccactctcaccaaaacagagtgtgggactcactgctccctcgmctactatgtaaccttcctagggatgctgtttctaactgctgccggcccctwcttaccatctctctggttgtgmttctgamgcattccctacacaactggaamgtgtttccaggtcagcntcccta

SEQ ID NO: 27956 - DNA, 60 bp, Homo sapiens
cccattagctcagccgtggcatcggacttgcagcttcattttgggctgccttagccatga

SEQ ID NO: 27957 - DNA, 267 bp, Homo sapiens
cctttaatgcctgatatacaaaagcagactcataaacaggttttataaacagtcttcacttatagaatttcataaatcctgagctaatttaatgaacaattggttttaacccataagtacaaaacaatacatcttgcataaagaaaagtatatctatatttggagatagtttagctgatatgttcttgataattgtgcctcgacctcatcatttaaattaatagagaggaaagttttcttcatttggtttagatttacccctgcctt

SEQ ID NO: 27958 - DNA, 293 bp, Homo sapiens
aaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgct

SEQ ID NO: 27959 - DNA, 75 bp, Homo sapiens
  misc_feature 11: d=a or g or t
attagtaaatdacaaggcataagtagcactaataggtgcaaagttaaccagaagttaaaattgaaaactagagtt

SEQ ID NO: 27960 - DNA, 103 bp, Homo sapiens
  misc_feature 15: d=a or g or t
  misc_feature 16: w=a or t
tagtagagacggggdwtctccatgttggtcaggctggtctcaaactcccaccctcaggtgatctgcccgcctcggcctttcagagtgctgggattacaaccgt

SEQ ID NO: 27961 - DNA, 116 bp, Homo sapiens
  misc_feature 13: k=g or t
  misc_feature 55: k=g or t
gggcttgcgtcgkagggggcggtgggctcacccatgggcctttccaaaagcaaakagaaacccaggaaaggtgaggagcaaaagaagggatccacctattcagttccaaaatctaa

SEQ ID NO: 27962 - DNA, 105 bp, Homo sapiens
  misc_feature 38: m=a or c
cagaacaatctgctggcttagcctttggccaagttggmagctggacgagcacgctcagagcccagctcttgagagttcaagtatccgacagttccccactgctcc

SEQ ID NO: 27963 - DNA, 81 bp, Homo sapiens
  misc_feature 26: w=a or t
  misc_feature 36: d=a or g or t
  misc_feature 54: d=a or g or t
  misc_feature 76: n=a, g, c or t
cgccgggcgcggtggcgcgtgcctgwagtcccagcdactcgggaggctgaggcdggaggatcgcttgagtccaggngttct

SEQ ID NO: 27964 - DNA, 112 bp, Homo sapiens
agcagcggttgtcgggtttggggctggaggtgaagccctgtgtgaatggggttgattgtccggcgccacttccccgcgctgcccggcagccgtcttccccagccgagggact

SEQ ID NO: 27965 - DNA, 131 bp, Homo sapiens
ttgtattatttatatatctttgtatataatatttgtattgtattatttgtattgtataatatttgtattgtattatttatatatctccccagctgtttttatagtttctagaaggcagaggttggatctta

SEQ ID NO: 27966 - DNA, 97 bp, Homo sapiens
  misc_feature 15: d=a or g or t
  misc_feature 16: y=c or t
tggtacttaagctcdytcttaaaggatgagtatgagttaaataagaaagggtgggagagtgggtcaattaatgttggatttgtagttggtttgttct

SEQ ID NO: 27967 - DNA, 55 bp, Homo sapiens
acccggattccgcgcctagctcagccaattaagcatgagacataggccattgagc

SEQ ID NO: 27968 - DNA, 289 bp, Homo sapiens
  misc_feature 15: d=a or g or t
  misc_feature 19: m=a or c
  misc_feature 25: k=g or t
  misc_feature 31: m=a or c
  misc_feature 49: y=c or t
  misc_feature 51: d=a or g or t
  misc_feature 52: h=a or c or t
  misc_feature 54: k=g or t
  misc_feature 70: m=a or c
  misc_feature 74: h=a or c or t
  misc_feature 98: r=a or g
  misc_feature 99: r=a or g
  misc_feature 100: r=a or g
  misc_feature 131: r=a or g
  misc_feature 210: m=a or c
atacatacacattadgtamtcagckaagtamtggcactatgaggatttytdhtkctttcctgtcagcagmagthctgtgaatgcatcttaggtataarrrtgcaatacagatttttatattttggtgtggrccatggctcaattttgttttaccagttagttgcaagcaaaatgtaatttaatgtatagatgatttctaatgtctcctgmcaaactgtaaatactgcatttcttttgcgtatataattgcttacagcttttctcatttgatatatagcattgtacatat

SEQ ID NO: 27969 - DNA, 145 bp, Homo sapiens
  misc_feature 123: w=a or t
tgcagtgacacagtcatagctcgctgcggcctcgacctctcgggctcaggtgatccttctacctcggccacctcagtagctggtactataggcgtgtgctaccacacctggctaaattttgtwatttttttgtagagatggggta

SEQ ID NO: 27970 - DNA, 120 bp, Homo sapiens
aggaggggacaaaatggaagcggaagcagccgggcgaggaatctacgtgggctggtctgggctgtgtgaagtatagagaaaaggcttttcaggactgcatgtgacgatgcctgcgggcta

SEQ ID NO: 27971 - DNA, 74 bp, Homo sapiens
  misc_feature 5: w=a or t
  misc_feature 15: s=g or c
  misc_feature 27: w=a or t
  misc_feature 32: m=a or c
  misc_feature 57: r=a or g
  misc_feature 59: r=a or g
gcgcwgttctcggascaaactgagggwggggmggctatttctcggggcccaatgacraratgcagatgaactga

SEQ ID NO: 27972 - DNA, 325 bp, Homo sapiens
  misc_feature 253: k=g or t
  misc_feature 275: w=a or t
  misc_feature 307: m=a or c
tattttgatatctagaagttaggttaaatttcatgagtttaactttttagtaccacattatggtgattttgctgcaggttactagagggtgaagagaggattttttttaaatgagacatttagttaaaaaccccagccaaagaaatggcttggctcattgtgtgagtgtgtttatttcccagataacaacttagcatgcccaggttgcgtgttcatggagcatgcctgcctaccaaaagtgttttgtttttgktttaccataggctaacaatgcwaagagaggcctctgatgaaattgtggctgaamaagaggctgaagttaaat

SEQ ID NO: 27973 - DNA, 246 bp, Homo sapiens
atggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccaaac

SEQ ID NO: 27974 - DNA, 171 bp, Homo sapiens
  misc_feature 105: b=c or g or t
  misc_feature 107: r=a or g
aaacttctctgtcaatttttacatgatttttgagaacattttaaataatattaagacaaaaaacatttcaagaagcaaaacacagtggaaagcacacaacagtgbaragctccacagcaaattggagcttcctggtttctgtaggtatttctttttttttttttttttttt

SEQ ID NO: 27975 - DNA, 259 bp, Homo sapiens
  misc_feature 150: k=g or t
  misc_feature 230: n=a, g, c or t
catttgatctttttttaaagacggagtcttgctcttgtcatccaggctggagtgcagtggcgtgatctcggctcactgcaacctcttcctcctgggttcaagcgattctctgcctcagcctcctgagtagctgggattacaggcacctgkcaccacgcccagctaatttttgtatttttagtagagacgggtttcaccatgttggccaggctggtgtcaaactcctgacnttgtgatccacccgcctggcctatttgat

SEQ ID NO: 27976 - DNA, 260 bp, Homo sapiens
  misc_feature 124: b=c or g or t
  misc_feature 161: n=a, g, c or t
tatgtcaaagcattcattttttttaggatatctgaaaaaatgccatataagagaaaactctataaaacatctataattttcgaacccaagtacactcttgcattctatgctttaagttaaatgbaaactcctttttccttcttcctgctgcaagtactagntcatcctgatgctcaagagtgtcagggcctgggtttccaaacagagactaccctaaaattatttggcgagtagtactttacacaattgcctctcccccc

SEQ ID NO: 27977 - DNA, 397 bp, Homo sapiens
agaggtaactcagggccacttacaggctcacagaacctgaaaatttctaacagcaaggggcaaaaggattcctttatacatgaaaaattaactcaaaagggatcatagccttagacataagacctaaaactataaacctcttagaagaaaacacaggagtaaaattccttgaccatgttttaggcaatagtttcttgcatatgacaccaaaaggaaaagcaacaaaggaaaaacattaattcatccaaattaaaaacttttgcattttaaagaaaagtagaaagacaacccacagaataagagaaaatatttgcaaatgctatgtcggataagaaacctgaatccagaaggcaaaaacaactcttacaacttaataataaaaagtccaagcactcct

SEQ ID NO: 27978 - DNA, 382 bp, Homo sapiens
  misc_feature 100: k=g or t
  misc_feature 115: m=a or c
  misc_feature 116: m=a or c
  misc_feature 166: n=a, g, c or t
  misc_feature 223: s=g or c
  misc_feature 224: r=a or g
  misc_feature 329: r=a or g
  misc_feature 379: w=a or t
cagacactaggtatttgccagcagccagggtcagtgctgggccatggaagggaagcggcccgcttctttctcatggcaccttgaagacgcgccagctgakaaggcctctcaccgmmgcatgaccatgggggcaggacgtgagggcgcgggttagtgtcaaaatagnaagaggaggcgagcttcaaggacggctggagaaaccagaagggcattgtttgaacasrtctttcatcagaaactggactcatgaatccatgggtcaaatcatggcagcgtttgcatcattcagctatttttctgtcatttttgtagaaaatgtaagattgcaraggtttttaccagtattatgaagttatatcatgaggatgtgtgcggtagwaga

SEQ ID NO: 27979 - DNA, 425 bp, Homo sapiens
taattggctccccacttagaagaaagcacacattcatcagtttcccccacagcaatgggaaagccaggcctgggaacacatggaggagggcaccgccgagccgcgaggagctctggccccggggtgtccctcagggtgctggccaggctgcctttgttccgctttacacatggccctgtgtgatctcatgtccatctgtatgccagggctgcccagagccccagccagactgcttgtcagaaccctgcttggcttctcgccctggatgtcccacagcaaactaatcctgtctgaacttgacctcgacatcttcctcccaggcgtgctcctttgcctcacctagtctgtttctcagtgaagagcaccaccatccacctgcttgcccacaccagaaacctcatctcatccctgtctcctccccccca

SEQ ID NO: 27980 - DNA, 210 bp, Homo sapiens
aaagattccagcatcttggaagcaagtgctccactggaaaataaaagccacgtgtctttttaaaagcatgagtgaagaaagacataaacttccggatttgcgtaagtgagcttgccaactaaggaaacacatgagtattatctgtatcttcaggagcacttgattagactccagaaacagaaactgcagctgctcccaccacccccacgt

SEQ ID NO: 27981 - DNA, 53 bp, Homo sapiens
  misc_feature 1: h=a or c or t
  misc_feature 26: r=a or g
hatagagacttctggactctatagarcccactgcctcctgatgaagtccctac

SEQ ID NO: 27982 - DNA, 144 bp, Homo sapiens
  misc_feature 13: w=a or t
  misc_feature 90: m=a or c
  misc_feature 111: m=a or c
  misc_feature 112: v=a or c or g
  misc_feature 120: k=g or t
  misc_feature 128: m=a or c
  misc_feature 131: r=a or g
  misc_feature 133: w=a or t
  misc_feature 144: w=a or t
tggttcctcccgwtctctccttacccgagcctgaggcccctctggagaacaggcagcctctgaggaaacctctgatccccgatcagccamcccatcgcctgcgtccccagmvgcttccckcctgggcmttrtwcccccttcccw

SEQ ID NO: 27983 - DNA, 369 bp, Homo sapiens
  misc_feature 356: w=a or t
  misc_feature 366: b=c or g or t
cttttaccgctggagaagccgacggacagacgggcagcgacccccgccgtcgcacaacccgtctaggcagagagcgcaggagacgggagggcggcagggacacatctcccagccaaggacctcctgggcccgcagaggccgcgacaggttccccccacagagggaaccaactctgccgcaggttagagcacagcagactgagccacccagaactggcccctccggtggaccagcccctgcggattcacagaccactggtcctggaagggaccttgtcaagcaggcccataaggtaatccctgaaagagaattccccggaaagagaagatcacagattttgtcatattaaaatacawtgtagaaatbcat

SEQ ID NO: 27984 - DNA, 256 bp, Homo sapiens
  misc_feature 122: r=a or g
  misc_feature 142: d=a or g or t
  misc_feature 243: s=g or c
cccaaattcttctcatcttggaaaactgaaactctatacgtattaaacttcccattcccccagcccctgacaatcaccattctaccttctagctctgtgaatgtcacaagtacatcattatrtgggatcatacaggtatttdtttgtgactggcttattatacttagcatgatctacgttgtagcaggtgtcagaatttcgttcctttgaaaggctgaataatattccactgggtttagatasaccacgttttgtt

SEQ ID NO: 27985 - DNA, 309 bp, Homo sapiens
  misc_feature 83: r=a or g
  misc_feature 84: m=a or c
  misc_feature 94: r=a or g
  misc_feature 172: r=a or g
  misc_feature 184: w=a or t
  misc_feature 218: k=g or t
  misc_feature 297: w=a or t
gtctcccttggatcacttgcttggggggaaccagctgccatgttgtgagatgctcaagcagctgtatggaggagcccatgtgrmaaaaaactgrgcacccctcacaaccgatattcccttaccaggagtgtggcaagcctccctggaagcagactcttcagcaccagtcaarctttcagatgcwgcagccgtgggcaatgactttgctgcaatcttakgagagactaagccagaaccacccagctaagtggctcccacattcatgactcacgaaaactgtgaggacacatggtgaawagagggcttgct

SEQ ID NO: 27986 - DNA, 257 bp, Homo sapiens
  misc_feature 127: n=a, g, c or t
  misc_feature 146: k=g or t
  misc_feature 147: r=a or g
  misc_feature 177: d=a or g or t
gcaacccagttgggtccttttccactgtgtggtagctttgttcttttgctcttcacaataaatcttgctgctgctcaccctttgggtccgcaccacccttatgagctgtaacactcaccacgaaggnctgcagcttcattcctgakrccagcgagaccacgaacccactgaagggadcaaacaactccagacgcgccgcctttaagagctgtaacactcactgtgaaggtctgcagcttcaatcctgaagtcagcga

SEQ ID NO: 27987 - DNA, 198 bp, Homo sapiens
tgcacattttactttgggaatccgagacggtcagattacttgagcctaggaatttgaattttgaggcaaggtcttgctctgttgtctaggttggagttcagttgcgctatcagggatcattgcagtctcgacctcctgggctcaagctgtcctcccacttcagtctcctgagtaggttgggatgtgctaccacaccgc

SEQ ID NO: 27988 - DNA, 168 bp, Homo sapiens; identical to SEQ ID NO: 27129

SEQ ID NO: 27989 - DNA, 152 bp, Homo sapiens
  misc_feature 13: w=a or t
ttaatgcacttawaagggtattgcactaaacttgagctctttgaggacagagaccaggctgtgtggtcttccagaggaggacacaatgtgcacagtggataattgaagaatgcatgcattaagaaaattagtgaaagttgatcggtaaggac

SEQ ID NO: 27990 - DNA, 378 bp, Homo sapiens
  misc_feature 337: w=a or t
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccacgttttgttgacccattcacccatcaaggggcccaagttgcttccacattttagctacagtgaataatgctactagaaacataagggcacwaagctgggtctgtgacaccctgcttttaattcttttgtcac

SEQ ID NO: 27991 - DNA, 405 bp, Homo sapiens
  misc_feature 176: s=g or c
  misc_feature 381: n=a, g, c or t
  misc_feature 382: n=a, g, c or t
  misc_feature 401: r=a or g
gttttgtggaggagagcagggcagagatagagaggaatcctgcctgggccctcccatccagccctccctacaaatgcctagtagccactctgtggggcacatctgtcggctggtacaagccccagtgaccacaggagggcaagagaaacctaaattctgatatgagctggagaggsaagattaatctaagagatagataggtagccacgcactggtgctaagcaatcaacagcaggagaggcagagattgggatggacaaagggatcatggaaggctccttcgagctggacttgaaggactggtgagatctggacacacgcaaagagtaactgcccaacgtgttccccttgccactgcctagacaaagctgatttatcaanncagggaaattgcaataaaragct

SEQ ID NO: 27992 - DNA, 445 bp, Homo sapiens
  misc_feature 84: s=g or c
  misc_feature 132: d=a or g or t
  misc_feature 259: s=g or c
  misc_feature 308: n=a, g, c or t
  misc_feature 309: n=a, g, c or t
  misc_feature 369: n=a, g, c or t
  misc_feature 370: d=a or g or t
  misc_feature 371: n=a, g, c or t
aaagtttcctggggacctgtccggtcggaaagtcgagggacagttgtcttggtatttgtaaagggggtatccagtgaggcggasttgagggggttgtgtcgagtgactgatacagctgtcaaccaataaagdctactatcgctcgcctcaggaaaaccatcacaactccagctggatgtgcgcataatagtgtaatcactcatgattctattttgtttaataattcgttcttgagactagacgtctcgaaagcgaagastggcactcctcagcctgccacggacggctcgcaggccgatactgaacannagtacccttatcaaggaggcgtcacccctgggcaagcctagcatcagtccattgacaccndnagtcaccatgatagacgttctcccagaccaacagcttcctttggctcgaggcgggtcttacgtggagggcctat

SEQ ID NO: 27993 - DNA, 79 bp, Homo sapiens
tgattgggaatttggagtggtgagccacattctgattgttctgggaggttttatgcataaatatttttacatgtttttt

SEQ ID NO: 27994 - DNA, 144 bp, Homo sapiens
  misc_feature 14: s=g or c
ctctgctctgtggsccaggctggggcacagtggcacaatctgagctcactgcaaccttcacctcccgggttcaagcgattctcctgcctcagcctcccaagtagctgggattacaggcgcccgcccagccccaagtctggtttt

SEQ ID NO: 27995 - DNA, 114 bp, Homo sapiens
  misc_feature 68: w=a or t
  misc_feature 73: s=g or c
  misc_feature 74: d=a or g or t
  misc_feature 90: d=a or g or t
  misc_feature 104: w=a or t
ctaatctcattttccctgaatgccaactttcttttttttttcacttttaaaaattgtggtaaaatacwttaasdtaaaatttaccatttdagccatttttaggwgcacagttta

SEQ ID NO: 27996 - DNA, 340 bp, Homo sapiens
  misc_feature 119: m=a or c
  misc_feature 192: r=a or g
cttttaagacagaaccgcttcaaaaactccatgtaccagaaaaactggttagaaaagtggaatttgaaaccatgtcaaagaaacagatgcacaagtactgataagtgctctctaaggamctttaactccaacattagttggctctctgattgcaaggaagctctacaagatgcctacagttgcctttaatgrtcttggaacttactctatagtctcctcttcatgggaaaatggagttttatggagagatcaacctgggaactgttagatcctctctatgcttggaagatccttgtaacccatcacagagagcaattcagagaagaaaatttgcacactc

SEQ ID NO: 27997 - DNA, 407 bp, Homo sapiens
  misc_feature 124: s=g or c
  misc_feature 233: r=a or g
  misc_feature 360: k=g or t
  misc_feature 363: k=g or t
  misc_feature 364: k=g or t
ataaaagtgatggtgtctgccggcttactctttctcttgggtgatctgctctggggagagttgtgagtaggcctccagcccacagccatgtgagtgacccttttgaagagtggatcttccaggsccagtcaagccttcagatgactgcagccccagccaacatcttgggagaccccgagtcagaaacccccgctaagtcacttccagatccctaagtctcagaaactgaagaraaaaaaaatgtatgtggttttaagccctaagtttggggggtaatttgttatgttgcaatagataatatgtctgaatatggtttaactgtggccccacccaaatctcaccttgaatggtagctcccakaakkccttcatgttgtgggaggggccagtgggaagataattcaatca

SEQ ID NO: 27998 - DNA, 186 bp, Homo sapiens
  misc_feature 116: m=a or c
  misc_feature 119: s=g or c
  misc_feature 126: y=c or t
  misc_feature 127: m=a or c
  misc_feature 134: w=a or t
caatggttagatgagtgaaagaattaattcagattaaaaaaaatttgtttttgtttttgagacggagtctcactgtcgccaggctggcgtgcagtggtgcgatctctgctcgctgmaasctgactymccctggwtcaagcttttctcctgcctcagcctcccgagtagcagggattacaggcacgc

SEQ ID NO: 27999 - DNA, 97 bp, Homo sapiens
  misc_feature 33: m=a or c
aaaaagattcttgaagaggtctgtcccagacgmatatcgtcctattgcaacatgaccagcctgcagctcttgccccatgtgtcacttttatacacaa

SEQ ID NO: 28000 - DNA, 116 bp, Homo sapiens
atattacgcctggtcaaggccttcggtgatacctcatcactcttgtctcctcgacctggattttaaggttatttcaactataatggaacctaaccttttccagctttttttttttt

SEQ ID NO: 28001 - DNA, 56 bp, Homo sapiens
ataagcccttgcaggtgctgtccatctgtccattcctttttttttttttttttttt

SEQ ID NO: 28002 - DNA, 381 bp, Homo sapiens
  misc_feature 114: r=a or g
  misc_feature 205: r=a or g
  misc_feature 340: n=a, g, c or t
  misc_feature 341: n=a, g, c or t
  misc_feature 357: r=a or g
  misc_feature 358: s=g or c
tatttcgagcatctctatcaatacatttgaatgctgagagcttttccttccagaagctcatgtcattttcaacacacacttctatttacctttatgtagtttctaaaaattgaraaccagaattggaggtttttttaaaaaaaaaagaaagaaaaaacggtgaaaataattaattaggagccagggcagtggctcatgcctgtartcccagcactttgggaggctgaggcgggaggatcatttgaggccaggagtttgagaccagtctggccaacatggtgaaaccctgtctctactaaaaatacaacaagtagccaagtgtggtggcgcatgcctgtanncccagttacttgggarsctgaggcacgagaatcacttgca

SEQ ID NO: 28003 - DNA, 277 bp, Homo sapiens
  misc_feature 135: n=a, g, c or t
  misc_feature 136: k=g or t
agtggaggggcggatccctccaacctgacggccaaacgtttcctagacgttgtcgttactgataagaaactacatttcccagaatgcagtgagggtagcgaccgggctacacagtagaaacagggttttcaccankttggccatgctggtctcgaactccagaactcaagtgatccgtccgcctcggtcttccaaactgctgggattacaggcatgagccaccgcgcccagcctttggggaagttctttttaccgtccatcatccattaccaccaca

SEQ ID NO: 28004 - DNA, 401 bp, Homo sapiens
  misc_feature 124: r=a or g
  misc_feature 128: w=a or t
  misc_feature 129: y=c or t
  misc_feature 132: w=a or t
  misc_feature 137: m=a or c
  misc_feature 138: w=a or t
  misc_feature 317: r=a or g
  misc_feature 318: n=a, g, c or t
  misc_feature 319: n=a, g, c or t
  misc_feature 324: s=g or c
  misc_feature 334: m=a or c
  misc_feature 336: v=a or c or g
agttaggctgctggggctgtgggtgccatcttgtcaccttggaggaagagcccacctgagaacgacatcaactcagagggaagtcagcagagccaagaggccgggagaggtgattcccgggtgracawycawctggmwcctgggtgcagccatggtagagttggcctcgaacgttgtccctggcatggaggtgaccagaggtcaccctcacatgtcagcagacacctccagctgtgtcattcttgcttctcgttggcaaagtttgtaggggtagtattctcagttggcattcctagctgagatgtgtagctgggacrnnaccasgccgcagggmcvttgggaccagttctggcctccgaggagtcccttactgatgatcataaggctcctcaaggtcatca

SEQ ID NO: 28005 - DNA, 109 bp, Homo sapiens
  misc_feature 93: m=a or c
aaatcctaggggcctgggccctgtgctgtacaagggtagaatcaacctcctacaggaccacctacaggacccgagctggggaggggcggtggmtttatgctgacaaaac

SEQ ID NO: 28006 - DNA, 71 bp, Homo sapiens
agtcagccgtcatgggagggggaactgtggggcgttcgccatcttgtctccctctccttacctgcgtcctc

SEQ ID NO: 28007 - DNA, 238 bp, Homo sapiens
  misc_feature 132: w=a or t
  misc_feature 214: k=g or t
gtgggctggcctgtctgaggaggggcatttgcagtgctggagcaagccatggaggacaggaattgctccagtcagaggaacagcaaggacaaggggcccaagacggcatgtactagaggctccacgcatagwaaaagccagccatccccagcgctgtaactgagtggccagtggtgggagtctttgtaatagttaattttatgcatcaacttgkctggatcacagtgtgcccagatac

SEQ ID NO: 28008 - DNA, 86 bp, Homo sapiens
  misc_feature 17: b=c or g or t
  misc_feature 21: k=g or t
  misc_feature 25: k=g or t
  misc_feature 40: k=g or t
  misc_feature 46: y=c or t
  misc_feature 54: y=c or t
  misc_feature 60: w=a or t
  misc_feature 73: y=c or t
tgcagtgacacagtcabagckcgckgcggcctcgacctckcgggcycaggtgayccttcwacctcggccaccycagtagctggtac

SEQ ID NO: 28009 - DNA, 76 bp, Homo sapiens
  misc_feature 14: w=a or t
  misc_feature 15: n=a, g, c or t
  misc_feature 16: w=a or t
  misc_feature 18: r=a or g
  misc_feature 42: m=a or c
  misc_feature 44: r=a or g
tagggcgcgcagawnwgrccctgactgggtgcttgccctggmarcggcgcgaatggcggctgcacccagctgaggt

SEQ ID NO: 28010 - DNA, 221 bp, Homo sapiens
  misc_feature 12: v=a or c or g
  misc_feature 87: m=a or c
  misc_feature 104: m=a or c
  misc_feature 105: y=c or t
  misc_feature 113: w=a or t
  misc_feature 163: m=a or c
agcagcgacggvagcggtgtgggccgccatcttgggcaacggatccaacctttgaaagcccacctgctgatcctccacctgaccggmgcccgccgtgcataggmygatagggwgacgtgcggggtggacggactgcgggacatctgaaggaagggctcaaggmgcgccaagctcaaagctgggccgccactctagaccgtggagggaagcgcccgggccaa

SEQ ID NO: 28011 - DNA, 308 bp, Homo sapiens
ctttcccctgctgagttggaaattccagtgcagcactgattgaccacagttgccaatctaaaagcacaaagacagaagtaaagctttatgctaattttatttcaatatgatagaaaaatttatcttggtatgtccttttttagataactccagcaggaaactgtaactgctatgtctttaggaaaatgtagaagaaagaacattattattctttaattcctacaaggtactcgaaaaccttaagtgaaaaagatttctatctttttatcttagcgcatttatggaaaaaatattaactatcctgagct

SEQ ID NO: 28012 - DNA, 352 bp, Homo sapiens
  misc_feature 112: r=a or g
gacgtcataaagaggtgcagggaaaagacaagatggcctaagaccaagctctgaggaactccgacatttagaggtcaggtggagaacaagttgccaaaggagaaagccggcraactaagaagaaaatcaggaggatgcggacttctggaacccaaaagaaaagagtgttccaaaaaaggaatgggaaactgtgctgaaggctgcagagacatgaagcaagcctgccctgagaagtgtgcagtggattgggtagaagccactgtagctctgcctacggcatttgcaatggcccagatgtctcttccccgtgtgccgacttggtgtacatccaatggctgactgaatatcccca

SEQ ID NO: 28013 - DNA, 82 bp, Homo sapiens
  misc_feature 30: s=g or c
caattctctgcatttggtgtttcagaggasactgcaatacgaaacacctgtgggagtgccctctttctgcttctaggaatct

SEQ ID NO: 28014 - DNA, 318 bp, Homo sapiens
  misc_feature 16: d=a or g or t
  misc_feature 17: d=a or g or t
  misc_feature 98: d=a or g or t
  misc_feature 107: r=a or g
  misc_feature 166: b=c or g or t
  misc_feature 167: w=a or t
  misc_feature 294: r=a or g
acctaaaggtatgagddgctgggtcatgtagtctagctttttgcctgggaagaagaggaaaatatatttagacgaacaaccagaaatctatttctatdctctggaaragcttgtataaggtttttttaattacttgacctattttcttgctgctggtgctgtcacbwtgggaattggtttctttgctttggcatcagctttgtggttcctgatttgcaaacgaagagaaatatttcaaaattccaaatttaaagcaattgatgagagatgcaggcaaagaccatcaatggcgargattaaatctcattctcagtgtgt

SEQ ID NO: 28015 - DNA, 408 bp, Homo sapiens
  misc_feature 85: y=c or t
  misc_feature 101: k=g or t
  misc_feature 102: w=a or t
  misc_feature 107: s=g or c
  misc_feature 230: w=a or t
  misc_feature 257: s=g or c
  misc_feature 261: k=g or t
  misc_feature 275: s=g or c
  misc_feature 369: s=g or c
  misc_feature 372: m=a or c
  misc_feature 375: m=a or c
aagaggttacctcccatcagccccggcgctctctcatcccttctctcttccttggtgcttctttttcctgctcggtgagtttgtytgtttgtttgtttttkwgacasagtctcactttgcttcccaggctggagtgcagtggtgcgatctcagcttactgcagcctccgcttccggggttcaagcgattctcctgcctcagcctgccaagtagctgggactaccggcgcwccaccaccacgcctggctaatttttcsaatktttagtagagagtsggtttcactatgttggccaggctggtctggaacgcctgacctcaagtgatccgtccgcctcggccttccaaagttctgggattacaggcgtgascamcgmgcccggcctgagtgagtcttaatccgtggcgtg

SEQ ID NO: 28016 - DNA, 349 bp, Homo sapiens
cacaatctatttttctgaacatctgtatgcttttcgtatttaatttattgtttaaagaatttttgcggtttctcttgtgtttagagttacgtaaacagcatttgcattagattcagtggtaatatacagttgcattataatatacttactataaaaagtaaaaattattcatgatttttttgctggtaagtttgagtttttaacttaaattaagttgccttaatttcataaatttcagtgcaatttcttagcatttttattgaagtgaagaagctatgtagtcattgtgccttatttttaaattgctctggtactttcagtagggaatattattaacatgaacccctag

SEQ ID NO: 28017 - DNA, 171 bp, Homo sapiens
atatgtggcagtgtcataggataatagtggagagatggtcagcagataaacacgtgaacaaaggtctctggttttcctagacagaggtccctgtggccttccgcagtgtttgtgtccctgggtacttgagattagggagtggtgatgactcttaatgagcatgcagccctc

SEQ ID NO: 28018 - DNA, 205 bp, Homo sapiens
acacaagacgccggagcttcacaagggagcgaacgagggtgtttataagaatggaagtgttgtttccttgcccgattccttcatgctatatctcatgaacctctgtaatcttgggggagagactatatttaatgatgacaaacctgtcaccagtgtagcaacaacagtgtgaggacaaaagcaaataaaaattaagaagcgtggt

SEQ ID NO: 28019 - DNA, 186 bp, Homo sapiens
acttcttgggacggctgtagacattaggggaaagcagagtttaaaggcaaggaggcagggagaatattcccagatgtgattgaggcaggaaacatacacagggtttggggaagttgagaagaatggaagctgcattgaggacaaagaagaacagaatgtgcagctcaatggggaagtagaggggcc

SEQ ID NO: 28020 - DNA, 95 bp, Homo sapiens
ctatttaaaagtacctttttgttttaagtgatagtaaattaaacatcttttttccatttaaatttcttgcttttttcttttttttttttttaaaa

SEQ ID NO: 28021 - DNA, 127 bp, Homo sapiens
acccacagtgcccagtccctttccgttacttcttccttcagttctcttggaaaatgaaaagaaacatggaatgtaagtagttgtagcttcggtgacccctgtgttcctccacattcttttttttttt

SEQ ID NO: 28022 - DNA, 145 bp, Homo sapiens
  misc_feature 145: s=g or c
agccaggcaaggtggctcacgcctgtaatcctagcatttttggaggctgaggcaggcagattgcttgagcccaggagttggagaccagcctaggtaacatggtgaaaccccatctacacacacatacacacacacacacacacas

SEQ ID NO: 28023 - DNA, 209 bp, Homo sapiens
  misc_feature 13: s=g or c
agagaagattttsaaggcggcttttgtgctgacggccacccaccatcatctaaagaagataaacttggcaaatgacgtgcaggttcttcaaggcagaataattgcagaaaatcttcaaaggtattcatcaaatttttatctctagcttaaaccaaggaccacctgggcactctatgtcacttgaagaggggaacatttcacggttgggg

SEQ ID NO: 28024 - DNA, 206 bp, Homo sapiens
actacaaccaaattaatccagcaagctaaggctcagatcactgtggatatgtccaaatcctccatgagaccaagctgcagtgaaacagaatgaaccatgtctaagaatacctaaaattgtgaggaagaattggaacagaaaccagatacatcttagagaaggctttccacctgtgcacagtggaacacttacagtatcctccacgt

SEQ ID NO: 28025 - DNA, 181 bp, Homo sapiens
  misc_feature 30: b=c or g or t
agttggaagagtactggccctgggaagacbcagctttgagcctcaggttgtgtctaatcatctctctgtccttgggccagtcaactcacctgttcgtgctgccacagagacagaggggccacatcagagagaaagactctacagcttgcccagagtcgagcttaaatggagcagcatgatt

SEQ ID NO: 28026 - DNA, 94 bp, Homo sapiens
tagtagagacgaggtttcaccgaattagccaggatggtctcgatctcctgaccttgtgatctgcccgccttggcctcccaaagtgctgggatta

SEQ ID NO: 28027 - DNA, 167 bp, Homo sapiens
gagtgaaactccttctgaaaaaataaagagaacctatcttctttcaagccagcctgtcatgtgtcagaactaaacagtcattttccttataattttttttaaaggcccagttgctgcctgcccattgctgatgcaggaagtctgagccattcagttaacaccaaccc

SEQ ID NO: 28028 - DNA, 87 bp, Homo sapiens
cctgccccagcctcccgagtagctgggattacaggcgcatgccaccatgctcagctaattttctacctttttttttttttttttttt

SEQ ID NO: 28029 - DNA, 341 bp, Homo sapiens
aaaagatgtagctgtacatggagatcttgctgggaaaatccgcttgctcccctcacgtcgtccagcccaggagaaccaccgccgtcaccccggagcttcctcggccaccgcgcagagccctccgagagcccgagccgcggtcttcgagctccaaggctcattcagggccccagatccttgccccgaaaggagaggatctgagaaaatggatgcactgagacctctctgaaaaccctccgagagagcgcgagaggagcgaggacacgttactcgcagctaaaatcacatttaaggaccaaaacaacaacaaccaaaaatttcattaaaacaataagcgccag

SEQ ID NO: 28030 - DNA, 122 bp, Homo sapiens
caataattcccattaattattatttagcattacatgtgtgtacttgtagacttattttcattctgttatcttttaaacctatagatgggtggtttctttagcatggtttttttttttttttt

SEQ ID NO: 28031 - DNA, 128 bp, Homo sapiens
tgatttcctttgggtagatacacagtagtgggattgctgggtgaaatggtagttctgtttttagttctttgggaaatgtccattctgttttccatagaggttgtactaatttacattcccaccaacac

SEQ ID NO: 28032 - DNA, 146 bp, Homo sapiens
atatgctctttttgcctaaatgttcataagattttttttcttcaaatatagttaattttactagaagattgttggtcattctgagttggtatctctagataccatgatatgctctttcaatatatagtttccagtctttttttttt

SEQ ID NO: 28033 - DNA, 178 bp, Homo sapiens
acccttttttggtcaggcatattttactcagtatagttattttgagattcatccatgtggtagcatgtgtcacgagtttttgtttttatgtttttcattgctgagtactgcttcattgaatagatttgttcattgacctatcgatggacacctgggttgtttccagtttggggctaat

SEQ ID NO: 28034 - DNA, 389 bp, Homo sapiens
  misc_feature 108: d=a or g or t
  misc_feature 110: w=a or t
  misc_feature 111: h=a or c or t
  misc_feature 126: s=g or c
  misc_feature 226: r=a or g
  misc_feature 259: w=a or t
  misc_feature 363: v=a or c or g
  misc_feature 364: v=a or c or g
  misc_feature 365: s=g or c
caatattgtattgcctcagggaatagggagacccatagagagggagagagacaggggaatggctggtcagtggagcagtaagaacacacataatattgattgaggaadtwhtctatcttacatggsccgcagattgaggcaccgtaaaacaattatagtagtaatatcagagatcgcagatgactgtcacagatataataatttaaaagttttaaatattgtaagrattacaaaaatgtgacatagagacacgaaggawgcacatgctgttggaaaattatgcttgacatggtgttgccacaaactcaataggtaaaaaacatagtatctgcagaatgtgcaataaagtgagatgtgcctgtvvsatgaatcatttattacgtgtatat

SEQ ID NO: 28035 - DNA, 283 bp, Homo sapiens
tgaattcccaccccaaatccgttcctcttttttaccacctttgcaaacgccatcaccatttatccagtttcaaaggcgtggaatcattcttctctcaaattccacttctagttcatcagtaaattctgttggcgttactctcgaaatgcctagtgaatctgaccattttcatatctctattgttggcctaatccaagctaccatctgctcttgtctgcactcttaacagtaaccttgtaactggtctccttgcttctaccctctgctccttcctccgtgccat

SEQ ID NO: 28036 - DNA, 182 bp, Homo sapiens
aacccgtttgggtctctttccacactgtggaggctttgttctttcgctcttgctgctgctcactctttgggtccacgctgcttttatgatctgtaacactcaccgcgaagatctgcagcttcacttctgagcccagtgagaccacgagcccactgggaggaacgaacaactccagatgcacc

SEQ ID NO: 28037 - DNA, 230 bp, Homo sapiens
  misc_feature 109: w=a or t
agagagagagagaggagccaccctgagaaggaagagaccaggtgggctctgagacagggagaccctttctacgtcggtgccttgacatgtgacttttttgtcacttcgwgctccagggatcacacctggatgaactatcactttcaaatgaccttgtcttttctcgggccttccgaactgatcatctcttccttctgatacaagaggatcttccctggaagaccactgcc

SEQ ID NO: 28038 - DNA, 268 bp, Homo sapiens
caaaagtatttactataacaattggggtatcctgacctagctcatatatcatgaagtgaatttaaatagagagatgctcaagcaatagaggaaacctgggcaattgttcttcctcttttaggtggagagtaactcatatttgctagaatgggaaccacctgttgaggattacatttccatgacgttttctgaatttaatccttatgtaggtgatgaaattcattcctttcaaaatcaagatgaaccagaacagtcatttgacccacct

SEQ ID NO: 28039 - DNA, 339 bp, Homo sapiens
  misc_feature 149: d=a or g or t
tttttagtagagatggggtttcaccatcttggccaggctgatcttgaactcctgacctcgtggtccacccacctcagcctcccaaagtgctgggattacaggcgtaagcaaccgtgctcggtcagatgtgcttatttctaagctgactdcttttttcttcattcacattatattgcacagcctcctgctttttaaaattctcgttgctgtaagaggtttttcctctcggaagtccaaggcctggcctatctgctgtgaagccttttcagggcatttccttctgagaaatatagcaggacagtgcttggcagatgactgtggggagattttttttttttt

SEQ ID NO: 28040 - DNA, 264 bp, Homo sapiens
  misc_feature 113: y=c or t
agtcccgggcgggccgtcgcgggagagaaataacatctgctttgctgccgagctcagaggagaccccagacccctcccgcagccagagggctggagcctgctcagaaggtggyttgaaagatgcccggaggcccgcctctgctgttggcagctgtgttgctgggcctggtgctgctggtggtgctgctgctgcttctgaggcactggggctggggcctgtgccttatcggctggaacgagttcatcctgcagcccatccacaac

SEQ ID NO: 28041 - DNA, 239 bp, Homo sapiens
gaagattccaacttcctgggcagagggtcatgtagtggaatagagctgtacctggcttcaggcgagacttgggttcactcctggcgagaaattttacctctggatgaatcacatcttgaatctcatgcatttagataatatttaggtgatatagtttggatgtcccctccaaatctcatgttgagatgtaatccccgtgttgaaggtggggcctgaccggagacgtttacctcacggat

SEQ ID NO: 28042 - DNA, 125 bp, Homo sapiens
  misc_feature 114: h=a or c or t
gtggagcgtttaggagtctcaacatgtaaagggtggttggagtttcaaagagctgagaaagaacttgacgagggatggcagagaggtacgaagttcaggaaagtgatgtcgtghagccaagggac

SEQ ID NO: 28043 - DNA, 204 bp, Homo sapiens
caactgcaaatcaaattcttcacattccagctacagtctttctttccccattgaatctcagtccctggccatgtggtcaaggtggctttctgttaagctaccctaatttcgggaatgggaggggagagaggagggccattacaactctgccttcaagactcatctcttaaaaacaaaacgaaacaaaactacaaccaccactca

SEQ ID NO: 28044 - DNA, 53 bp, Homo sapiens
attcttgagaactatagacaagaaatgagagagaactgggatagtctaaggcc

SEQ ID NO: 28045 - DNA, 331 bp, Homo sapiens
ttgaagaagagaaaacaaacagagacagctgaggttggcattcgaggaacagctggaagatctgatgggccagcacaaggacctctgggacttccacatgccagagcggctggcaaaaggagatttgtgccctggacagcagcaaggagcagctgctcaaggaagagaagctggtcaaggcgacactggaagacgtgaagcatcagctgtgctccctgtgtggggctgagggcccctccacccttgatgagggactctttctccgcagccaggaggctgcagccacagtgcagctgtttcaggaagagcacaggaaggctgaggagctccc

SEQ ID NO: 28046 - DNA, 365 bp, Homo sapiens
  misc_feature 267: d=a or g or t
  misc_feature 268: w=a or t
cacttctcaaaaacagcctttggttacttggtgcccaggggtgaggtggcctttcctggatttgcacagtgtgacctgagcgtgtggataactgtggccagttgagtggggggttgtcagtgcctgtgtgtggtggcaggagggctgcctgattgtcagggctcagatcccagaagaagcctggctctcagattcagggcctgtctctggggttcctcggcggtgtggtatttctgtctgagccagctcctgggaactgcttttccdwcctccaggaccctagggagggggctgtgctcaccctgggaacactgccatggtcaggatcttgattcctgggtagctgctgagggcccctcgccccc

SEQ ID NO: 28047 - DNA, 450 bp, Homo sapiens
  misc_feature 292: n=a, g, c or t
  misc_feature 325: s=g or c
gccgcagccatgaccgtggagttcgaggagtgcgtcaaggactccccgcgcttcagggcgaccattgacgaggtggagacggacgtggtggagattgaggccaaactggacaagctggtgaagctgtgcagtggcatggtggaagccggtaaggcctacgtcagcaccagcaggcttttcgtgagcggcgtccgcgacctgtcccagcagtgccagggcgacaccgtcatctcggaatgtctgcaagaggttcgctgacagcctacaggaggtggtgaactaccacatgatnctgtttgaccaggcccagaggtccgtgcggcasagctccagagctttgtcaaagaggatgtgcggaagttcaaggagacaaagaagcagtttgacaaggtgcgggaggacctggagctgtccctggtgaggaacgcccaggccccgaggaccggcccc

SEQ ID NO: 28048 - DNA, 306 bp, Homo sapiens
ctgttttatttttcttggtatccagatctgtacattgttgaatttggggtagagggaaaaagtgtattagcatgtatgtgtttatgtatttagagaccatgtcttgttctgttgcccaggcagtagtgcagtggtatgattttggctcactgcaacctccacctcccggcttatgccatcctcccacttcagcctcctgagtagctgagactacaggcgcatgccaccatgccgggctaatttttatgttttttttgtagaggtggggtttcactgtgtagctttcattttaaatgactcagtttt

SEQ ID NO: 28049 - DNA, 289 bp, Homo sapiens
  misc_feature 96: m=a or c
  misc_feature 110: r=a or g
  misc_feature 127: k=g or t
  misc_feature 138: m=a or c
  misc_feature 190: k=g or t
  misc_feature 199: k=g or t
  misc_feature 205: b=c or g or t
  misc_feature 221: k=g or t
gtgcctctccagccgcgcgcccgccctgggccgctagcgaacctttgcgtccttctggctccagggaaaagttcgctgtttctccgccttttggcmaagatcaaggatartatggagcggggacgakgggtggggggmaaagttcgcgggtcactggcagaaaacgcctctgatcgcgtgttgcgttttkgttgttgtkgttgtbtgaacttctggagcaktcagtggtgctgataacgctcctcagtcctctgctggtaaccatcagggctaggcgcttctcctgccc

SEQ ID NO: 28050 - DNA, 294 bp, Homo sapiens
  misc_feature 16: k=g or t
ttttgtcttctgtttkaaaatgtatatcctcccagtagagtgcacttgttaggtcctttttaccttagttttattagcataataacttgctggttgtcaaaattcccaagttaaaaactaacgagttactgtaaattttattcttttgtctgattggaaggatattaagaatactgactgcctgatggaggagtggaactaggttcaggttactctatgtacttctccttctctgatagctgctgattatattcagtgctatgttttctcagcagttggaataatctgcctcaa

SEQ ID NO: 28051 - DNA, 140 bp, Homo sapiens
agcaaggaagagtttgctggcagaatgttgcaggtgtcacaccttggattcaccatagctggctgaaactagcagcagcagtgactcccgactatgaccagtggattaaccaacaagaccctgattgccccacccgaata

SEQ ID NO: 28052 - DNA, 414 bp, Homo sapiens
  misc_feature 15: k=g or t
  misc_feature 229: d=a or g or t
  misc_feature 323: n=a, g, c or t
  misc_feature 356: r=a or g
agtacagttcctctkctccttatcttagtaaaagaaggcctccttagcctcagactttcatatatttggctgcaagagagatatgaggggatagagagcgagaagaggtgaactttggggaatgtattgttcatgaagagagactatgtccccccaacctgctcccagagggggaagggagaggggtccatgatttctcctcttaaggtaatcacctgtgaagcttagdgatgacttcaagagggagaggtgagagagatttattagcattagactgttttaattcaaatatgccttctcatttttaagataactattaaacngaagcagaacaaaatgtagactttcaaaaccaraaaggtaatagacaatatttgataaatataacaaacaggagaaaatgagtgaaaaaga

SEQ ID NO: 28053 - DNA, 326 bp, Homo sapiens
  misc_feature 121: m=a or c
  misc_feature 127: w=a or t
  misc_feature 144: y=c or t
  misc_feature 145: b=c or g or t
  misc_feature 158: b=c or g or t
  misc_feature 214: w=a or t
  misc_feature 215: k=g or t
  misc_feature 264: w=a or t
  misc_feature 265: d=a or g or t
  misc_feature 275: m=a or c
tggctcattgcagcttcaacctcctgggctcaagctatcctcccacctcagcctcctgagtagctgggactacaggtgtgggccaccacacccagctatttttgtttcaattaaaaaaaamaatttwtttttttagagatgggybtcactatgttgcbcaggctggtctcaagcaatccttccaccttggcctcccaaagtgctgggattacawktgtgagccaccatgcctggccaaaaacttgatttgtatgtgatatgaawdtacgctgatmatacacatatttaggtctttaaagagttttgctttttaaatttcagatttc

SEQ ID NO: 28054 - DNA, 107 bp, Homo sapiens
  misc_feature 8: n=a, g, c or t
  misc_feature 9: s=g or c
cccaaatnsttctcatcttggaaaactgaaactctatacgtattaaacttcccattcccccagcccctgacaatcaccattctaccttctagctctgtgaatgtcac

SEQ ID NO: 28055 - DNA, 114 bp, Homo sapiens
cttttcttttgcatttcttctccgcgtatttcccctcctctcagccccttcttaccgccgaactccttctttatcaccatctatgccctccccatccccctcagcctcttcgga

SEQ ID NO: 28056 - DNA, 85 bp, Homo sapiens
  misc_feature 34: s=g or c
aatggctgaggaatgccccagagcgtgcgcggasctgtggcgcccaaggccacggccccgccggagaggaccagcgactactacc

SEQ ID NO: 28057 - DNA, 420 bp, Homo sapiens
  misc_feature 107: k=g or t
  misc_feature 110: d=a or g or t
  misc_feature 111: w=a or t
  misc_feature 114: k=g or t
  misc_feature 138: k=g or t
  misc_feature 347: w=a or t
  misc_feature 348: n=a, g, c or t
  misc_feature 349: n=a, g, c or t
aatgtcctagttagacacaggacctgctgggccacagaaaggaggctctgggtagacgcactagattactggataaatcacttcaatttcccaatgaattttatatkgtdwatktttataccctggagttttttcctkaaaaaagtagcactttgaagcctactattgaagcattgcctaatgtgctacctttaaatgaagatgttaataagcaggaagaaaagaatgaagatcatactcccaattatgctcctgctaatgagaaaaatggcaattattataaagatataaaacaatatgtgttcacaacacaaaatccaaatggcactgagtctgaaatatctgtwnnagccacaactgacctgaattttgctctaaaaaacgataaaactgtcaatgcaactacatatgaaaaatcca

SEQ ID NO: 28058 - DNA, 180 bp, Homo sapiens
gtgacctttcaaagctgccaagtgggcaagcttccagcagcagtctgggagcgagcgacagagccaccaagctgggcggcagggcattgagcctcgcgtttcaatttctgttcagttctcctgtaatggaaaattgctttgcacaaagctaaagtgttacagttctttccagcgcccctc

SEQ ID NO: 28059 - DNA, 107 bp, Homo sapiens
  misc_feature 80: m=a or c
gacacaagttactccattttgattctaacaactttttcacaaactatgtatgtatttggaattatttcaaagttgtatgmcatatacaatatgtagtcttttttttt

SEQ ID NO: 28060 - DNA, 174 bp, Homo sapiens
  misc_feature 16: w=a or t
  misc_feature 113: m=a or c
  misc_feature 119: r=a or g
  misc_feature 121: s=g or c
  misc_feature 133: k=g or t
aagatttctgaagggwatctggcaatgtgtatcaagaaacaacaacaaaaaattataccctttgaaccagtttggggcaggaatgtatacataagtctggaacatcttgccamaccagrasacaaaggatcakctgttagcgatgacaacagaaggatcatctcagaaggaccc

SEQ ID NO: 28061 - DNA, 61 bp, Homo sapiens
atatattatatctctatttaaataaatgtcccaggtgattctgtagttgcagcaggtgttt

SEQ ID NO: 28062 - DNA, 97 bp, Homo sapiens
actgggagggcacaggcgcttgcgagtagggtggccgctcccggccgcgtgcagcgcgaaacgtcggcgcaggcgccaaggctctggcagttggcca

SEQ ID NO: 28063 - DNA, 156 bp, Homo sapiens
agagaggattcctacatggagtgggagactgaaataataacctcaaagatgccttccaatcagaagatttggtgattctttctgagttatcaaactgccttcctttgaccttgctcacatgtagaaatccaagtcagcgcagttaacttggactcc

SEQ ID NO: 28064 - DNA, 247 bp, Homo sapiens
  misc_feature 202: n=a, g, c or t
agatgtttgggcttcaaggcatcattggcagattactcctgaagaaagacaagttcaggatatgctggtttcagctttggacaaagtattaatccaagacaagaacatagatggcgcctttttgccctgttgaccctttgccacctgctccctccaggagagaaccttggtggtgaaacagctaatggttcacatcctttgncccaccgtgatgtgcttcagaaaactactcatttgagcgacaact

SEQ ID NO: 28065 - DNA, 57 bp, Homo sapiens
  misc_feature 20: w=a or t
  misc_feature 23: w=a or t
  misc_feature 32: k=g or t
  misc_feature 34: w=a or t
tgggacaggagggggctccwtcwccagatgakgwccctggagggggcaggaggtacc

SEQ ID NO: 28066 - DNA, 315 bp, Homo sapiens
  misc_feature 120: w=a or t
agttgctctttggagcacccacttcacttctcccatgtagttcctgagtgcaggactctcctgaagaaggggcgtctaaaaggccagcccatgcatcttgttcagaccaggctgctccawctccgctaagcccagggatccacttaacctcgtcgcgacatttctcagaagccatgacatgtccctgcggctggaggcctttcaagggtggcccaggaggcctcaagggcccggtgtggcctgcaaaggaagagaacagctgttctcacggaaggatccaaagggttcaaaggcgaagggtgccatctgcttccc

SEQ ID NO: 28067 - DNA, 141 bp, Homo sapiens
  misc_feature 13: k=g or t
  misc_feature 17: w=a or t
  misc_feature 55: r=a or g
  misc_feature 56: r=a or g
  misc_feature 96: k=g or t
  misc_feature 136: m=a or c
tataaataatttktttwccttttttgtgatggaatctcactctgttgccaggctrragcgccatggtgcaacctcagcctcctgggttcaagttaktctcctgcctcagcctcccaaatagctgggactacaggcmtgtgc

SEQ ID NO: 28068 - DNA, 205 bp, Homo sapiens
ggttcaagtgattcttctgcctcagcctcccaagtagctgggactacaggcatgcgccaccatgcccagttaattttgtatttttagtagatacggggtttcgccatattggccaggctggtcttgaactcctgacctcgtgatccacctgcctcggcctcccaaagtgatgggattacaggtgtgagcctccgtgcccggccca

SEQ ID NO: 28069 - DNA, 250 bp, Homo sapiens
  misc_feature 126: m=a or c
aatagattctacccgttaatggaaagagtggcaaagcatttgtgaccatctttaatctactacaaattttccctccatctgttgaatctggattaatcttcctaaaatattagtttttatcataamatttgatggctccttatttagtataggtaaaaagtgttaagttcttaagcctaagtttgaaggtctcttcattttaggttttaacatgcatttctaaactttatccacttcttttccctcagcc

SEQ ID NO: 28070 - DNA, 195 bp, Homo sapiens
  misc_feature 137: w=a or t
ttttgtcttttcagtagtgatggggttttgccatgttggccaggctggtcttgaactgctgcctcaagtgatccaccggccttggcctccctaagtgctggggttacaggtgtgagccactgtgcctggcctgtatwttctttaaagtgttaccctgattctaacaacgtacttctttgagaactaccggccacc

SEQ ID NO: 28071 - DNA, 72 bp, Homo sapiens
  misc_feature 45: w=a or t
  misc_feature 46: w=a or t
  misc_feature 65: w=a or t
acggttgtgcctttccatgtttagtgcttccttcaggagctcttwwagggcaggtctggtggtgwcaaaatc

SEQ ID NO: 28072 - DNA, 399 bp, Homo sapiens
tatttatttatttattaaacttccttgttaaaaactaagacacacaccttagtctgggcctacacagggtcagtagaaccccatcactgtcttccacttccactcttgtcccactagaaggtcttcagaggcaaaaacaggcatggagctggcagctcctatgaggataatgccttcttacagatacctcctgaagaagctgcccggggctattggcagttaactttttaaaaatatgtaagtagaaggaacacagtctaaaataatgataaatagtatagtgaacacataaaccagtaacatcgttgtttgtcaccaccgtcaagcattacgtgctgtaattatgtgctagactttcatactcccagcagcccagcaggtttacttacaccagcatct

SEQ ID NO: 28073 - DNA, 252 bp, Homo sapiens
agattacgtgaagtatctcttcatatgtttattgaccatttgtttgctcttcaatgaaatgcccatttgtggtcgggtgcggtggctcacgcctgtagtcccagcactttgggaagccgaggtgggcagatcacgaggtcaggagatcgagaccatcctggctaacacggtgaaaccccatctctactgaaaaatggaaaaaattagccgggcgtggtggcgggcacctgtggtcccggctactcggggggc

SEQ ID NO: 28074 - DNA, 331 bp, Homo sapiens
  misc_feature 167: r=a or g
actgcctctgacctctctatggcaagccaaatggccatgggaagaccccatggagtgtcagaatgatgccgttgagggcaaggattttagaccggtcatggattctgcctgtgcactgggctctaccactttctagctatctggctactagcaagttaccttaacartctaagtttcaacctccccattcgtgaaatggagatgatgtcttagtcatagaagtagcaagtctactgcatatcaacagtgtagcactgagcctggctctttgtaagtgttcaataaggaaacaggccgagagacgcaagtcaaacagcaaaggatggtctgc

SEQ ID NO: 28075 - DNA, 363 bp, Homo sapiens
  misc_feature 348: r=a or g
  misc_feature 349: n=a, g, c or t
  misc_feature 350: n=a, g, c or t
cttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgrnntctactccccccc

SEQ ID NO: 28076 - DNA, 395 bp, Homo sapiens
  misc_feature 117: r=a or g
  misc_feature 248: n=a, g, c or t
  misc_feature 299: r=a or g
  misc_feature 332: n=a, g, c or t
tatttgatgggaagaagtcaaagatgactaaatgtgccagcttgaagagaccttataaatgaggaagatgtaaacccatttatgccggaagctgcaaatttttttgtgaaaaatcaraccttggtgatgacctcgagcagtgtatataaataactcccaccagcctagcgttccaataatggaacactaggcataaatgagttaattgagatagtaaatataggactagggagagtggttgggaaggnaggtaagatagagtttgtgaatatttgaggactgggtgacacatatgcagraatgcatatctgagacttagaaaagttaggctngagatagggattaagaaaatcacaccaaactagaagatggggtttcaccatgttggccaggat

SEQ ID NO: 28077 - DNA, 240 bp, Homo sapiens
  misc_feature 118: k=g or t
  misc_feature 127: w=a or t
  misc_feature 129: w=a or t
  misc_feature 138: y=c or t
  misc_feature 232: r=a or g
cagtgatgatgacctttttgttcttggccacataaatgtcttcttttgagaagtgtctgtgcatatcgtttgcccgcttttttgatggggttgtttgatttttttcttgtaaatttgktttaagttwcwtgtagattytggatattagccctttgtcagatggatagggacgaggcttttttaatttttaatgtaacttgaggaggaactaactagagaatactagaattaragagggac

SEQ ID NO: 28078 - DNA, 115 bp, Homo sapiens
actagcatttcatgtttttatctctctctactgcattctgggtagtttatgccatgataatttattcagctctctctgctggatttattattttctttttagttgtgtttaatct

SEQ ID NO: 28079 - DNA, 135 bp, Homo sapiens
ttcagtccctaaaaaatgaaatggaaaaaagtggtgctaaatcgagtcagagatattacaggagagttttagagcttattatttcctgtggccagtgcttgtcctggcagtaaggctctcccctgtaacaagcca

SEQ ID NO: 28080 - DNA, 189 bp, Homo sapiens
  misc_feature 113: w=a or t
  misc_feature 119: k=g or t
acccctggagaaagggaagtacatattggagactgcagtggaagatggtagaaaagaagtgaatcagcaacttatgaggcaaatgcattaaaagcaaaatacccaagtggtawatttgktagctcattctcttaagtgctacatcttactgcttgttttgtattgctagttcattcttttttttttttt

SEQ ID NO: 28081 - DNA, 87 bp, Homo sapiens
agaccgaagaaggtttggtggatagcagaacctttttgtctccctctgattgctcctaagcctcacgctcccttgccccgcgtgtcc

SEQ ID NO: 28082 - DNA, 102 bp, Homo sapiens
gttcaggcatgtgttatagtgcttttggctgtgagtttgatattaatcaacaatatatagtaaataagaggccaggcatggtggctcattcgtgtgatccca

SEQ ID NO: 28083 - DNA, 147 bp, Homo sapiens
  misc_feature 131: k=g or t
  misc_feature 142: s=g or c
actcgcgccccctccctgccccttctcacgcgcgcctccaggagggacgcctccttcttaagtccccggcccctcccgccaacggtcaccgggattcctggaagagacggggatttgggggaaacggagakggttctgcgasgagac

SEQ ID NO: 28084 - DNA, 98 bp, Homo sapiens
ctggtatatagtaaagatgctagtcaacagtaaaattaccaaatgggtgagctagaagaaagactgacacagagtgaatattcagctatcactctgta

SEQ ID NO: 28085 - DNA, 247 bp, Homo sapiens
  misc_feature 119: s=g or c
tctgtcaattccacacaatccttctacctctgctatgctgaacccctcattcaccctgcacctgccaactgcaaaatattgtctgaaagaatctttcacatgttcctgcttcctatggstgcaggaaaaggagaaaatgtgattgcatgtggtagttgtggtgatagacgtttagacaggacaggttaatttagcggattgtggacttaagattcaacctctatctggagaggtgaaaacacaaaga

SEQ ID NO: 28086 - DNA, 104 bp, Homo sapiens
  misc_feature 64: h=a or c or t
  misc_feature 66: m=a or c
  misc_feature 69: y=c or t
gcttcttcccagcgcgagttgctgctaacgctcctcctccagcttcccacccccgccgcccgchgmggyccggtaccaacgggtggtctcgccgagggagctgt

SEQ ID NO: 28087 - DNA, 330 bp, Homo sapiens
  misc_feature 128: s=g or c
  misc_feature 180: n=a, g, c or t
  misc_feature 222: k=g or t
  misc_feature 237: w=a or t
  misc_feature 259: y=c or t
tcttccttaaaaaggaaatacagtgatttgagctagatgaatccagctacattttacttttttttttgagaccgagtctcattctgttgcccagggtggaatgcagtggtgcaatctcggcttactgsaatctccacctcctggggtcaagtgattcttgtgcctcccaggtagctgggnactataggcaccaccacacccggctaatttttggtgtttttkgtttgtttgttttgwatttttagtagagacggggttycaccatgttggccgggctggctgcaaactcctgacctcaggtgatcagcccgcctcagcctcccaaagtgc

SEQ ID NO: 28088 - DNA, 233 bp, Homo sapiens
  misc_feature 178: b=c or g or t
  misc_feature 179: w=a or t
cactttgccagaaccgtgggtcttcatgaaataagagatttcatttggtttttgttttggtttgcatcctctctaactttaggtagaaattgctgttagggcaatcacctacctcactatattccactctctcttctggatattggtgctcagcccttttttgaaccgcaaaccttabwaataaaatagttttcattctttgagcgttcctcttctcactgcccaccccacga

SEQ ID NO: 28089 - DNA, 234 bp, Homo sapiens
  misc_feature 165: h=a or c or t
tgaatcctgaagatggaaatgtagcttaatgacctccttgtcctggagtctcccttaatacagtagagacggggtttccccatcttggccaggctggtcttgaactcctgacctcatgatccacctgcctagcctcccgaaatgctgggattacaggcgtgagchaccgcaccggcctcttctgtatgtcgtagagaagccttagtacacaatgaaatgtttcatcattactaa

SEQ ID NO: 28090 - DNA, 309 bp, Homo sapiens
  misc_feature 113: y=c or t
  misc_feature 131: w=a or t
  misc_feature 277: r=a or g
  misc_feature 278: y=c or t
  misc_feature 302: k=g or t
cccaaattcttctcatcttggaaaactgaaactctatacgtattaaacttcccattcccccagcccctgacaatcaccattctaccttctagctctgtgaatgtcacaagtayatcattatgtgggatcawacagtatttttttgtgactggcttattatacttagcatgatctacgttgtagcaggtgtcagaatttcgttcctttgaaaggctgaataatattccactgggtttagatacaccacgttttgttgacccattcacccatcaagggryccaagttgcttccacattttagckacagtga

SEQ ID NO: 28091 - DNA, 167 bp, Homo sapiens
  misc_feature 95: s=g or c
  misc_feature 96: r=a or g
  misc_feature 97: m=a or c
  misc_feature 110: w=a or t
  misc_feature 119: m=a or c
  misc_feature 131: m=a or c
  misc_feature 132: r=a or g
  misc_feature 135: m=a or c
  misc_feature 160: m=a or c
agactgtggctattttaacaccagtgacgtcatatcccattgatgccttaaggacacgatgagagaagtttcttctttgaacatcacacaaagcsrmatacatcagcagwctgagcatmcagagggcatgmrgtmtactcactctttggtcagaagaggmcaggact

SEQ ID NO: 28092 - DNA, 113 bp, Homo sapiens
  misc_feature 2: r=a or g
gratgaccttgtttgttcttttttgcacagtatgatttgtagtcatcttacctgatacaaatatagctattcctgctctttttaaagtttccgattgcatggaatatcttctc

SEQ ID NO: 28093 - DNA, 134 bp, Homo sapiens
  misc_feature 16: y=c or t
  misc_feature 17: y=c or t
  misc_feature 106: k=g or t
ccagaaaagaatttgyycatccctagactctggaacatgacactgactacccttatgtaactcccagcctgtgagtctcaagcctgtgactctaaaccttgatcakgtgcctccctctggtctttgccccagca

SEQ ID NO: 28094 - DNA, 252 bp, Homo sapiens
  misc_feature 191: n=a, g, c or t
  misc_feature 200: m=a or c
agattacgtgaagtatctcttcatatgtttattgaccatttgtttgctcttcaatgaaatgcccatttgtggtcgggtgcggtggctcacgcctgtagtcccagcactttgggaagccgaggtgggcagatcacgaggtcaggagatcgagaccatcctggctaacacggtgaaaccccatctctactganaaatggaamaaattagccgggcgtggtggcgggcacctgtggtcccggctactcggggggc

SEQ ID NO: 28095 - DNA, 389 bp, Homo sapiens
  misc_feature 158: n=a, g, c or t
tcatttaacttttaattgtctctcaagtgacaattacgctttgaatgatgggtcaaatgatgttatttattacaacactaggaacctgtttagtcaaatggagaagctacttttcaaaagatgggctttgaaattaatgtctagttttgcatgtggcntggttaatatctatttgggctgctttaacaagcactgggtagcttaaaaacaacagaactttatttctcacagttctggagactgggaagtccaagatcaagatgccagtatattcagtttctggtttgggcttattccacatagccagtgttttcttgctgtgttcccacatgatggaaggggcaaacaagctctttagcctcttttataagggcactaatctcattcat

SEQ ID NO: 28096 - DNA, 57 bp, Homo sapiens
tttgttctagtgctttcaagagcaagtacatcaaaatgtagaaggtaaaatgtatgc

SEQ ID NO: 28097 - DNA, 415 bp, Homo sapiens
  misc_feature 17: w=a or t
  misc_feature 245: y=c or t
  misc_feature 371: r=a or g
attccaagaagagagawaagcaagggtactctgtagatcgacacacagatatggacagaatattcaacattgattctggaaatggttcgatttttacatcgaaacttcttgaccgagaaacactgctatggcacaacattacagtgatagcaacagagatcaataatccaaagcaaagtagtcgagtacctctatatattaaagttctagatgtcaatgacaacgccccagaatttgctgagttytatgaaacttttgtctgtgaaaaagcaaaggcagatcagttgattcagacccctgcatgctgttgacaaggatgacccttatagtggacaccaattttcgttttccttggcccctgaagcagccartggctcaaactttaccattcaaagacaacaaagaccaacacggc

SEQ ID NO: 28098 - DNA, 188 bp, Homo sapiens
  misc_feature 16: k=g or t
gcttgtccttgaggtktactgtgtttggcatcgcagttccgacggcagccgccgtttcgcgacccacggcggacttgcataaacactttctagttggaatctcaccctgtgaggtgggcaaggtagtgatattcctgtttgacgccgacagaaataagagagattgactctcagaaccatgtggcggt

SEQ ID NO: 28099 - DNA, 157 bp, Homo sapiens
  misc_feature 108: s=g or c
  misc_feature 146: r=a or g
ctcttcacggagccgcgcggctgcgggggcgcaaatagggtcactgggccgcttggcggtgtcgttgcggtaccaggtccgcgtgaggggttcgggggttctgggcasgcacaatggccgtctcgagcaggcccgcgagcggccgrcaccgacggca

SEQ ID NO: 28100 - DNA, 417 bp, Homo sapiens
  misc_feature 78: d=a or g or t
  misc_feature 79: d=a or g or t
  misc_feature 115: w=a or t
  misc_feature 116: w=a or t
  misc_feature 154: n=a, g, c or t
  misc_feature 196: w=a or t
  misc_feature 308: b=c or g or t
tatttaatggctgttacatgtcaggtgctcaattaatatttgctgaatgaatgaatgaagatatatagatatgtaatddttattgtagaatattcttggatattttacaagtttwwtttttccttcaacatgggtacctgggtagttgctaatnatgtttgtttggtattgtattaacagctttattgagatatawttcatatcccctacaggttacccatttatttatttacttataacaatgacacaatcatgcagcctcctgctgtggtgactacagtcgtgcaccaccatgcccagcaaattcbgcagttttttgtagagatggggtctcactataatgcccaggctggtttcgaacacctgggcttaaatgatcctcccactagggcctgacaaaaaggcagataaatagga

SEQ ID NO: 28101 - DNA, 91 bp, Homo sapiens
ccaaatgcccagagtaacctgatatatttttcttcttactttcttttttttctttttctttttctttttcttttctttttttttttttttt

SEQ ID NO: 28102 - DNA, 217 bp, Homo sapiens
  misc_feature 130: m=a or c
agaaggggaagggccagggagccgttaacccccgaggctccgtgccgggtctcacctggctgaatgtcggcttgttgtgaagccgggagcaccggtccccgtgccggcagaccccgatcttaaagtaaamagagcagttaaccctggaagaggtgcaaagacaaaggggaaccgagggccggggaagctgggcaccccagaaacaccgccccaccat

SEQ ID NO: 28103 - DNA, 390 bp, Homo sapiens
  misc_feature 112: r=a or g
  misc_feature 285: m=a or c
tctgtgaatatttaaataatgtaattaaggatttactgctctgcccttctcttaagacttactctgctattcataatgaaggaaagatagaagaaaaataactttataaatraattttattcagaaacagaaattttgctttttgaagattctgttaaaaagtcgatctttagaattagcagtatctttcaaatttaagatcccagcttacaacaagcacgttttcattttgaagagtttttggcagagaaaaaagatatgggaaacaactggtataagataggmgaaaaagttaaaatatattacatttacagtaaataaaccgaacctttcttctttcttggagaagccttttaaaaaaattgcctaattctcaagtgagatgggtgt

SEQ ID NO: 28104 - DNA, 59 bp, Homo sapiens
aatatttcattttgaaaccatagtgaatcacatttgatatctctctttttttttttttt

SEQ ID NO: 28105 - DNA, 419 bp, Homo sapiens
  misc_feature 112: m=a or c
  misc_feature 218: k=g or t
  misc_feature 388: r=a or g
  misc_feature 395: r=a or g
cagcactattgtatccctagagtctggtgcctagtcagtactcaataaatattgcatatttaatgcaaaaatacccagcaacaggtaatgctgtctattgatggtgcctacmcccaagaaaaaggtaaaaccaggatttttatccttctagaagtggattttctatgcagttaatgaatttaaacttacaggtcccttacttgcatgaactcctttakagaccctggaagaggccttagtgatatttttacatggttacattttttcatgttgcaaaaataaaatactttaatcaaaattaagactcttgttttccgtctgagttcatatttcccctcctggagcggcgttggagtggctgtggatgttttggtgatctgtttcaggraaagcaragttgggagtatattttatattta

SEQ ID NO: 28106 - DNA, 143 bp, Homo sapiens
aaaagattggatcttctgagaacaccagagaaagactgaccttgctctccacactgcaataaaactttgtgatcttgaaccttaggttcataatctcacaaatgagaaggctccctccacactcttggaactgtacacccaca

SEQ ID NO: 28107 - DNA, 152 bp, Homo sapiens
aagtcttaaacaatcctcctccctctgcctcctgaagtgagccaccgtatgtggcctgccatttcttaattttagcatcgtttgctctctggagaggcttagaattttcaaaacttatcaagttctggcatttttgtttaatagtccctccc

SEQ ID NO: 28108 - DNA, 79 bp, Homo sapiens
ttttgtatttttagtagagaccgggtttcaccatgttaaccaggatggtctcgatctcctgacctcgtgatccgcccgc

SEQ ID NO: 28109 - DNA, 80 bp, Homo sapiens
  misc_feature 16: y=c or t
agatgagagtggggayttggatctgcctgccaggccatcctgggcgctgcaggaagcaacatgacttaggtaactgccca

SEQ ID NO: 28110 - DNA, 54 bp, Homo sapiens
tgttgtcagttttctgtctgctatttcaaaagtctttttttttttttttttttt

SEQ ID NO: 28111 - DNA, 408 bp, Homo sapiens
  misc_feature 316: n=a, g, c or t
agcttcttggcgcacaagactatcagtcccaccaatagcgcttcgagttgagcctcgcgccaccgctgcctctccctccgcacgtcctgcccgcccagactgtcttccccctttcgaggggctggagctcttttgtgctatgaagcaacagcctcaagattcagagctgttgctttccataactggaagtggcttctgatgaggaacatggtgtgtaagctgcaagagggctgcgaggagacgctagtgttcattgagacagggactgcaaggggagttgtgggctttaaaggctgcagctcgtcttcgtcttacnctgcgcaaatctcctaccttgtttccccacccggagtgtccattgcctcctacagtcgcgtctgccggtcttatctctgcaacaacctcacc

SEQ ID NO: 28112 - DNA, 240 bp, Homo sapiens
  misc_feature 116: r=a or g
  misc_feature 117: n=a, g, c or t
  misc_feature 118: n=a, g, c or t
caaatgaagaaattaaggcacaagacagttaagtaatttgcctaagattatacagttgctgggcgcggtggctcgcgcctgtaatcccagcactttgggaggccaaggcgggtggrnnacctgaggttgggagttcaggaccagcctgaccaatatggagaaaccccatctctgctaagaatacaaaattagctgggcgtggtagtgcatgcctgtaatcccagctactcgggaggcaga

SEQ ID NO: 28113 - DNA, 108 bp, Homo sapiens
  misc_feature 22: k=g or t
  misc_feature 32: h=a or c or t
  misc_feature 35: k=g or t
  misc_feature 44: k=g or t
cttcaggtcacagagattatckcttatgttthctkctggaaatkttacagttttggttcttatgttttagtctataatctattttgatatgtgggatgagttaagggt

SEQ ID NO: 28114 - DNA, 380 bp, Homo sapiens
  misc_feature 328: m=a or c
  misc_feature 329: r=a or g
  misc_feature 340: n=a, g, c or t
  misc_feature 341: w=a or t
  misc_feature 342: n=a, g, c or t
  misc_feature 343: n=a, g, c or t
aacaatctggtattgtggaaattttcttagtttttgtcttttaattgttaattaactgttgaaatatactatagcaaatgaaggaacgaacaaaaacaaagatacttggactcaatttaattcaacaaacatttattgcctgtggataaggccatatattgtaggtagataaaaaataaatgacattagctgtccttataaagatatctttatatatcatatatctttgaagatatgtttacgtatcatacacacacacacacacacacatatacagtatacctttgaacaacatgggtttgaacctgaaattttttgaagaattgcmrcaaattgaaanwnntcaacagatgaaccctataagcctagaaataccaact

SEQ ID NO: 28115 - DNA, 128 bp, Homo sapiens
agacggagtgtgggccatcgtccccagtggtgaccagccctgccatgggaaactatagttcccacaaaaggaccaaagcacccaagcaggcccgcaaggagaggccggcttgaacatggacaaggccc

SEQ ID NO: 28116 - DNA, 188 bp, Homo sapiens
  misc_feature 48: m=a or c
  misc_feature 56: m=a or c
  misc_feature 57: y=c or t
  misc_feature 125: y=c or t
  misc_feature 156: k=g or t
  misc_feature 161: y=c or t
  misc_feature 162: r=a or g
tattagctaagctagagaaagataagtaatttagtatattgatttttmaattttgmyatcacttaagtatttgatgtttatatttgatatttatcaaattcttaagttataaactacttattccytaagttaagaaatttataatcacagtttatkttttyracttgtacttcttgtacttcctaatt

SEQ ID NO: 28117 - DNA, 51 bp, Homo sapiens
  misc_feature 16: h=a or c or t
  misc_feature 17: m=a or c
  misc_feature 24: m=a or c
  misc_feature 43: m=a or c
tacaactgaagatathmaagctgmttttgcaccatttggaagmatatcaga

SEQ ID NO: 28118 - DNA, 365 bp, Homo sapiens
  misc_feature 116: r=a or g
  misc_feature 118: m=a or c
  misc_feature 196: w=a or t
  misc_feature 199: k=g or t
  misc_feature 244: m=a or c
  misc_feature 331: k=g or t
  misc_feature 339: m=a or c
  misc_feature 352: w=a or t
gacagcccctctgatgaggaggccactgggctgagaccaatgaatgagatggagccagccacgtggtgagccagaagagggcatcacaggtccatgaaatgggctcccgaagtccramctcacagaccccataaggaaaagcagatggaatctccaagggcaccagctatacatggtggtggaaggaccaacgcawgckctgaatgccactgcggaccacaggcctttctctgtccctcacgamctggcctcaccccgtcctgggctctgcagaactggtgcatggctctgcagggggtgaacccatggctctgccccttttctgattgakgaagctgmttggcctttctgwgtctcagctgatc

SEQ ID NO: 28119 - DNA, 127 bp, Homo sapiens
aaaataatgttgtaatgccgggcacggtggctcacacctgtaatctcagcactttgggtggccaaggagggcagatcacctgaggtcaggggttcgggagcagcctggcccaacatgatgaaaccca

SEQ ID NO: 28120 - DNA, 98 bp, Homo sapiens
  misc_feature 70: m=a or c
cttgatctcctgagctcgtgatctgcccgcctcggcctcccaaagtgctgggattacaggtgtgagccamcgcgcccagccaagaataaaatactctt

SEQ ID NO: 28121 - DNA, 125 bp, Homo sapiens
  misc_feature 15: k=g or t
  misc_feature 16: k=g or t
ggtttccttcacttkkaaaaccaccctataaattcccatattttttaaaggccctacttatttgatatttgtattcttaggtcttccaggccaaccctctttaagctaagattcacctctctgta

SEQ ID NO: 28122 - DNA, 249 bp, Homo sapiens
  misc_feature 11: r=a or g
  misc_feature 17: w=a or t
  misc_feature 26: v=a or c or g
  misc_feature 27: r=a or g
cttcccccaaraaacawcaacaacavracaaaaaccaaaaaggaaaatgtagcatgttggctaaaactggagcaaagtgcactaaaacaatttcctgaactcacctgttgtaactattcaccttttaaaccataaattgctctttagccatttgtagtgcagtaaatgttacaggaaaagacttggcacattttcttccaaattttaagaggtgattttcaaaagctttattggggtatgttgtcagac

SEQ ID NO: 28123 - DNA, 404 bp, Homo sapiens
  misc_feature 17: b=c or g or t
  misc_feature 18: d=a or g or t
  misc_feature 197: b=c or g or t
  misc_feature 298: h=a or c or t
  misc_feature 299: v=a or c or g
  misc_feature 322: w=a or t
  misc_feature 375: r=a or g
cttttactatggacagbdtaaaggagaagggcagccggaacagaagactcacaccacctttaaatgcctcagctgcgtgaaagttctaaaaaatgttaagtttatgaatcacgtgaagcatcatttggaatttgagaagcagaggaacgacagctgggaaaaccacaccacctgccagcactgccaccggcagtttbccactcccttccagctacagtgtcacatcgaaaatgtccacactgcccaggagccctctactgtctgtaaaatctgtgaattgtcatttgaaacagatcahvgtcctcttacaacacatgaaggwccatcataagcctggcgaaatgccctaatgtgtgccaggtttgccattataaratcgtcggtctttgctgatgtagaaacac

SEQ ID NO: 28124 - DNA, 220 bp, Homo sapiens
  misc_feature 93: r=a or g
  misc_feature 94: m=a or c
  misc_feature 130: n=a, g, c or t
  misc_feature 132: w=a or t
  misc_feature 133: v=a or c or g
  misc_feature 139: m=a or c
  misc_feature 144: m=a or c
  misc_feature 146: k=g or t
  misc_feature 155: y=c or t
  misc_feature 161: m=a or c
  misc_feature 185: r=a or g
  misc_feature 186: m=a or c
ttgcagggtcagttaagaaaaattttttttgagttataaggttcttttttaaaaacagtatcttgctgtcacctaccctggagtgcaatagcrmaatcctaatgaactgcagccttaaactcctgagttngwvatcctmcccamckcagcctttyggttgmcaagactacaggcacatcaccacrmctggctcatttgagaaatatttttctgtagacgt

SEQ ID NO: 28125 - DNA, 133 bp, Homo sapiens
  misc_feature 59: w=a or t
  misc_feature 60: r=a or g
  misc_feature 80: k=g or t
  misc_feature 119: y=c or t
  misc_feature 120: d=a or g or t
  misc_feature 132: m=a or c
tagggtacatgtgcacaatgtacaggtttgttacatatgtatacatgtggtatgttggwrtgctgcacccattaactcgkcatttacattaggtatatctcctaatgttatccctcccydactcccccctamc

SEQ ID NO: 28126 - DNA, 345 bp, Homo sapiens
  misc_feature 114: m=a or c
agcgcgggtgactacgcttatcaatccatcgtattcctttgtcttcttgtcacaaaaagaatttcgtcagtctggaaggggagttttacttacgtaaatggatgtagaccagamtcaagcatgttacaatcttaatctaaaagtggttcctgcttcataatgcctgtggacatgaagctaacaaatcttttcaaaatgtgttcatgtggtaattcactgcagcacaggagcaataatcagctatgtgcaggcatctatgctactgtctcttaaaatactttaaaagaccctgtgaggtgatattatgacctccccttccctatgcctcagaagaaattgaggcaa

SEQ ID NO: 28127 - DNA, 196 bp, Homo sapiens
  misc_feature 47: s=g or c
  misc_feature 57: w=a or t
  misc_feature 111: k=g or t
  misc_feature 112: w=a or t
  misc_feature 115: r=a or g
  misc_feature 120: h=a or c or t
  misc_feature 124: r=a or g
  misc_feature 191: m=a or c
agagctggacgggcgttgaggccaccctggccaggctgcgggcggastggtggaaawgcatttccaaaaccaccagctggctagaactttactggacctaaacattgaaakwgcrgcaahttgraaaaaggagtatgaactggaaaattacatcagactcccaaagcccaaaagatgatgccgaatccggmataaa

SEQ ID NO: 28128 - DNA, 207 bp, Homo sapiens
  misc_feature 123: w=a or t
  misc_feature 136: r=a or g
  misc_feature 167: s=g or c
  misc_feature 168: m=a or c
  misc_feature 169: m=a or c
tctgcttcagcctcccgagtaaaaggcatgcatcaccacacctggttaattttgtagttttagtagagatggggtctcaccatgttggccagactggtctcgaactcctgaactcggggtgawccgcctgtctcarcctctccaagtgctgggattacaggcgtcasmmctatgcccggctgggaatcatatgttccacacatgttt

SEQ ID NO: 28129 - DNA, 440 bp, Homo sapiens
  misc_feature 16: w=a or t
  misc_feature 17: w=a or t
  misc_feature 31: d=a or g or t
  misc_feature 32: k=g or t
  misc_feature 120: s=g or c
  misc_feature 127: w=a or t
  misc_feature 128: k=g or t
  misc_feature 307: w=a or t
  misc_feature 308: w=a or t
  misc_feature 371: m=a or c
  misc_feature 393: r=a or g
  misc_feature 396: d=a or g or t
  misc_feature 397: y=c or t
  misc_feature 421: v=a or c or g
  misc_feature 422: y=c or t
cagtaaatttttttgwwcattggttccttcdkcttggactctctgttagcacacctgatcagagttggccgtgttgtaattctttccctctctgctgcaatgttgtttacttctacctgscaactawkctttatactttccttttttgccatgaagggaatacattttttccttcttgttgggctatacagtgatcctcatcaacaaattatcaaagaactgtatgaggaaaaggtctctttttttaaaagtgaatcagggctggggagttaggaatgaagaggttttttttgtttgtttgtttgtwwtttgacgagtcttgctctgtcaccaggctggggtgctgtggcgcgatctcagcccactgcaamctccgactccctggttcaagcratdytcctgcctcaacctcccgagtagvygggattacaggcatgcgc

SEQ ID NO: 28130 - DNA, 358 bp, Homo sapiens
  misc_feature 16: k=g or t
  misc_feature 114: m=a or c
  misc_feature 126: w=a or t
  misc_feature 127: k=g or t
  misc_feature 220: r=a or g
  misc_feature 285: d=a or g or t
  misc_feature 286: v=a or c or g
  misc_feature 287: r=a or g
  misc_feature 297: m=a or c
  misc_feature 327: r=a or g
cccaaattcttctcakcttggaaaactgaaactctatacgtattaaacttcccattcccccagcccctgacaatcaccattctaccttctagctctgtgaatgtcacaaagtamcatcaattatgwkggatcatacagtatttttttgtgactggcttattatacttagcatgatctacgttgtagcaggtgtcagaatttcgttcctttgaaaggctgrataatattccactgggtttagatacaccacgttttgttgacccattcacccatcaagggacccadvrttgcttccamattttagctacagtgaataatgctactagraacataagggcacaaagctgggtctgtgaca

SEQ ID NO: 28131 - DNA, 67 bp, Homo sapiens
  misc_feature 3: k=g or t
  misc_feature 11: k=g or t
  misc_feature 25: k=g or t
cckcccgggtkcacgccattctcckgcctcagcctcccaagtagctgggtctacaggcgcccgccac

SEQ ID NO: 28132 - DNA, 379 bp, Homo sapiens
  misc_feature 118: y=c or t
  misc_feature 196: r=a or g
  misc_feature 335: r=a or g
  misc_feature 336: n=a, g, c or t
  misc_feature 342: w=a or t
  misc_feature 366: r=a or g
gaaggttaacaggagtagcaagagaagccaagacaagaagagggctttatttctgatactagaatcagccttcctcccctttattctctaggggacatttttctttgctgactcatcygttcagaaaagaagaccctgctccctatttggtgtacctcaagtctcacttcaacccctgtgtgggcgtcctcatcaracccagctgggtgctggccccagctcactgctatttaccaaatctgaaagtgatgctgggaaatttcaagagcagagtcagagacggtactgaacagacaattaaccccattcagatcgtccgctactggaactacagrnatagcwgccccacaggatgacctcaatgcrtcatcaagctggc

SEQ ID NO: 28133 - DNA, 184 bp, Homo sapiens
  misc_feature 118: n=a, g, c or t
  misc_feature 119: m=a or c
  misc_feature 122: m=a or c
  misc_feature 123: w=a or t
  misc_feature 132: m=a or c
  misc_feature 144: r=a or g
  misc_feature 145: r=a or g
  misc_feature 154: v=a or c or g
  misc_feature 161: r=a or g
  misc_feature 166: y=c or t
  misc_feature 173: r=a or g
  misc_feature 179: w=a or t
aacatggagcagagcagatgtgccatcatcaagaggcataatggaggagaaaaggatgttccatcaagaggcaacatagaagggagaaggctgtatcatcaataggcaccataggagnmagmwgaagggtamcatcaagaggcrrcaccaagavtagaagrgtgtytcatcgrcatgawggggt

SEQ ID NO: 28134 - DNA, 368 bp, Homo sapiens
  misc_feature 142: w=a or t
  misc_feature 154: k=g or t
  misc_feature 157: w=a or t
  misc_feature 164: k=g or t
  misc_feature 223: n=a, g, c or t
  misc_feature 224: n=a, g, c or t
  misc_feature 225: k=g or t
  misc_feature 226: n=a, g, c or t
  misc_feature 267: y=c or t
  misc_feature 270: k=g or t
  misc_feature 299: m=a or c
  misc_feature 330: k=g or t
  misc_feature 332: w=a or t
  misc_feature 343: r=a or g
  misc_feature 345: r=a or g
ttatttatctacattggataaggctttgtttacttctgaataggaagcattacacttaaagtgtaatgttctcagatagtcttatataggtatttattcttacatatgaacttatgttttagccataccctcttttgttttwtgtttttttttkgtwatttttkgtttttttgagatggagtcttgctctgtcctgagcccagctagagtgcagtggcgcaannkncggctcactgcagcctccgcctcctgggttcaagtgattcycckgcctcagtctcctgagtagctgggactamaagcgcgtgccaccatgcccaactaattttkgwatttttagtararacggggtttcaccatcttctcca

SEQ ID NO: 28135 - DNA, 103 bp, Homo sapiens
  misc_feature 7: m=a or c
aaaaagmgactagaacctgccattttgtctcatgcaagtagcccatcctgcactgtcccgggaagccccacagcccggatggccctcaggggggcctcgcggc

SEQ ID NO: 28136 - DNA, 68 bp, Homo sapiens
  misc_feature 15: r=a or g
cccaaattcttctcrtcttggaaaactgaaactctatacgtattaaacttcccattcccccagcccct

SEQ ID NO: 28137 - DNA, 383 bp, Homo sapiens
  misc_feature 279: n=a, g, c or t
  misc_feature 280: v=a or c or g
  misc_feature 373: k=g or t
cccaaattcttctcatcttggaaaactgaaactctatacgtattaaacttcccattcccccagcccctgacaatcaccattctaccttctagctctgtgaatgtcacaagtacatcattatgtgggatcatacagtatttttttgtgactggcttattatacttagcatgatctacgttgtagcaggtgtcagaatttcgttcctttgaaaggctgaataatattccactgggtttagatacaccacgttttgttgacccattcacccatcaagggacnvaagttgcttccacattttagctacagtgaataatgctactagaaacataagggcacaaagctgggtctgtgacaaccctgcttttaattcttktgtcacaagc

SEQ ID NO: 28138 - DNA, 221 bp, Homo sapiens
  misc_feature 73: w=a or t
  misc_feature 108: m=a or c
  misc_feature 171: y=c or t
tagcctcgtaaggactggaccacgggtgggcaggagaccggtggagaacccgccctgttgttggggctggggwgggccgcgcaccgagactaaattctccttccggcmagatccgctcaccaggccctggcgacctgagcatctacgacaactggatccggtacttcaacygcagcagcccggtgtacggcctggtccccagagcaagacttcagccagac

SEQ ID NO: 28139 - DNA, 94 bp, Homo sapiens
  misc_feature 73: k=g or t
  misc_feature 94: m=a or c
attttattaaaaacttgttttattggccggctgggattccaggtgtaagccactgtgcctgaccaagtttctktcttacccgtgcctccatcam

SEQ ID NO: 28140 - DNA, 250 bp, Homo sapiens
ttgattcattctgatagggtttttttgtttttttttgtttttgttttttgttttttttgagacggagtctagctctgtcgcccaggctggagtgtggtggctcgatttcgggtcattgcaaacttctgcctcccacccaggctggagtgcagtggctcgatttcgggtcattgcaacctctgcctcccaggttcaagcgattctcctgcctcagcctcctgagtagctgggattacaagcacccaccaac

SEQ ID NO: 28141 - DNA, 291 bp, Homo sapiens
agagagaatcaacagagctgcctctcaaggatgatctgagcctgctccctgggcacctgccctttccgagagcttgcttgcctcagtatgggtcagggaaggaggcacctacattttggcaactgtcttgagtggaggagtcgtctcccttgagagagtgtatcctgggctttccacctcctactggcaggagatcaggtcagaagttgagtagcaggggcctaggagggctcgaagccttcacagcgatggcagagaagcgacccctgagaaccctggggcctgtgatgt

SEQ ID NO: 28142 - DNA, 214 bp, Homo sapiens
  misc_feature 19: r=a or g
  misc_feature 111: w=a or t
  misc_feature 149: r=a or g
attgtgtgaaatagtataraaatcattggtgttcattatttgctttgcctgagctcagatcaaaatgtttgaagaaaggaactttatttttgcaagttacgtacagttttwattgcttgagatatttcaacatgttatgtatattggarcttctacagcttgatgcctcctgcttttatagcagtttatggggagcacttgaaagagcgtgtga

SEQ ID NO: 28143 - DNA, 407 bp, Homo sapiens
  misc_feature 18: k=g or t
  misc_feature 339: m=a or c
  misc_feature 362: s=g or c
  misc_feature 374: m=a or c
tttttttttttgcccagktttgggcacagaatgctaagaggaacgccaacagaatggagactcgatgccaatgaattgggaaatcatattatgtgacgggcagttgaagaaggcatgtctgtaaaattgaagaagagatttcttagaatgacctcagtaacaagcttaaatatttaagtgtctggtgaaagtaggggtgggatagtctctgatgtgctacaagatcgaagaaggagttaagtccttctctagagcctcaaacccctgctcagcatgaaaaaaccaacagaaacccgagttaacatctccttgcaaatatctgatctgtttttccaatamatctgctcatcttgtttcaaaasgagtaagctgtmaccattcttaaccctgtcgtccaaaccaggccc

SEQ ID NO: 28144 - DNA, 117 bp, Homo sapiens
tacttgtcgacaaaaggcatctcttaattggcacatgaagaaacatgatgcagactccttctaccagttttcttgcaatatctgtggcaaaaaatttgagaagaaggacagcgtaat

SEQ ID NO: 28145 - DNA, 233 bp, Homo sapiens
  misc_feature 122: n=a, g, c or t
cttactgaacattgttcttgatattgtatttagtctttagtcaggttctaacctattttctgagttatttctctagttcttccttttgagtatactatgctctatttcctgtgtaactaggnaatccagagtgagattagcagttcttaatagcacctgacctactgatgtgggagcattttgacagaatcctccagatattagtggtatgactagcgcaatgaattggacct

SEQ ID NO: 28146 - DNA, 99 bp, Homo sapiens
agttaagaaaagcaggcgttttagtggagaaatggggaacagcatcaagaaaggcttttttccttttttcttttttttttggagacagagtcttgccct

SEQ ID NO: 28147 - DNA, 366 bp, Homo sapiens
  misc_feature 114: v=a or c or g
  misc_feature 116: w=a or t
  misc_feature 118: w=a or t
  misc_feature 119: y=c or t
  misc_feature 129: w=a or t
  misc_feature 184: w=a or t
  misc_feature 264: w=a or t
  misc_feature 277: w=a or t
  misc_feature 287: s=g or c
  misc_feature 358: w=a or t
gtaattttaaaaactacgatatgcttgcagaaattcattgagaagctgttataaaaaatgcagtgaagcatgaccaaatagctaaaaatattactgaatctttacaaatatatvawcwytatttgttgwactgtggagtgcaaggatactaaatattggctattgataaaatactaacttgcawttcatggcaaatagatgttatatcgcttgattagtctagaacatttctaatattttgtgctttcatatatcaaaggagawtatgtgaaactawttttaaatastgtaaagtgacatatagttataagatatatttctgtacagtagagaaaagagtttataaacatgaagaatwttgtacca

SEQ ID NO: 28148 - DNA, 336 bp, Homo sapiens
  misc_feature 291: r=a or g
  misc_feature 306: s=g or c
  misc_feature 307: r=a or g
aaattaattcaatcaacaccttcaaggtgttattattacctacaactattgtttacaagaggtatgcaccgtggaagatcctggagacacaacaatgaataaagccaagccagttcctgcccccgtggagcttgtagtcaagacattgaacaagtgatcagaaagatgttgactgctgcagcagagggttgcaagctgctcatgagtatataacaagtagccctaaccaaagcattctctcccttggtttaatgtccacccattgaggtgactgctaaatactaatccatractctatcccttggsrttcaaactcacacatccacttacctgcca

SEQ ID NO: 28149 - DNA, 117 bp, Homo sapiens
gtgcaaaaaattggccgggcgtggtggcgcgcacccgtggccccagctgcttggaaggctgaggcaggagagttgcttgaacccgggaggtggaggttgcagtgagctgagatcgca

SEQ ID NO: 28150 - DNA, 132 bp, Homo sapiens
  misc_feature 16: d=a or g or t
  misc_feature 17: d=a or g or t
atttgtatttttaggddagacggggtttcaccatcttggccaggctggtctcgaacttctgacctcatgatccacctgcctcagcttcccaaagtgctgggattacaggcttgagccaccgcgcccagcttt

SEQ ID NO: 28151 - DNA, 183 bp, Homo sapiens
  misc_feature 112: d=a or g or t
  misc_feature 113: k=g or t
ggaagtttctgcgccgagtcctccgtcgggaaaactctaccaacttccccaggggaagggaagacaacagtgtcccagcttcccgagcttagaccgcctcaccccgtagggdkggggggcagtgggggtctgccaccttcaccctccccgcccgagttacgtacgccccacaaacctgagacc

SEQ ID NO: 28152 - DNA, 319 bp, Homo sapiens
  misc_feature 269: r=a or g
ccttacaatagttatactcaaagcagaggaacacagattaaatgtaaagggatgaaaatgtggtaagttgaacacatacatatctttgtttttaattgaaatcatgttacagtaacataatttttaaaaaggcataaacccacaagaacagagaaaagggtaagagggacaaaataaatcagtttggaaactgaaaagtgagtgaatgggtagcaacttagtgtacccaataaagttgaaacagccggcaggtatggaagctacaagarataagccaaatcatgccaaagaaccccaaaagactaaggaataagagaca

SEQ ID NO: 28153 - DNA, 186 bp, Homo sapiens
  misc_feature 112: r=a or g
  misc_feature 125: k=g or t
  misc_feature 185: w=a or t
  misc_feature 186: y=c or t
agctaaaaataaccaccctgggaagtgaaactgtggcagtgccaaggagctaagaacgtggtgatttaccagaagtcttcagaggcaagccatcttcaattcagaaggggartcccacatgtggkgttgaatatgaggcattgtttaagacacctcctgccctcaccacattggcaaactgacawy

SEQ ID NO: 28154 - DNA, 263 bp, Homo sapiens
  misc_feature 108: w=a or t
  misc_feature 113: d=a or g or t
  misc_feature 118: w=a or t
  misc_feature 119: k=g or t
  misc_feature 120: v=a or c or g
  misc_feature 128: r=a or g
  misc_feature 130: r=a or g
  misc_feature 131: m=a or c
  misc_feature 132: m=a or c
  misc_feature 258: m=a or c
tgggaacattgaaacagaatatttgagatctagactctcccagaaaatccactatgagtgataacacccctcacagattacccaagagggaaggaggttgggcagcawtaaadttgawkvcaaaatartrmmtcagaaagatggtatataatctgggggtatagaagaggagtgtggactgtgaaggtgaggcttggaaaaataagctggccatgttggggaaagtagaaatgggagagcaagacaagcatgtaaaamagggc

SEQ ID NO: 28155 - DNA, 109 bp, Homo sapiens
  misc_feature 85: w=a or t
aacccgctccggtccccttccacagtgtggaaggtttgttctttcgctctttgcaataaatcttgctgctgctcactccttgggwccacactgcttttatgagctgtaa

SEQ ID NO: 28156 - DNA, 452 bp, Homo sapiens
  misc_feature 112: s=g or c
  misc_feature 309: n=a, g, c or t
  misc_feature 310: n=a, g, c or t
  misc_feature 383: w=a or t
gttgccgtggtaacaggcctccggtggagggcggggaccctcggaagccagctgggtggcgatcgcttgtctgccttggcaggccccttgtgcagtcttttcccggcgtgascgtgcaggggattgaaaagggaatgctttatggttcagcagagaagccaccacgcaggatgcactgggacctgagaaccgtcgggcagtcccacgagctctttcatgaccagctccaaccgacaagtacacgccccttcgcactccactagctagtaagctgagctacaaggtgtgccaggcacccaggacgccganncaccgcttcagtgaaggcccagctcaaatgccacctcttccatgaagacttccgtgatccacaatgatagcawctccagcaattgcttctataatgaatagcatgagtcattctgcaggatgttgatcttcctttttttact

SEQ ID NO: 28157 - DNA, 248 bp, Homo sapiens
  misc_feature 15: d=a or g or t
  misc_feature 112: k=g or t
  misc_feature 127: r=a or g
  misc_feature 148: k=g or t
  misc_feature 163: r=a or g
  misc_feature 174: r=a or g
  misc_feature 193: r=a or g
  misc_feature 223: r=a or g
  misc_feature 224: s=g or c
  misc_feature 237: r=a or g
agtgaaagtttagadcaaagaacagatatgactcactgatggggtatggagaaagctgtagagctcagtatcccagtctccaccatctcgatggcttgcttcatttccagcktcttgtacaaagaarcaatgcttgatttgggtaggktctttctgatgaggrttttccgaaaragagacagaggaagcaaaratgcaagtgaaaaacttccagctcctcgarsaccactgtagaaratgatgcactc

SEQ ID NO: 28158 - DNA, 60 bp, Homo sapiens
agcacatgatcagtcattgataggacacagtgactttgtcatcagccccatggccataaa

SEQ ID NO: 28159 - DNA, 243 bp, Homo sapiens
  misc_feature 126: s=g or c
atttttctaaaggccgtcttgaagaaaattaaaccagaaagatcaagaaaggctggagtgcaatggtgtgatcttggctcactgcaacctccaactaccaggttcaagcaattctcctgcctcagsctcccgaatagctgggactacaagcgcatgccaccatgccaggctcatttttgaatttttagtagacacggttttgccttattggccaggctggtctcaaactcctcacctcgggat

SEQ ID NO: 28160 - DNA, 355 bp, Homo sapiens
  misc_feature 115: r=a or g
  misc_feature 125: r=a or g
  misc_feature 140: r=a or g
  misc_feature 297: m=a or c
  misc_feature 332: h=a or c or t
agtagggattctccacagggcggggaaggacttgaaagagtctggcaatatggagcacatcaggattatggaaggagaaactgcatagcaagtatttattttattgaaaaggaaraacaataaarattactacataaaaraataaagctactgaaatagatcttcccctaaaataaatgacttcactctggaacaggactgagtgacattaagcatgactttgcccaattctgtaaagccaagtcatgctgcacaagctggcacacaagaggcctgagaagatgtcctggagtaggmagaatcctgggggctccacatccacctcgggagghgaaacaagtgagacaggtgctgt

SEQ ID NO: 28161 - DNA, 242 bp, Homo sapiens
  misc_feature 16: s=g or c
  misc_feature 17: s=g or c
  misc_feature 117: r=a or g
  misc_feature 239: s=g or c
aaatatcacagacacssctcacacaaggaatataaaaaccaccaccctccagcctgggcaacgtagtaaaacctcatctatacaagaatttaaaaataagctgggcgtggtggtacrcacctgtggtcccagctactagggaggctgagccaggaagaacgctccagcccaggacttcgaggctgcaatgagctataattgcatcattgcactccagcctgggcaacagagaccctgtstca

SEQ ID NO: 28162 - DNA, 107 bp, Homo sapiens
  misc_feature 71: w=a or t
  misc_feature 75: w=a or t
  misc_feature 80: w=a or t
  misc_feature 88: n=a, g, c or t
tattcagtgcggattgcagagggcgcagtccaccgtggtaacttgcaatgtggccgcccctgcgctggctwcttwctccwcggccctnggtgaacccagcttttcct

SEQ ID NO: 28163 - DNA, 84 bp, Homo sapiens
  misc_feature 15: r=a or g
  misc_feature 75: k=g or t
tacgaccatcagagrttaaagaaggaaagtcagcgagcttgaacacaggcgtcccgtgtggaaatgtccaaggakaccgccaga

SEQ ID NO: 28164 - DNA, 259 bp, Homo sapiens
  misc_feature 5: r=a or g
  misc_feature 15: r=a or g
  misc_feature 114: r=a or g
  misc_feature 116: y=c or t
  misc_feature 125: k=g or t
  misc_feature 130: h=a or c or t
  misc_feature 131: m=a or c
  misc_feature 132: r=a or g
  misc_feature 141: w=a or t
  misc_feature 159: k=g or t
  misc_feature 200: k=g or t
cccarattcttctcrtcttggaaaactgaaactctatacgtattaaacttcccattcccccagcccctgacaatcaccattctaccttctagctctgtgaatgtcacaagtacrtyaattaatgkgggahmrtacagtatwtttttgtgactggcttaktatacttagcatgatctacgttgtagcaggtgtcagaattkcgttcctttgaaaggctgaataatattccactgggtttagatacaccacgttttgttga

SEQ ID NO: 28165 - DNA, 188 bp, Homo sapiens
  misc_feature 48: y=c or t
  misc_feature 73: k=g or t
  misc_feature 74: k=g or t
  misc_feature 115: w=a or t
  misc_feature 137: d=a or g or t
  misc_feature 156: w=a or t
  misc_feature 157: n=a, g, c or t
  misc_feature 158: n=a, g, c or t
tgggactagaaacagccttattgtgaataaggctgtcaggaatatttytgtaaaaatatattgtgaacgtgtkkacatttctcttggataaaaatgtagaagtgaaatcagtgawgtcaaagagtttggtgtatatdtattagaaattgcccaatwnnatcaaaaaacatacatccttaacagcacct

SEQ ID NO: 28166 - DNA, 97 bp, Homo sapiens
  misc_feature 77: m=a or c
ataagatggtttagggtatgagtgaatatcactgtgagaacgggtctagcacaatcccagtaaagcaggtagagtcmctggaagaccggctgggcaa

SEQ ID NO: 28167 - DNA, 108 bp, Homo sapiens
  misc_feature 15: r=a or g
  misc_feature 81: k=g or t
tgggttgtgaaagaragcgaggaatcaaggatgactcagaggtccttaacctgtgctgctgggtgaatgctgatgccagtkctgagacaggaaggaatgaaggagaaa

SEQ ID NO: 28168 - DNA, 226 bp, Homo sapiens
  misc_feature 3: k=g or t
  misc_feature 110: w=a or t
  misc_feature 185: d=a or g or t
  misc_feature 194: m=a or c
  misc_feature 195: k=g or t
  misc_feature 224: h=a or c or t
gtkgcgcgccaaccgacgccttagtccccaacgagataaacacagccaagctcggttcttccggcgggcagctgtgcgcgcacgtgcagtcgtagctaagtgccggaggwtttcgggacttgtaagtccatacgtttcctgagggacgagagggctgaggagtgggcaggggcgtaggagagatdctgcgcatmkgcaaatatgtgtcgaagaccgaggaggchgc

SEQ ID NO: 28169 - DNA, 59 bp, Homo sapiens
  misc_feature 16: r=a or g
acctttagagatgagrcacaagcaggagaagagggattaaacctgctagttttggaaaa

SEQ ID NO: 28170 - DNA, 275 bp, Homo sapiens
  misc_feature 109: v=a or c or g
  misc_feature 112: w=a or t
  misc_feature 122: y=c or t
  misc_feature 123: n=a, g, c or t
  misc_feature 132: w=a or t
  misc_feature 168: r=a or g
  misc_feature 175: w=a or t
  misc_feature 245: w=a or t
  misc_feature 248: y=c or t
catagatatgctttcttccccagtaaattctcatgcagatccagtagacatcaagtgggcagttaatcatctagattaaaatattgtttctctagttttcttaatattvgawaaacaaatcynaaaataatwtatttcattatgaaagtaactaaattaatgataaaratttaawaaggccgggtgtggtggctcatgcctgtaatcccagcactttgggagaccaaggtgggtggatcgcccgwggyaggagttctaaaccagcctggccaaca

SEQ ID NO: 28171 - DNA, 93 bp, Homo sapiens
  misc_feature 59: k=g or t
  misc_feature 62: s=g or c
ggagtagccccgcccgtctgctcgaccttttctagttggttggcggaggtgcgcggagktcsagctgcgcgtccattggctgtttggcggggc

SEQ ID NO: 28172 - DNA, 123 bp, Homo sapiens
tataaataattttttttccttttttgtgatggaatctcactctgttgccaggctggagcgccatggtgcaacctcagcctcctgggttcaagttattctcctgcctcagcctcccaaatagct

SEQ ID NO: 28173 - DNA, 51 bp, Homo sapiens
  misc_feature 23: k=g or t
cttctttaactgtctcctgtttktcttcttctctctgaaatgcatgctact

SEQ ID NO: 28174 - DNA, 278 bp, Homo sapiens
  misc_feature 19: k=g or t
  misc_feature 124: h=a or c or t
  misc_feature 141: r=a or g
  misc_feature 158: m=a or c
  misc_feature 173: w=a or t
  misc_feature 246: s=g or c
  misc_feature 248: w=a or t
  misc_feature 249: r=a or g
  misc_feature 267: r=a or g
  misc_feature 268: m=a or c
taccttatatttataaatkttaatgttttactaggaaaacaatgtttagaaaagtatatgtttaaaaatttgtactgtattttcgaggtcaggagatcaagaccatcctggctaacacggtgahactccgtctctactaaraataataataataaaamaaattagccgggcgwggtgctgggcgcctgtggtcctagctactcaggaggccaaggcaggagaatggtgtgaacccgggaggcggastwrcggcgagccgagactgtrmcaatgcactc

SEQ ID NO: 28175 - DNA, 56 bp, Homo sapiens
  misc_feature 9: k=g or t
  misc_feature 17: r=a or g
  misc_feature 18: s=g or c
  misc_feature 43: s=g or c
agtagcgakaggcgctrstgccagctccagcagcccagatcgsgcagtatttctgc

SEQ ID NO: 28176 - DNA, 135 bp, Homo sapiens
tttttttttggaccatgatggtggcagtggaagtagcaagaagtgattggattctcaatatatttgggcagcagaacttacagcgttcccaaacaggatgaatacggatgtaagctggagctgtggcagccccat

SEQ ID NO: 28177 - DNA, 114 bp, Homo sapiens
tactttggtatggttttagtatgatagtacttactttgctgtctattatcaatcagattttataaatgttttgaggcttcgaagaactaatttgtaaaacaacccaagagccca

SEQ ID NO: 28178 - DNA, 186 bp, Homo sapiens
acacaaggtccattctttttttctaagcaggaatagccacccttactccaactggggaaatcccacattattcaatttctctcaatacttaataataaatctcaagatgataagatcaaatttaaaaattaacaatattccttaatattgtcaaatatattgagggtttattgaatgcaggcattt

SEQ ID NO: 28179 - DNA, 159 bp, Homo sapiens
  misc_feature 26: s=g or c
  misc_feature 91: m=a or c
  misc_feature 107: m=a or c
  misc_feature 142: w=a or t
  misc_feature 143: k=g or t
  misc_feature 145: w=a or t
  misc_feature 146: m=a or c
  misc_feature 158: m=a or c
  misc_feature 159: m=a or c
cagtttcctctcacaaaggaaattasggaagcaatgaagataataggaatttataagttaggaaacaaaaataatagaatcagtcaatacmagagctgtcgtttgamagtcctattaaattgataagccattggccaaccawkawmaaaaaggggcgmm

SEQ ID NO: 28180 - DNA, 163 bp, Homo sapiens
gtatttcctaagaacaaggacaagctcttacataaacacagacaatcattcagattcaggaaatttaacttcgatataatactattatataatccacagaatatattcacatttcaccagttttcttaatgaagattcttgtagctcttcccatgccccaacc

SEQ ID NO: 28181 - DNA, 124 bp, Homo sapiens
gcctgcccctgtcttttccccttggttttgtgttacaagagttgtttgagacagtttcagatgattatttaatttgtaaatattgtacaaattttaatagcttaaattgtatatacagccaaat

SEQ ID NO: 28182 - DNA, 221 bp, Homo sapiens
  misc_feature 6: y=c or t
  misc_feature 10: s=g or c
  misc_feature 90: r=a or g
  misc_feature 187: y=c or t
  misc_feature 209: y=c or t
tttttyttastagagatgggttttcaccgtgttagccaggatgatctcgatctcctgacgtcgtgatccacccgccccagtctcccaaartgctggaattacaggcgtgagcccctgcgcccagtcaaatcacccaatttttaaatgttgataacttaaattctcattttgcactatgctgtgtaaycccttccttcccccaaacacayacatgcacacta

SEQ ID NO: 28183 - DNA, 96 bp, Homo sapiens
catcatgggttcagcctctttgtaattaaactgtttgctctatatgttaagccatgttctaagcctttatttgttaattgtttattaaccctcccc

SEQ ID NO: 28184 - DNA, 114 bp, Homo sapiens
gaaataggaatgcttttacactattggagggaatgtaaattagttcagccattgtggaagacagtgtggcgattcctcaaggatctagaaccagaaatatcatttgacccagga

SEQ ID NO: 28185 - DNA, 196 bp, Homo sapiens
  misc_feature 131: m=a or c
tgattataaatgttacaaaaccgactagacagtgtttacctatttcgacttaaatgtcttggttttgaagttaaaaatgaagctacataatctcacatggaaaggttaagaaacttcatataacacatgamaaaaatgtactatttttataaattcaatgaaagactattcctagtcttaaaacttttattggggg

SEQ ID NO: 28186 - DNA, 166 bp, Homo sapiens
catcaatataaaatagtttgaagtcaggtagcgtgatgcctccagctttgttcttttggcttaggattgacttggcaatgcgggctctttttcgtttccatatgaactttaaaatagttttttccagttctgtgaagaaagacattggtagcttgatggggagagt

SEQ ID NO: 28187 - DNA, 143 bp, Homo sapiens
ttctgatcattttaacatgagaaactgtcactccaggtctgggagtcaggagtctaaatgttctgggaaggatggccagttatcccattccttgagtgggtaggataggaagttcatcagcaaaagaaaaaagagagaaagcc

SEQ ID NO: 28188 - DNA, 87 bp, Homo sapiens
  misc_feature 37: y=c or t
  misc_feature 49: y=c or t
  misc_feature 55: s=g or c
aagactatactttcagggatcatttctatagtgtgtyactagagaagtytctctsaacgtgtagagcaccgaaaaccacgaggacat

SEQ ID NO: 28189 - DNA, 114 bp, Homo sapiens
  misc_feature 96: m=a or c
gaaataggaatgcttttacactattggagggaatgtaaattagttcagccattgtggaagacagtgtggcgattcctcaaggatctagaaccagamatatcatttgacccagga

SEQ ID NO: 28190 - DNA, 87 bp, Homo sapiens
  misc_feature 17: m=a or c
  misc_feature 59: m=a or c
  misc_feature 69: m=a or c
cactattgactcaagamatcactgggaccattccaggtctctgcaggatgaattttggmatagtttgtmacattgaacagccacctg

SEQ ID NO: 28191 - DNA, 127 bp, Homo sapiens
  misc_feature 25: s=g or c
  misc_feature 78: s=g or c
  misc_feature 121: k=g or t
tgtagcccttgttggaaagtgtgtsaatatagtaagatcctgttctgaatgttttaaggttcctaagtggtagcagasatggaacagcacggatttggagatttgagcagttagaatggakgaagca

SEQ ID NO: 28192 - DNA, 93 bp, Homo sapiens
aagactatactttcagggatcagttctatagtgtgttactagagaagtttctctgaacgtgtagagcaccgaaaaccacgaggaagagaggaa

SEQ ID NO: 28193 - DNA, 185 bp, Homo sapiens
  misc_feature 171: m=a or c
taatgaaatggaaatgatgagctgagatgcaatgagttgaaatgagatgaaatgatgaaatgatgagatgaaatgatgagatgagatgtgatgaaatgacatgaaatgatgacataaaatgagatgaaatgagatgtaatgatggaatgagatgagatgaaatgagatgamatgatagatgagtt

SEQ ID NO: 28194 - DNA, 108 bp, Homo sapiens
ctttatccccaggatgcagggttggttcaacatatgcaaatcaatacatgtgattcatcacataaacagaactaaagacagaaaccacatgattatttcaatagacgc

SEQ ID NO: 28195 - DNA, 93 bp, Homo sapiens
  misc_feature 12: s=g or c
cactgaagggastggtttggagcctgttcactactttgcagtaaacagtgggcctccctctcttcttttcaataacccatgactcttcaggca

SEQ ID NO: 28196 - DNA, 470 bp, Homo sapiens
  misc_feature 10: k=g or t
  misc_feature 11: d=a or g or t
  misc_feature 328: r=a or g
aagttgtcakdgtcaaaatggagtcagtgtgtcgaactttgacaaaatggaggctgagaaggccgtgaagggagggctgtcatggacgattagcctggtatcaggagctatcacaataaattttttgaaaccatagcttactgcatcagccctacaaggacagctagccgcttacatgtgaacacttgtctgtttcaaaacaggccaggcacagtggctcacacaggtaatcccagcactttgcaaggttgaggtgggtggatcacttgaggcaggagtttgagaccagcctggccaacatggtgaaaccctgtctctactaaagggrtaaaaattagctgggcatggtggtgggcgcctctagtcccagctgcttgggaggctgagacatgagaattgcttgagcccagggggtggaggttgtagtgagccgacattgtgccactgtactccagcctgggagacagagt

SEQ ID NO: 28197 - DNA, 297 bp, Homo sapiens
atttattattttggataaggctaggttagaaaagacaatacagcttttgcccacctcttcctcttaggatgcttactcttggaattcagccaccatgttctgaggaagccctgactacatgaggaaaccacatgtaggcattatagctaaggcctcagctgagagctcattcaacagccagtatcaaccatcaggcatgtgagtgaggcagccttcagattattctagtctctggtctttgagccatcccagctgatcccaggtggagcaaagtgagctattcctgttacgccctcg

SEQ ID NO: 28198 - DNA, 119 bp, Homo sapiens
  misc_feature 66: s=g or c
aactccctacctcaggtgatccgcccgcctcagcctcccacagtgctgggattacaggcgtgagcsaccgcgaccagccagaatctacctttcagaggctgttaaactaagccaactaa

SEQ ID NO: 28199 - DNA, 57 bp, Homo sapiens
  misc_feature 53: s=g or c
catcaaagtcacttgcaagccaaaagtctgctcccagaaaaaactgtaaccasagac

SEQ ID NO: 28200 - DNA, 97 bp, Homo sapiens
cagggactccctttcactggctgcgccgggggatattgagggcagggtgagtcaagaagagggaaaaagtgggaaaagaggtcttgggcacacggtg

SEQ ID NO: 28201 - DNA, 75 bp, Homo sapiens
  misc_feature 10: s=g or c
  misc_feature 12: m=a or c
  misc_feature 21: s=g or c
  misc_feature 23: s=g or c
ttggaggatsamagtacggastsatccatcggctaagtgtcttgtcacaatgctgacactcaaactgctgacccg

SEQ ID NO: 28202 - DNA, 75 bp, Homo sapiens
  misc_feature 13: y=c or t
cagaatattttgyttcactttttaatttcagtgctacttgagattttctttttttttaacctgaaagacaggaca

SEQ ID NO: 28203 - DNA, 72 bp, Homo sapiens
  misc_feature 12: s=g or c
aatacaaggcasgatgtggtgagggccaaatgaatgggccacaaacacacacctctgggttgaaaggatagt

SEQ ID NO: 28204 - DNA, 79 bp, Homo sapiens
  misc_feature 26: k=g or t
  misc_feature 39: r=a or g
atattatagttttaataattttgtakatcaggaatttargtgggactcagctggccatttgtttccatgtcatgtatcc

SEQ ID NO: 28205 - DNA, 132 bp, Homo sapiens
  misc_feature 95: k=g or t
  misc_feature 96: k=g or t
tttataaacagatgtgctttatgtaataattcttaatttgtgttaaataatttcaagaaaacatcatttagtggtagtctgggctgtttgctgtkkatttttttttgttttgttttgtattaaccttagagc

SEQ ID NO: 28206 - DNA, 109 bp, Homo sapiens
ttgaattagtgttcctctgtgtaattggattcgatgtaagtagtggcctctgggttactgtcaaattctagaactagttttctaaattattcccttttccccacacaga

SEQ ID NO: 28207 - DNA, 143 bp, Homo sapiens
  misc_feature 143: k=g or t
ttttaacccaaataagaaattcttggctgggcatggtggcttatgcctgtaatcccgcactttgggaggtcgaggcaagcggatcacctgaggtccaggagttcgagaccagcctggccaacatggcgaaaccccatagccak

SEQ ID NO: 28208 - DNA, 207 bp, Homo sapiens
  misc_feature 21: s=g or c
  misc_feature 24: r=a or g
  misc_feature 26: k=g or t
  misc_feature 27: r=a or g
  misc_feature 83: k=g or t
  misc_feature 89: s=g or c
  misc_feature 105: s=g or c
  misc_feature 109: k=g or t
  misc_feature 127: y=c or t
  misc_feature 166: k=g or t
  misc_feature 186: s=g or c
  misc_feature 196: k=g or t
actccggaggccttcccactsgarakrctgtccattcccttgtgttccccatcctcactccagggcgacctccgcgggacttkccagcscatggctgaggctgtsctgkgcacccacgatgaccggyagataggcaaaaccaagatctttctgaaggaccaccatkacatgctgctggaagtggascgggacaaakccatcaccgac

SEQ ID NO: 28209 - DNA, 125 bp, Homo sapiens
  misc_feature 52: n=a, g, c or t
  misc_feature 58: k=g or t
  misc_feature 66: r=a or g
  misc_feature 97: v=a or c or g
acttctcctgcacgttgctggcaatcagatcgcgtttaagcaatttcctgancccaakaatagcartgagtcgggagactttcgcgggctgaaattvggagctccaagcactttttccccccact

SEQ ID NO: 28210 - DNA, 236 bp, Homo sapiens
ctgggagaaatgaatgctgttccatggaacacggaaattatagaataaaactaaagcattctaacatttcaagagaaagaacactggttatgacatctctggtcacatggagtatgtctgtaaagcttgaagtcttgctaaagcatctttaatgatttgataggcttcaagtctgatatttttttctataacctccttagtcaggctttgcacactggccaaactacactgggccc

SEQ ID NO: 28211 - DNA, 78 bp, Homo sapiens
  misc_feature 23: y=c or t
cttctaacttgcccacggcagcytcggggtgagcgactttcctgcaccagctgccgcgcctgctcacaccctgaccca

SEQ ID NO: 28212 - DNA, 85 bp, Homo sapiens
  misc_feature 12: s=g or c
cacagcagaatsacattttttctgtcactattattattgttggtatgtgaagctatttggagatccaattcaggaagcaacacct

SEQ ID NO: 28213 - DNA, 145 bp, Homo sapiens
ggaagacgggcggcgcgtggcggaaggcaggcttgctcctcggggtgggggagggtatccggcttaagggggctgcgtggacaccacttcttaatgtcgggggtcttcgcggcgctcacctcggctcctagggttcgggacgctt

SEQ ID NO: 28214 - DNA, 108 bp, Homo sapiens
atttttgatgccatgcactcatttccagccaatgatgaagtccagaaacttggatgcaaagctttacatgtgctgtttgagagagtctcagaggagcaactgactgac

SEQ ID NO: 28215 - DNA, 132 bp, Homo sapiens
agcctgcattctttctccaatttctagaaggtatttacacacttctgtaccccaccagggggttgggttttcattctgaagtctcctgtgtataacacattagataaagttttgtgtcttttcccctgtgga

SEQ ID NO: 28216 - DNA, 67 bp, Homo sapiens
tccaaataaacacagaaacaacaaaggtgacgttacaaccgaccccacagaaataaaaaaaaaaaaa

SEQ ID NO: 28217 - DNA, 102 bp, Homo sapiens
gagagaagaaaagcaggtggaaggagaggaagcggatgccgtgggggtaagctaagttctttccttctgtggtctttgagcatgtcgagtcacccgggatgg

SEQ ID NO: 28218 - DNA, 138 bp, Homo sapiens
acaatggcagtttcatgcattcattgtgaattgtgattggtgcaagtgaaaaacggtgaaattggagatagtgcaagtgggaactgtgcataaagcagagctcattctattagcacagtagcccacagcgggaggtag

SEQ ID NO: 28219 - DNA, 104 bp, Homo sapiens
ctatagggatatttccttttctgatagttattatttagggttaatatatcattttacatcatatgtaaggattttgcaacttcattttacataatatgcaaggg

SEQ ID NO: 28220 - DNA, 146 bp, Homo sapiens
  misc_feature 81: s=g or c
ttacataattttttttttttaactttaagtttcaggatacatgtgccgaatgtgcaggtttgttacataggtatatatatsccatgatggaaatatttatttttttaagcgtaattttgccaaataataaaaacagaaggaaacaa

SEQ ID NO: 28221 - DNA, 136 bp, Homo sapiens
atatagaacattaccaattataaatacatatttaagtataatttagtgttttctggaaagaaatcaaatgtgtttctgtgggcattcacattttcttttttgtgaattttccaagctttctacaatagccatagca

SEQ ID NO: 28222 - DNA, 76 bp, Homo sapiens
  misc_feature 11: s=g or c
ggatggaatgsaaaggactggaatggagtggaatggaatggaatggaatggaatggaaaggactggaatggagcgt

SEQ ID NO: 28223 - DNA, 164 bp, Homo sapiens
  misc_feature 54: n=a, g, c or t
  misc_feature 70: d=a or g or t
gaacttctcagacggctcctgtcagcgccaagtttcaccaaatccaggcctgcnggctcctcccccaggdcccccactcgcagtccctcaagcctgtgctcccggaaaggcactgggcgaccgcacccgtggctttctctgggcgaccgggtcccagactccta

SEQ ID NO: 28224 - DNA, 97 bp, Homo sapiens
tattctgagctctggctttgacagtaagctgtgcccacagcagctgttagcaatcagagtgtgtttccatccgatgtgaaatgtgctgccacctaaa

SEQ ID NO: 28225 - DNA, 256 bp, Homo sapiens
  misc_feature 223: k=g or t
  misc_feature 226: s=g or c
aggagttctggagctgctggctggagaggagggtggacgaagctctctctagaaagacatcctgagaggacttggcagactccaggttcttcagttttggaactcaaactggccctccttgcacctcagcctgcagatggcctattgtgggaccttgtgatcatgaagtcagggaccctgaatggagggatcggccagagctgaggcagaagaacataaattkagscaagatttcatggatatttatcacttccca

SEQ ID NO: 28226 - DNA, 87 bp, Homo sapiens
gtatttttagtagagacggggtttcactgtgttggccaggatggtctcgatctcctgactttgtggtctgcctgctcctgccccccc

SEQ ID NO: 28227 - DNA, 165 bp, Homo sapiens
cataaatcatgatgagtcacttgtgtgccctcagacaccaaacttgtataatttgagaccagcataatttctttccaaaagctttctgaaagaagtaagagtgatttttggcacttttttgttaaatgccaaaaagtaagggaatgggaattaatatgagctaaa

SEQ ID NO: 28228 - DNA, 341 bp, Homo sapiens
caacataggacatctgatcatcaaggactgaggacctggtggtgtacttaacaccactgccatttattgattgattgagatggagtctcaccctgttgcccaggctggagtgcagtctcggctcactgcaacctccacctcccgggttcaagtgattctcctgcctcattctcccaagtagctgggattacaggcacggaccccatgcctaatttttgtatttttagtagagacggggtttcaccatgttggccatggctggtctcgaactcctgacctcaagtgatccacctgcctcggcctcccaaagtgctggaattacaagcgtgagccaccatgcc

SEQ ID NO: 28229 - DNA, 324 bp, Homo sapiens
catttgattgttggctgcatgtatgtctgtttttgaaaagcgtctgttcatgtcctttgcccatttcttaatgggattgttgtttttttccctgtaaacttgtttaatttccttatagatgctggatattagacctttgtgggatgcgtagtttgcagtattttctcccattcggtagggtgtctgtttactctgttgatagtttcttttgatgtgcagaagctcttcagtttaattagatcccatttgtcaatgcttgattttgttgcaattgcaacaaaatatatattgaacttgatgtctgtgactctaatttaccccctc

SEQ ID NO: 28230 - DNA, 135 bp, Homo sapiens
caaaatgtatataaattatctagattggataacagtcttgcatgtttatcatgttacaatttaatattccatcctgcccaacccttcctctcccatcctcaaaaaagggccattttatgatgcattgcacaccca

SEQ ID NO: 28231 - DNA, 100 bp, Homo sapiens
ttatattgctactttttctggaaattgaacagatgcataaagcaaactcttaatttcagcactttacttttaaggcttatttcgagttcctagaggcaga

SEQ ID NO: 28232 - DNA, 117 bp, Homo sapiens
tacataggtatacatgttccaaggtggtttgctgcacctattgacccatcatctaggttttaagtcccacatgcattaggtatttgtcctaatgctcttcctccccttgccccccca

SEQ ID NO: 28233 - DNA, 165 bp, Homo sapiens
ttagtctctctatgtgccattagttatttggtgaaattagtaggccaatgtctcccttcagaactttaattatagcagaagttaacaaagttcctttcactcacatcttttttatttgatattccacttaactgttgcctaaatcaattaaatatcagtagctcc

SEQ ID NO: 28234 - DNA, 170 bp, Homo sapiens
  misc_feature 16: d=a or g or t
  misc_feature 23: s=g or c
  misc_feature 25: s=g or c
  misc_feature 47: s=g or c
  misc_feature 104: k=g or t
  misc_feature 110: k=g or t
  misc_feature 114: s=g or c
acttcccccaccccgdgtgtctsasaaactctcaggggtcctcaaasaacagtttgaaaagccagtctctttgcccctacatcagactcagccttatggaagakgacgakgaasaagagttagaaatccaggatgagtcaaatgaagaacggcaggatacagacatgcaa

SEQ ID NO: 28235 - DNA, 259 bp, Homo sapiens
tgttcctgcagtattggatagctatctcatacttcttttagaaagaagcctttttcattaaggatacaacctatttgtagctcgcactttaaaagatgcttgagatacattttaaagaaaactaaaaatccctgtaaataggattttgtgctttctgtaacagtgcatgcttcagcacagaaaactcagcattgattattgtaaattaaataactgaaattgtggtgagacgtcatagtcttcatgagaacgtgggggt

SEQ ID NO: 28236 - DNA, 258 bp, Homo sapiens
ctcactcgggggtctgtgtgattctgcttgggctgccgtaacaaaatgccccagacttcaacaccagacatttattttctcacagtgctggaggctggaaggccaagttcaaggtgccagcaggtttggtttctggggaggtctctgttcttggcttgaagacagccactttttcagtgtgtccttacatggccatttctttgtcatccctggtgtgtcttcctcttctgacattaatcctaccagtttagcgcccta

SEQ ID NO: 28237 - DNA, 190 bp, Homo sapiens
tgatgtttctgttgtgctgcctgaaaaccctattacttatgcctgggaaggtggaaaattgatatcagagaatgatgattttgaagatatggtggtaacaagagaagattacgaagaaaatggacatagcgtctgtgaagagaaatttgatatttaagcaacatttttgaatgaaagttgtgaccatcag

SEQ ID NO: 28238 - DNA, 157 bp, Homo sapiens
taaatttccattttctagttatgtattgcatgtagagatcgcttgatttttgtatatccaccttttatctgtggccttgctaaactcactcaatagttacaggagcttttttgtgggtatggattctttggtttttttgtcttttcttttttttttt

SEQ ID NO: 28239 - DNA, 221 bp, Homo sapiens
  misc_feature 4: w=a or t
  misc_feature 173: y=c or t
taawtgatgagccaatattgatacactagtattaactaaagttcatagtttacattcagattcatcctttctacagttctgtgggttttgacaaatgcgtaatgtcatgtctccaacattacagtaacatgcagagtaccttcactacactaaaaatccattttgctttaccyatttattcctcctcaccccctccctcgcccccagttcctggcagccac

SEQ ID NO: 28240 - DNA, 320 bp, Homo sapiens
agaatcatcatagaagactaagaaagggtacaatagggtaggagaataactaatggattcccggaattcaagtgaagaaaatatttccaagaacatatgagcaattctgctaaaaactcttacccagaaagatgggaattgcgaagttactttgaatttagcaacatagaggtcattagtgactgtgacaagaccaaatttatggaacagtggagagaaagtctgatccacttaaatgtggaacagacatcttaacctaatacacccagctatgagaattgaggaaacgaaattgacataactagcatagatggcaccac

SEQ ID NO: 28241 - DNA, 351 bp, Homo sapiens
  misc_feature 344: r=a or g
ctttctgtatgttaggtggtttaggtttgttgtctttaaatcttccatatgatgatgataccctgttttacagttgagacccaagactatagatatgttaaataatttgcttgtggtcatacatgttctatcttctgaatagaagataactcctggaactgatagagagagggcagaaaaaagattctattttgagaaatggagcaacctgaaggcacatagctttgctgtttgctgtaactcctttagacagctctctgaccacacagtacgtgggtggacaccagcattgaccaggagggatggtggaaagtttaaatagttttcctttactgtaataaacrctctaga

SEQ ID NO: 28242 - DNA, 423 bp, Homo sapiens
caaacctaacaactatcgcttgccactgaagggaagtacgcggtctatgggaccctggtagccttatatggacttgttttttggttgccggaataacatgcatctggacatgggaatgagactggcgagaaagggagggggcagatgttcacactggtattcattggtgcttcaattactaagagccacatctttcctggtttaccagaaataggtgctgttgcacaacttcctggtggatagggtaggggggtgttagctgataggggagttccctggagccctcgactctctctgttgctttcagcctcagccctcagtgcagagtttggccctggcccgcgctgtggggccctcctaaacctcccctatgtccttgcaaaggtgtgcttcttaggtttcgcttgagcagtcagccagttc

SEQ ID NO: 28243 - DNA, 216 bp, Homo sapiens
aatttgattataatgtatattggtgtaatcttctttgagctaatgttgcttgagcctcatgattatggatagccatattcctaccaagatttgggaagttttcagacattatttatttaaataagctttctactgctcttattcttctccttcttggactcccacaatgcatatgtttgtttgcttgatgctgtcctttaggtcccatatgctccc

SEQ ID NO: 28244 - DNA, 367 bp, Homo sapiens
  misc_feature 348: n=a, g, c or t
ttgtgaacatagcaattaactaaagtgagtgtcaaggaagggcctttgctcctaaggttacgagtccatctctctaggaccatttcctataaaaggggaatcaccatctgctttctaattgcttcttttattccactttggatttgttaacatgaaaatgtaagttttcatttggctgacattaatcagtttctgtgtgaggttctgtatcaaggtatcaaacaagacctaagagattgaaggtcctagtggtggtattaaatttttgcatataaattaatgaccatgcaatgtttcacagccatttttctcttcctttctaacagccttgttagatactgtagtttntgagaatatagagacagcg

SEQ ID NO: 28245 - DNA, 431 bp, Homo sapiens
  misc_feature 203: k=g or t
  misc_feature 370: k=g or t
tggtcctgtgtcagatggatagtttgcaaatattttcttccatctatgggttgtcgttttactttgttgattgtttcctttcttgtgcaggagctttttagctttatgtaattccatttgactttgctttgttgcctgtgctttttgaggttgtcatttttattgactagatgatattccagtatattaattttttttctttkttgtatttttgagatggaatctcgctctgtcgcccaggctggagtgcagtggcgtggtctcagctcactgcaacctccaccttccgggttcaagcgattctcctgcctcaccctcctgagtagctgggattacaggcgtgtaccaccacgcccggctaatttttgtktttttagcagagctggggtttcaccatgttggccaggctggtctcaaaactcctgacctca

SEQ ID NO: 28246 - DNA, 300 bp, Homo sapiens
  misc_feature 41: s=g or c
ggcgctggcgcaggtggacgcccatctggagcaagcggcasccagttgctcattccctcgcctgccctggatttgctggcagaggagttgcggctggcccagaacgccttgggcgcgatcaccggagagttctcctccgacgatctgctgggcgtgatcttctccagcttttgcattggcaagtagcgctctccaccgggcagcttctttgtaaagggacgtaagcggtgcttgtgtccgcgctgtaacgcaggtactttcagacccactatgaatgccctaatgtccacatccccccgc

SEQ ID NO: 28247 - DNA, 226 bp, Homo sapiens
ctgtcttccccctctaaaaatgtaaattatataaacagagggttttttaattgtggtaaaattatacataacataaaattgaccattttaaccattttcaagtgtacagtccagcagtattaagtacattcatgttgttataccttcaccaacaccactatgcatctccagaactttttcatcctcccaaactaaaactctatactcattaaacattaactccccc

SEQ ID NO: 28248 - DNA, 129 bp, Homo sapiens
taatcttgaatgaatgttatttctacttagtcctaagcaagaataagctgccctcttggtgatcatactttatacggagtgctatcgtttatgaaatgctttcagtatgctttttaaattatgcaggca

SEQ ID NO: 28249 - DNA, 316 bp, Homo sapiens
aaaaattattttaaaaaatttaaatacataatacttgtacatgtttatggggtacttgtgatattttgttacatgcatacaatgtgaaatgatcaattcatagcatttagggtgtccatcacctcaagtattcgttatttctatgtgttgggaacatttcaagtcctctttttttaaactattgtgaaatatacaatgtattgttgttaactgtagtcaccctactctgctatcaaacatttgcactttttacttcgatctaattgtatgtttgtacccattaacaacctctcttcatctcccctcaagccccaca

SEQ ID NO: 28250 - DNA, 179 bp, Homo sapiens
ttttttgaaacagtgtctcgctctgtcacccaggatggagtgcagtggcatgatcacagcttactgcagcctcagcctctctggctgaagtgattctcctgcctcagcctcccaagtagctggaactacaggtgcacaccacgatgcccagcttttctttctttttttttttttttttt

SEQ ID NO: 28251 - DNA, 105 bp, Homo sapiens
tgaggcaggagaattacttgaacatgggaggtggagactgtagtgagctgagattgcaacattgcactccaacctggacaacaagagtgaaactccgtctcaaaa

SEQ ID NO: 28252 - DNA, 361 bp, Homo sapiens
catttctggtggaaatacaaataatacagttattctggaaaatctcttgatagtttaaaaaaaaaaagaaaactgtgtaactatcctactacccagtagttgcacccttggacctttatcacagataaatttatattgatacagaaaacctgtgtcaatttcataaagtccagatataccaaatgagtaactagtcagagaagcagctgtgtttctacaccatagcatgcacatgcgcatgtggtgttaggaaaatacaggtctctttgcccttctgatgcccttagtcttgaggtgaaggaagaagcaacagaaagtatccaattactgtttgaagattacctagtttgtttatgagtgc

SEQ ID NO: 28253 - DNA, 357 bp, Homo sapiens
  misc_feature 116: m=a or c
  misc_feature 305: y=c or t
  misc_feature 309: r=a or g
  misc_feature 311: r=a or g
  misc_feature 313: v=a or c or g
  misc_feature 318: r=a or g
  misc_feature 319: r=a or g
  misc_feature 324: w=a or t
aaactaatatttacaatagcagtaaaaagataaagtattgtggaagaaacttaaaggttcagaactattaggaaagaactttaaaatactactaaggggcataacaaatgtgaacmaataaatataccatgtgacattaagaagtgtgcgcaaacttaagtgaatgtattaatttactgtgatcttggtcgggtgcggtggctcatgcctgtaatcctagcactttgggaggccgagatgggcggattacctgagatcaggagttcgagaggagcctggccaacatggtgaaaccctgtctctaytaararavaatarrataawaaaatacaaaaattagccgggcgtggtggcggc

SEQ ID NO: 28254 - DNA, 356 bp, Homo sapiens
  misc_feature 121: r=a or g
  misc_feature 154: s=g or c
  misc_feature 310: y=c or t
  misc_feature 338: r=a or g
  misc_feature 344: y=c or t
  misc_feature 345: k=g or t
tactacattcctgaaaacattgagagaggattttcatataataggagtttatatttagtactttatataagtaagccaaagtaaaacactcttaaatacctatatagcagtccacccaaartttctgagagctacgaagcatccagcttatcasttacctcttcatttaacatttaaatccttcagtgggtatgctggagcagtatcatgtccctgcacgttccttcaacaccacagggaccatgtgcaatagtccatgttataaagattcttagtgagtgcaaatttagtcaagtaaaataaggcagtyctaaaagggccacctgcagagtgaattrtagcaykagcgagggctt

SEQ ID NO: 28255 - DNA, 318 bp, Homo sapiens
  misc_feature 87: d=a or g or t
ctaaataatccatcttcagatgaatgggaaaagaaactgtggtatgtatccacaatggaatattattcagccttcaaaaagaaagadattctgtcatttgtggcaacatggatgaacttggaagacaccatgctaagtgaaataagccaggcacagaaaggcaaatattgcatgttttcactcatacgtgggagcttaaaaagttgaactcatacaaatagacagtagatggtggttaccagaggctggggaatgggggtggatgaagaaggagatgttgatcgaagggtacaaaatttcagttagatcagaggcgtt

SEQ ID NO: 28256 - DNA, 173 bp, Homo sapiens
gtattaaagtgtaaaatgtgaatcatacatcttgtctaaatagcttacagcatagttggcttaaatgaaaataaaaaatagtgatatgcttaaaaaatacaccaataataatgtacaaagtgacaaagatgaatatttaggataattataacctgaaaagggagagagggcga

SEQ ID NO: 28257 - DNA, 222 bp, Homo sapiens
  misc_feature 177: r=a or g
  misc_feature 185: r=a or g
  misc_feature 186: r=a or g
aactaaagagcttctgcacagcaaaagaaactatgatcagagtgaacaggcaacctacagaatgggaaaaaatttttgcaatctatccatctgacaaagggctaatatccagaatctacaaagaacttaaacaaatttacaagaaaaaacaaacaaccccatcaaaaagtgagtgarggatatgrrcagacacttctcaaaacaagacatttatgcagccaa

SEQ ID NO: 28258 - DNA, 275 bp, Homo sapiens
  misc_feature 243: w=a or t
  misc_feature 257: w=a or t
tatgataaagtttataaattaggcacagtaagatattaataatagaatatacaatataccgcaataaaacttatgtgaacagttatttttggacagcagttgactgtgggtcactgaaattgtggaaagcaaaaccatggataaaggggaactattaatagtctatctgtattgcattatcttctaaaatccaaaattctgacttcaaaaactcatctgagggttttggaattgtgtatctawgtgtgtgaagtgcwaagagcagtgcttcatgt

SEQ ID NO: 28259 - DNA, 179 bp, Homo sapiens
  misc_feature 38: n=a, g, c or t
  misc_feature 39: n=a, g, c or t
  misc_feature 40: n=a, g, c or t
tgaaccccttctgctaaaaatacaaaaattagccaggnnnggtggtgggcgcctgtaatcccagctacttgggaggctgaggcaagagaattgcttgaacccaggaggcagaggtttcagtgagccgagattgcaccactgtgctccagcctggtgacatagcaagactccatctcaaa

SEQ ID NO: 28260 - DNA, 353 bp, Homo sapiens
agtaaacaatgttttgttatgtattaaggggatatcagtgtttctcaaagtatgatccatggaccatctgggtcatggcgcctggtttcagacaacctgaatcaaatcttaggggtggggctttgggatgtcattgttcaataggcacctcaggagattctgagcacaccaatgtttgagaaccactaaaatgaggagtgggaaaaaaaaaataggtgttttgttaatttagagctgagctgagaagataatatatttttattgtcaatgacattaacagatatgcactgattcttttatacctacaatttacttaatgtcccttttattaaaacgcgtggttcatgagcacc

SEQ ID NO: 28261 - DNA, 164 bp, Homo sapiens
atcagttaatgacgtgtctatcctgtcagttccttgggcctgaaactttgaagttatccttgattcctctctttttagccataccatgtcccatctataattaaatcttattggctaccttcaaatcaaatccagaagctgctgatttcttcctaaccccacgc

SEQ ID NO: 28262 - DNA, 228 bp, Homo sapiens
aagatcctttacacaataaagtagatgatcatgataaatgaggtaaggtcctattatcacacacttcaaacacggtagatcagaaacccactatgatactcgcttcctgtctgtttgctaaggaatataaaatggctagaaagtttaatttgaaacctttgcctccatttggaatagtagacaccagttaagagggtgtcagatgccttttttttttttttttttttt

SEQ ID NO: 28263 - DNA, 303 bp, Homo sapiens
tgactattttattccacaagatagcatttgactaattcataatgcttaagtcataagatggtggctggcattttttaatttattactaaaagctaagatatttgcattatattgtgcaaatttcacagaacaatgttgcattttctgagataaggctctaattttttaaatagtgctacatttagttgaaagtttcagtcagctagttagctgagttgaatgaaaaatatagaactgtatgtacatttatcaaatgataaaatatgttcatttttgtaagaaatcagaaaaattaagacgcct

SEQ ID NO: 28264 - DNA, 222 bp, Homo sapiens
  misc_feature 41: k=g or t
  misc_feature 55: k=g or t
  misc_feature 167: r=a or g
  misc_feature 198: k=g or t
cctagtgcttttgcaattttcaaagcacttccataagcatkccttccacctcctkgataggcatttatggaaagcctgctacatgtcaatcatactgttaggcacaggggacctaaagacacataaaaggatggcattctgcctcataaattgcaaaacctaatgaragtgactgcttggtaaacaaattattattakattataaaatgctataaaagagcc

SEQ ID NO: 28265 - DNA, 313 bp, Homo sapiens
ggcttaacctacagattgaagaggtcggaagctctgaggcccggggcttccggaggtcgcggagatggaattggagcagagagaagggaccatggcagccgtgggctttgaggagttctcagcgccgccaggctcagagttggcgttgcctcccctatttggtggccacatcctggagagcgagctggagacggaagtggagtttgtgtcaggtggtctgggcggctcagggctccgggagcgagatgaagaggaagaggcagcccggggtcggcggcggcgccacgggaattaaatcgcagaaagtaccata

SEQ ID NO: 28266 - DNA, 161 bp, Homo sapiens
tttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcatc

SEQ ID NO: 28267 - DNA, 420 bp, Homo sapiens
  misc_feature 381: w=a or t
  misc_feature 392: w=a or t
agtatggcagctttcctcaaaacttcagacatagaattaacacatgatcctgcaattccacttataggaattgacccacaagaaatgaaagcagggacttgaacccatatttgtacaccaatattcatagcagcttattcacaagacccaaaaggcagaagcaacccaaatgttcatcaatgaatgaatgaatggctaagcaaaatgtgatatgtacctaacgaagtatccttcagcctgaaagaggaatgaagtactcatacatgttacaacacggacgaaccttgaaaactttatgctaagtgaaataagccagacatcaacagataaatagttatgattccacctacatgaggtactgagagtgaacaaatttacagwgacagaaagcwgaacagtgattaccagggactgagggga

SEQ ID NO: 28268 - DNA, 300 bp, Homo sapiens
ttaaacgatcggaaaatctaggctctgagaattagcttggaccttagaaatcagcgagtttcatgcttctcaaagagctggtctttgatgagataaggaacctgtgccagaatgtaaatcaacaccctgctttcaactgattaaacagtgttctgagtgatatcgttgatttatgttctggctcaagcttcttattcattcaggaccagtgttaaacagttttcagaccagcccctcggctggggtccatactttgagtaagcactgaactagctcatgttttttaaaatggagcatcaa

SEQ ID NO: 28269 - DNA, 110 bp, Homo sapiens
  misc_feature 10: k=g or t
aaaatactakccagccagagaaacagaatcctaactatttctgaggaaactgcaggtccaaaatgtggctgcttttaacaatggcaagtttgatatctgtactggggacc

SEQ ID NO: 28270 - DNA, 491 bp, Homo sapiens
  misc_feature 428: r=a or g
tttcctctagcgtgtacagtaagtgttcataaacacttaaaaataatttagttatcagcctctgggaaaatagctcattattttaaataattaactcagagcttttcgtccttgaggtcctagctcaagaaagccagcctggacttcatagaccaaattagcgcgcgcccccccgcccctttctgtactccttcatggcaattgtgcgtttgtaattgcatgcttctgtgaatatttgttcctccactgcgcagtgtgcttcatgagggcagtgtctgtatcattttgccgtacacctgttatggtggttggcacgtagtagatgctcaaaaaatattaattgccgaaccgtctcgtaatttggacccttccggttgagtctttcttttcatagctaatttcccctttaagaatatatactaattaaratcaattgatgtccttgacataccccctgggattacagaggacagacttatttgtcatgtaga

SEQ ID NO: 28271 - DNA, 54 bp, Homo sapiens
cataatatagattctcatcccaacaaataactctaaatggtcagaccataaaac

SEQ ID NO: 28272 - DNA, 208 bp, Homo sapiens
acttacagtgtcacttgagccagaaactctcaagtaggtaatgttttcctccactcaagaggtttgtgaagccaggacacaaggattggaggtaagggggtctgaagtgcaatagagcaaggcacagtggggcttaggaaatatttctgaagaggtcagccttgttcaagctaggacagggaaacagatgagagcagaaagggcgttg

SEQ ID NO: 28273 - DNA, 220 bp, Homo sapiens
  misc_feature 33: k=g or t
  misc_feature 95: r=a or g
aaaaagccaggcatggtggtgcaggcctatagkcccagagtatttgggaggccatggtgggaggattgcttgaacctgtgaggtcaaggctgcgrtgagctttgaacacacccattgcactccagcctggatgacagagtgagaccctgtctcaaagaaaaaggaaaagaaaagtctcactggagaggcatactttatatatcttttaattgtatgtttt

SEQ ID NO: 28274 - DNA, 287 bp, Homo sapiens
ctagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggaaag

SEQ ID NO: 28275 - DNA, 97 bp, Homo sapiens
ttgttacataggtatacatgtgccatggtggtttgcagcacccatcaacccatcatctacattaggtatttctcctaatgttatccctccccgctca

SEQ ID NO: 28276 - DNA, 116 bp, Homo sapiens
tgctgtaaatttccaaacattttaaaaggctgtcttgtaggaaggaagaagagttttcctcctggccagaggaggaggaactaggacttgttacttggaattgaggaaagacacat

SEQ ID NO: 28277 - DNA, 182 bp, Homo sapiens
  misc_feature 53: k=g or t
  misc_feature 56: k=g or t
  misc_feature 90: k=g or t
  misc_feature 111: k=g or t
gtgaataaggcataagttatattattattattatttttctccagacaggctckcakcctgtcacccaggctgtagtgtagtgactatcakggttcactctgacctcgaackcctgggctcaagtgatcctcctgcctcaacctcccaggtagctggaactataggcctgcacctctgcactt

SEQ ID NO: 28278 - DNA, 135 bp, Homo sapiens
agcactaaatcagttccaaaatctgaactccttcatatttattcaacatagggaaatgctcttcaactttgtgtgcttagattccatttatgaatgatatatttctaatatttgattaaaataaaaacccatgcc

SEQ ID NO: 28279 - DNA, 186 bp, Homo sapiens
atttatctttcctacttaaaccccaatcttttctttattcttcagacatactaaagaccacctcagtctttgtgtttgttccaagttgcacttctggttttatatattcccagctaaaatattttgcttagagatttgtctctatactttgattttgatactcggcatactagtccccccaaccgc

SEQ ID NO: 28280 - DNA, 388 bp, Homo sapiens
tttaatttaattataataattgtttaatatcttacgttttataacaacatttgctttgcacttttcaaatccctgtcacattcatgatcatatagtgctatatttaaaaaggagaaagaatcctgaagtgtcaggtccacaaaaaagcaaaacaagatatactgttatccgcatttcacagattaaaaaatggagactcagaaagatcccttgagatgcttcagttcacagacctagtaaataataatagaatagacaccgcagtcccaatctgctgactcctagtccacagctctggccaccaaaccattttactagcactcaaacatggcatctgtggagcattcttcttgtctttcattcccaacttcttctgaccaccaccgca

SEQ ID NO: 28281 - DNA, 117 bp, Homo sapiens
  misc_feature 23: s=g or c
  misc_feature 117: s=g or c
gtgaaatgcatggtatatatggsagaatatatacatgcacatatgcagtgtgaaaaataacaaactcctgtgtacccaactcgcaggtcaatgaagacagtattccaagcccatgas

SEQ ID NO: 28282 - DNA, 288 bp, Homo sapiens
  misc_feature 17: y=c or t
  misc_feature 18: y=c or t
  misc_feature 238: n=a, g, c or t
  misc_feature 239: y=c or t
ctggctaattttgtatyyttagtagcgacggggtttctccagtgttgttcatgctggtctcgaactcccgacctcaggtgatccgcctgcctcagcctcccaaagtgaaaccccatctctactaagaaatacaaaaattagccgggcgtggtggcgtgtgcctgtagtcccagctgcttgggaggctgaggcaggagaatcgcttgaacctgagaggtgaggttgcagtgagccgagnycgagccactgcactccagcctgggtgacagagcgtgagactccgtctca

SEQ ID NO: 28283 - DNA, 409 bp, Homo sapiens
  misc_feature 9: y=c or t
  misc_feature 10: y=c or t
  misc_feature 251: r=a or g
  misc_feature 252: k=g or t
  misc_feature 316: b=c or g or t
  misc_feature 318: y=c or t
  misc_feature 322: n=a, g, c or t
  misc_feature 323: v=a or c or g
  misc_feature 340: r=a or g
  misc_feature 343: d=a or g or t
  misc_feature 369: k=g or t
  misc_feature 371: n=a, g, c or t
  misc_feature 377: v=a or c or g
  misc_feature 389: w=a or t
  misc_feature 391: k=g or t
acttagctyytaaagcttatatattaattgttcaaatgtgaatctatataaagcatattggtgcagcacattttaagattctagaaaaccacaaaatctgtttattcatgttgaaacatacaggaacatattctccctagatcagagtcaaacttgtggaggtatttgtagcattttggtaacactccctagagaatttgtagactttgggggtgcatattaagggataacatacatggcttttcagaatrktttctgaataaagcagcttcagacaccagattttagtttttggattaggaaagagtgatgtgtbtytccnvcctcccctcccccaccracdcacacacacataccctccccatcttkcngatatvggccatcttgtwtkattggatgagccccccat

SEQ ID NO: 28284 - DNA, 209 bp, Homo sapiens
gaatataatgaagtttgaataatatctgcagatttcatgatttcatcctgtctttgttctcagtataatacaaattcaaactcattttgggaacttgatgtacataaactctatgtgaatataaataataaaatttaaaattagattttaaaattgaacacttcgcatttctcaggagtaatcgagtgttttacagatgtgaggaagaa

SEQ ID NO: 28285 - DNA, 151 bp, Homo sapiens
  misc_feature 144: w=a or t
acaacgtccggcgcttccgccttcgcttaggaggaggaagagctggtagggaaaggaaagtgcttcgccttgggcctggactggaccgagtcgggttggtgggggtctgggctatgagcttttgagggtcgcctgggacgcggwgcaaaca

SEQ ID NO: 28286 - DNA, 213 bp, Homo sapiens
taaataaggaagaggaacaggctatgtcctaatgcttgcttagaccagtataagcatgccagggcaaataggcttaattgtgggagctaagaacataaagtacattgatttgtttattatggctagcagatatttaagaatgttcgcacaggtctttcaataaattttgcttctaagagaagttactatttattcctaattagatggggagaa

SEQ ID NO: 28287 - DNA, 118 bp, Homo sapiens
aactggggtgtttctctccaaagtatctgcatagccagggactccttccagaattggctcaaaatatcactttctcaaaaagacccacactgattgtcctatatttgatagcacaaca

SEQ ID NO: 28288 - DNA, 184 bp, Homo sapiens
attttttgggtttgtataggggacgcagggtgtcagatcaagcggtggttttcccaggttcccggcattggctgtcagcgctgtgtcacacacaaaaaagtgacagtcattggcgctggtttggttgggggggagggcaaatcccaaatctgatgtcagacgagctaagcgttggatgggtagc

SEQ ID NO: 28289 - DNA, 331 bp, Homo sapiens
ataaaaattttccaggcaggcatggtggcacacacctgtggtcccacctactcgggaggctgaggtgggagaatcacctgggcctgggaggttgagactgcagtgagccttgatcgtaccattgggctccagcttgggcgacatgtacctggtctccaaaaaacatataaataaataaatctacttgttctgtggatttcatgaccccatttcatttaagcatactttcaaagtactccactgccccacctataccatttggaatatataaataggaacataggggatttaatagcttaaaattaagaaacatcaaaacaaaaccaagcct

SEQ ID NO: 28290 - DNA, 317 bp, Homo sapiens
  misc_feature 255: r=a or g
aataaattatatggatttctttggaagttgattgtgaagaaaatgactaagaaaacttttttttttcttttaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagrgaaatctgcagaatatacagcattggccagacaactggaagctgctttagaagaaggaagaa

SEQ ID NO: 28291 - DNA, 173 bp, Homo sapiens
tataaagaaaaactctttggggtcctcaaatcttaaggtataaaagggtcctgagaccaaaaggtttgagaaccattaggatttggggtttttttttgtttttttgttttattttataatagtgttttatttgatataataggatgtgaaagccctgaaaagttgtggaactg

SEQ ID NO: 28292 - DNA, 190 bp, Homo sapiens
  misc_feature 173: b=c or g or t
atactatcgagccaacatgtactgacatggaaagatgtcaaagatatgttaagtgtaaaatgcaagtggcaaaacactatgtatagtctgagccagatcaaagtatgtatgtttttaatatgcatagaacaaaagatttggaaagatataccccaaactgttaaatgtggttbctcttcggagagggggg

SEQ ID NO: 28293 - DNA, 465 bp, Homo sapiens
cctatggagaatacaaatagacattccttagtgtaattggtttctataaatatttattagtgttagaataaacaaaatttgtattttactttggagaagccatgccctggctaaaagcattcataatcacaaattgtaaatgctgatctgaatgtgtttgcacatacgtagattttggtactagctatgtttggtgcagttggtcatggactatgagcctgcaacctccatttctagtccagctggttttgtgtatgttttgaacagtctgtgcctctgtgtaataatgatggattgttgtgttttttcctcagctcccccttttcctgtaccactgcttaattagaagtatgtcaggactttgaacacagcgggagcatacttaacattaatctgtgggtgggtgattgctttggcccgggatcttggcgttcctgtgttctcagaatgcacacaggttgacct

SEQ ID NO: 28294 - DNA, 468 bp, Homo sapiens
  misc_feature 314: s=g or c
  misc_feature 315: r=a or g
  misc_feature 412: r=a or g
tccaattgtcctacagatatttttcaaaatgactacttttaaagtataatctttttattcacaggtgggatgctaattctacaattgcctaggacttctttaatttgtgtaggttaagagattttaatgggcaatttaagaagtgttgaaatttataaggattatttctgtatgttagagttgtgataacgcagacattttccctgtagtacttctctgagtctgatttgttttcctccatgggtaccacataggtttattttaagatggtaaaaaataaaagctgactaaggtacatactgattatcctagasracatgcagacatcactaaataagagtgcagttttcatcaactcaccatttgttttaattagaaaaaaactcatcaaaactgaatttctctgcatgarataccttttcaaatcacattgaatgtcatttaatagtaatttatccacttcagttt

SEQ ID NO: 28295 - DNA, 232 bp, Homo sapiens
aggagtagtggctttgttcccagctcagtgaagggtggcatggtctctcctgtccacttcactctggattctttaaccctgtgaattactagacatggattccatctccaatgtggatgcctctcttcaccacaagaatacatgctcctttctgggctgtggcttagctcggtcaaggagtgtgatgactggcgagcagatggctgccttccatccatcgtccaccccctaa

SEQ ID NO: 28296 - DNA, 298 bp, Homo sapiens
ttagtattttaactttttaaactcttttgttgaaaactaagacacaaaaacacatgttagcctagatccacacagggtcagggtcatcagtatcactgtcttccacctccacattttgtctctctggaaggtcttcaggggcaataacacacatggagctgtcatcgcctgtggtaacaatgccttctacagtacttcccaaagggcctgctagttcacttaattcttttatagagagaaggagtacactctaaaacactgatcaatagtatattatagtaaatacataaaccaggaa

SEQ ID NO: 28297 - DNA, 148 bp, Homo sapiens
tctctgaagccaagagccgaccttctgagccctcaagaaagatcagaacagattcatgggtgatttagcctatctgtcccaggccagcgtggctgagtgtgctggctggaggcctctctctctgcttcgagggtagctgagatccata

SEQ ID NO: 28298 - DNA, 148 bp, Homo sapiens
cagtaatgcgaattggaatgctcccatctgtttggtaatgtgtgtggctgggttctggagacaaagagtaaaagaacatttggacggtggaaggttgcctaaagggattccagcaggctgttgtcgggagatgcataaagaaacggct

SEQ ID NO: 28299 - DNA, 438 bp, Homo sapiens
agttggtataattgagagatcttccttaccagcacgtttttattgagcaaaaaattgtgtcataagttcctttaatattatgcttatttctaatatgtcaattttacattttctaataaatgtttatagatctttaccagctgtctttccgagttcatccttcagttttcaataagtttatgttgccttttttcctaatataatttattaaaagtttaaatttttaaaattataaaacatttaggaatttttctgtacctattaaaatgattttactccctttttttaaagcaaagacaagctgaattagaagctgctcggttagctaaggagaaagaagaggaggaagtcagacagcaagcattgctggcaaagaaggaaaaagatatccagaaaaaagccattaagaaggaaaggcaaaacttcgaaactcatgca

SEQ ID NO: 28300 - DNA, 130 bp, Homo sapiens
  misc_feature 104: y=c or t
  misc_feature 105: y=c or t
caagatatttttcatcattgagctaagtagtatactataattacatttatatagtagcatagtagtgtactatgattacatttctttttatttgctagttattyyatatatttgttaactttacgtacgc

SEQ ID NO: 28301 - DNA, 410 bp, Homo sapiens
tctgtgataggcatatgctttgagaccagattctctttatcccccaggccataagtaagctgatccttacattgtttacttgagtcaagagattgtgaaaagctcattggccaccaaattcaactggttctaggtcctacttgttgctggagtctgcgatttgggacttccccactctccgaacacccccagcccccctacccttctgcttctctcattactttattctatttgtgttcactcttagaagctaaaattcgagtgcttgtatgatgtccaccagtagtgagaaagtgtcagtatgagggtatgtgagagagagcacatgcaagtgaaaatgtaagtttgagttagtgcatgtattttagtttccacatttcaagaggggtatgaagaacttagaggacgaa

SEQ ID NO: 28302 - DNA, 446 bp, Homo sapiens
  misc_feature 299: w=a or t
  misc_feature 333: r=a or g
  misc_feature 341: r=a or g
  misc_feature 349: m=a or c
  misc_feature 383: r=a or g
  misc_feature 409: r=a or g
  misc_feature 410: w=a or t
  misc_feature 415: m=a or c
  misc_feature 416: y=c or t
  misc_feature 425: m=a or c
ctcaaatactactattaatcattgcaaatacctaatttacataacattctgtaagtattgaaaaaaatgagccatacctattcatttgaatcctgagttttctttggattatttttttttgaaagttgaagtaagaattactttgttttaaaaatttgtttttttatttttgccttctttttccacagtacttcatttaggtgccaattatatgaatagaactgcctgttctatgaactgtatcccacttaatgtaaggcatcacggattgggtgatgccacattactttatatatcgwtaagataatgtttaaagatgttgccagttataartgtaatarataatgamttgtaaacagttttccaatgtcaggagatgttartatataagagaatagtagcttatatrwgagamyagtgagaamtgagcatctgagaatgactga

SEQ ID NO: 28303 - DNA, 449 bp, Homo sapiens
  misc_feature 293: s=g or c
gactcgtgagcgcgccgctgccgggaccgctcctgggccttagagaagacgcggataagggccaaggaaagagggaggtagcggttgctgagctccttcggcgcttcggctcctgtagctctgactattcggaccgtcaaggtagaataggaggcggccagttccccgctctaagaagttgcctgcgctctgagagacaggtgccgctgtgttgcctaggatgatctcaaaccactaagctcaagcaatcctcctgcgtcgactttccaaagcgctggaattatgggcgtgascactgtgcccagagtctcactctgctgcacagcctggagtgcaatggtgtgatctcagctgactgcaacctctgcctcccaggttcaaatgattctcctgccttcacaatctatacatctgacaaaggactaatatccagaatctactacgagctc

SEQ ID NO: 28304 - DNA, 185 bp, Homo sapiens
aaatgctggaaggaagaaggagggaccattagttgaactaagaggtatgttgtttatactgttgttgtggttgtccctgggtggtctgaaattttggaggagggggtagggaaaggccccctaaaccttttttaaactagtataatacaacctgactgctacctgcagtttcccaattacccaac

SEQ ID NO: 28305 - DNA, 330 bp, Homo sapiens
aggctcggctgggtgcagtggctcatgcctgtaatctcagcactttgggaggcctaggcaggcagatcacctgaggccaggagttcgagaccagcctggccaacatagtgaaagtctctactaaaaatacaaaaattagccggatgtggtggcagtcacctgtaatcccagctactcatgaggttgaggcaggagaatcgctttaacccgggaagtggaggttgcagtgagccgagatcatcacgccactgcactccagcctgggtgacagagtgagactccatttcaaaaaataaaataaaataaaaataaaaaaagaaactgaggcca

SEQ ID NO: 28306 - DNA, 84 bp, Homo sapiens
ttttaacaataaagaatgaaacgggaagaaatttccgattaatacttatgaacccagaaaatgaagttagtcattgtagcatga

SEQ ID NO: 28307 - DNA, 397 bp, Homo sapiens
  misc_feature 312: s=g or c
  misc_feature 315: d=a or g or t
  misc_feature 330: d=a or g or t
  misc_feature 331: n=a, g, c or t
tatttcagcttccacattttatttcaacaacattagtcatcgtagctgcgtattcctgttttcagtgtagtaacgttgagcatttatgttcctagcactcttccaggtaccctgtgcgttatgaggcaggcacatctctcctgaaagaatttatattcttgtcagggaaataaggcttcagataagaaaaaattcgggggaaagtgcctaattccttctaccctaacctgcctccatttcctccctcctccgagttgagatgattgggtcagagccagctcttcctgggcttgggaagaggagatggggttsaadtgctgctgccccccdntaacctcagagtctatattgagactctcttgctcaaactctcctcgcagagtagaacgaacaggct

SEQ ID NO: 28308 - DNA, 386 bp, Homo sapiens
  misc_feature 323: d=a or g or t
  misc_feature 335: k=g or t
  misc_feature 336: k=g or t
  misc_feature 337: k=g or t
  misc_feature 345: k=g or t
  misc_feature 358: k=g or t
  misc_feature 361: y=c or t
  misc_feature 367: d=a or g or t
tgctctcaaaagaagagcctatttaagagactagtattataaatctttttgtacataggaataatcctttgataatacaaagtagattcccttgaagatctttattcacatattgaatttatccaatgtcagtttttataaagttaacctaggtagtgtagtcatttttgtaaattgagatataatttgcatatagtgaaatttaccttatttaatgtataattctgtgagtttcaacaaatgcatagttaggtaacaacataatcaaaatgtagaacaattccatcactccgaaaaaattccctcttgcagttttttttttdgtttttggtttkkkgttttttkgagacagaatctkgcycttgtdgcccaggctagagctcagt

SEQ ID NO: 28309 - DNA, 208 bp, Homo sapiens
attactattacaggaaaaaccctcaggtgtggtcgaaccccagtgacctcctggagattctggtcccaggtgaaaaagccaccacacttctttatataattttggggaaccagataggttgttgggagtttggttgatgactgatcatggcaaggaccccagaaggatgtgttgatggatgggctgaaggcgtgaggaagaccccgat

SEQ ID NO: 28310 - DNA, 169 bp, Homo sapiens
gtgatgttttctgtgggatatttacttatttaaatagataaatgcctttaatctcgtagtaggtaaaaaacttttttataaaagatatccttttctattgtgaagtgaattttattatgaatggatgaggaagtttatcaaatgcttttccataattatggggagaact

SEQ ID NO: 28311 - DNA, 258 bp, Homo sapiens
ttttgttatgtctaatggaataattgagctatatctatctttaggaaatgtaggagggggaaatgaggaattattagtcaaagggtacagagttttggttataaagataagtctcagaaatcttttgtacagcgtggtgcctatagttaacaatactgtattgtatggttaaaaatttcctaagaggatagatcttacgtaaagtattcttactacaaacacacaaattagtgatagtaaataagagagtgggaaaga

SEQ ID NO: 28312 - DNA, 89 bp, Homo sapiens
actcaaaatggattaaaaattcaatattttttttaatttttagagaaattataggacaaaaattgttatgcctcagagaggaaggaatt

SEQ ID NO: 28313 - DNA, 235 bp, Homo sapiens
atagacatagatatggattgatatagattttttttgagacagagtctccctctatcgcccaggctggagtgcagtggagcaatgatcgcagctcactgcaacctctgcctcccagtttcaagcgattctcctgcctcatctctcaagtagctgagattacaggctctcgccaacatgcccagctaatttttgtattattagtagagacggggtttcaccatgttggccaggcgac

SEQ ID NO: 28314 - DNA, 265 bp, Homo sapiens
  misc_feature 139: s=g or c
aaatcttgctgctgctcactctttgggtccacactgcctttatgagctgtaacactcactgggaatgtctgcagcttcactcctgaagccagcgagaccacgaacccaccaggaggaacaaacaactccagacgcgcascttaagagctgtaacactcaccgcgaaggtctgcagcttcactcctgagccagccagaccacgaacccaccagaaggaagaaactccaaacacatccgaacatcagaaggagcaaactcgtgacac

SEQ ID NO: 28315 - DNA, 259 bp, Homo sapiens
  misc_feature 247: k=g or t
ttaggaccttaggcaaatgcataaaatagatgaaaatatgtctttgacagtcccactgccgtaagaaaaaaaaagctgtgtacctttttttaatgtttctattctaatcttttcaacatcttttgtaagcttgagacaactgattttaacataacttaatttggtactcgcttcttttcccttcttttcactcatactttctcctttttatgactccatcttctctatatttttgctccttttcttkgtccccaccccc

SEQ ID NO: 28316 - DNA, 451 bp, Homo sapiens
  misc_feature 13: y=c or t
tgtttttcttccyattcttccccaccctgtgaaccctctgtccacattttgaggatccccagttgtgtgaggcacagtggaagacatggctctgcttgtagccctcgaagctgcaaggaaggaaaaagcctctttctctctttgtcttcctggcacttctggccactcaagtggccctgactgctacttactcagctaatgctccagagccgaacactttctatcagggaaacaagtggcaaacctaatcttttaggaagagacaaaggcagggcacaggatgaggggaggaagaggaggacactgagagggaaggcaggagcatagttgacccttgaacaacacaggggccaggggtgcaagcccccaatcccatgcagcggaaggtctacatctaacttttgactctccaaaaagttaactagtgatagtctcctattgactagaagcc

SEQ ID NO: 28317 - DNA, 174 bp, Homo sapiens
agttatactggaggaaagcattgctttctaatcctttaagataaacattccagacacaactgtggttagaaccagaggaaaaaaattacaggagctggtgaaaaagttgaaggagagggctattatctcaggcctttgcaaggggacgaaacagctaaaatagcaaggcacggt

SEQ ID NO: 28318 - DNA, 393 bp, Homo sapiens
cttactctatgagtaatctatcttttttggtagcttttaagatttcttgtgatattttccaatttctgtggaatgtttctacgtgtggatttattttaattattccgtttgacacattgtaaattttgactttttggaaaattttactcattttctctctaaatagtgctacttcaccatttcttcttttctgaatctcttgtcgacatattttggggatctataattgtttttgtttttgttttgagacggagtctcactctgtcacccaggctggagtgcagtggcgcggtctcggctcgctgcagcctctacttccccggttcaaacaattctcgtgcctagcctcctgagtagctgggactgcaggcgcgtgcccccacacccggcaac

SEQ ID NO: 28319 - DNA, 324 bp, Homo sapiens
acacaagattagaaaactcacatgcccacagtgctgtgcaggttacctgagtgactgaagcagctgtcttagtccatttgggctgatatagactgggtagttcataagcaacaaaatttatttctcagtgttttttgtttgtttgtttgtttgagatggagtcttgctctgtcacccaggctggagtacaatggtgcgatcttggctcactgcaacctctacctcctgggaaagtgattctcctgcctcagcctcccaagtagctgggactacaggtgtgtgtgccaccacacccagctaatctttgtatttttagtagagaca

SEQ ID NO: 28320 - DNA, 433 bp, Homo sapiens
  misc_feature 51: s=g or c
  misc_feature 75: s=g or c
  misc_feature 76: n=a, g, c or t
  misc_feature 239: y=c or t
  misc_feature 309: y=c or t
  misc_feature 312: y=c or t
  misc_feature 374: y=c or t
  misc_feature 375: y=c or t
  misc_feature 383: m=a or c
  misc_feature 392: s=g or c
  misc_feature 408: m=a or c
tattaacttaataaatgtatgaagtcttaaatacctcttagttctcattasatttaggaaaattcacactagcasnaataaagctgttaatgtaacagttgtggaaaagtgttctagcaacagcatatacttatcatcattgcctttccactactctactatctgtgtgatattagacaaaatatttgcttcttggtacctcagctgtaaaatgaaacacacctaaaagtgtggttgtytccaacatgtataatacagcaacaactatctggcccaaactgctttggattaatattggatattactgtyttyattatcatcaacattattattagtggatttcttaataggaagatgcaatggagatgacaaayytggaaaamccactcatsacttacatttcatgamgtacttctttgataaaatctgttat

SEQ ID NO: 28321 - DNA, 64 bp, Homo sapiens
aactagcttttttttttctcttggagcaaaaagttggaacaagttttttgtttttttttttttt

SEQ ID NO: 28322 - DNA, 77 bp, Homo sapiens
gatgtcttttcatttggaaattcatttctgggaaagtttgaaagttggctttttggaaaattacttttttttttttt

SEQ ID NO: 28323 - DNA, 174 bp, Homo sapiens
gttatctgggtgtggtggcatgcgcctgtagtcccagctactcaggaggttgaggtaggatagcgttcttgaacccaggaggcagaggtttcagtgagccgcaagatggcaccactgcactccagcctgggcgacagaacaagattaaatctcgaaaaaaaaaaaaaaaaaaaa

SEQ ID NO: 28324 - DNA, 401 bp, Homo sapiens
cgatggtaaagaggctaaagctaaaattaggttttgggttttgggcagttactcatatttcattgaaaatgaaagactaattgtatttttattttaatagagaaagatatacatatgtgtgtattgtctgtaattaaagtacactcagtacagtgttctcatttttttgccctaggggtttttcagcttggggtctgtcaccctagtctctgcttttcataggctgagggataaagtcatgatcatgattagaagtggaggacaacccacttgaaatcccctcctgatgatttccccttttctccacgattgcagacctgccctgcttactctaagagcagtatgttagctggccgcttctgtaggatggtttgggagaaggaagatagtatcctggcgcc

SEQ ID NO: 28325 - DNA, 448 bp, Homo sapiens
  misc_feature 374: n=a, g, c or t
catgaacctgagtgagcttttcagatatctgcaacaactgataggaatggatctttgatttctgccggtgacaagtccccggcactgctgacatcattgtaggttgttgtctacattcataattgaaggaagtgcaaattttcagttagaggttggtgaaaagaaagatgacatttttctccaccccagtccatggactctctaaatcctatccatggtccttttggcagtgccctgcctgtgctgccctatgtgagctggccctcaccttcatcttggatccttccctcctcctccattcacaagctggtctcccttttgtcctttgaataacacacgcttgtctccagcccagagcctttgcactgttctcnttacccggaatgttcttcctcacactttttcttccaggggactttaaggtctcagtccaaatatcatctccata

SEQ ID NO: 28326 - DNA, 440 bp, Homo sapiens
  misc_feature 376: k=g or t
aatttacgccagtccagtcgcctggtgtgcagggtctggagcgggggtgggggaaaggcgggccaaagaatggacggccgaggggagtagtgcagatctgagaaggtaggggaggcgggaggtcccgcttcgagtgccgcagcctgctccccatctccccccacacaccatcaaatctaaaaccgtgtgtttgagactatatgcctgtgtgctgagatgtgtgcgtgacgaggtctgtttgtgtctcctcgacctagctgaggaaaacactcctgctaccgagagagaactaaatggttggtcagggaaaatggaaaagacagtgatagctttaaaagttaaaagtgcagccggagaatatgggacctgctgttckctcaaacttttctttttgtctgcatatccatctacctatccatgattatatctcctattcatga

SEQ ID NO: 28327 - DNA, 80 bp, Homo sapiens
tttatcacttccccccattttgtttatcaatctcacaaaaacctagggtttcctatcccctctttttttttttttttttt

SEQ ID NO: 28328 - DNA, 263 bp, Homo sapiens
taggagttcaggaccagcctgggtaacatggcgggaccccatctctgcaagaaatacaagaattagccaggcgtggtggcaagtgcctgtcgtcccagctactctggaggctgaggtgggaggatcccttgagtcgggaggttgaggctgcagtgagctgtgatggcatcactgcattccagcctggacagtagagcaagactccgtctctaagaaaaaaaagagaaaaaaggacttaatggctaccttaagacacccgcacc

SEQ ID NO: 28329 - DNA, 365 bp, Homo sapiens
ccatgtgtgatttgcttgtagaaacaattttgaaagccccttgaggaaaataaaaatcaagaagaacacttttctcccttttccatacaaattaaaacttaacagcatcaaattattgggaccagaaaccaagtaatgtataatgtggcttttgttgagttaaataagatgctatataatggagaagaatttgaaaatgcacaaaaaaatcaatctacattatcagaacctgcagtgaaattaaacttatgttaaataaaaccagtttgcaggtgcacaaactatgagggtcttgtatccacgtaacacaggtagttacaaaaacatgttattgtactgtgtaaagatgcatagtcatctcattt

SEQ ID NO: 28330 - DNA, 333 bp, Homo sapiens
gcttcccacttccaagatggctgcgggtggagccgaccagtttctccttggaccaagatgactgatggaaaactctccacctctacaaatggcgtacttcatgggtattctggatggtcgaccaggaaacccccttcagaacctgcaacacgtcaatctcaaggcgccccgactcctctccgcgcctgagtacgggcccaagctgaaactcagggctttagaagaccggcacagcctccagtccgtggactcggggattcctaccctggagatcgggaaccggagcctgtaccctgcagcgcggtccacgtgaggaggaagcagcccgactcc

SEQ ID NO: 28331 - DNA, 84 bp, Homo sapiens
ccagcatggagaaagatgtaggctggaaggctaagccagtctagtcttttcacgtttttattttttgttttttttttttttttt

SEQ ID NO: 28332 - DNA, 294 bp, Homo sapiens
tatagcgaatttttaaaaatcagacttctaacaataatttcatttttatttaaatagtagttcatccttttggcttctggtattttaaaaggccactgacattttttggataaagatttaaacatattaaaattatatttcagtcaggtgttttggacttccattttatttattgctattaacgtcaccatatgtaaagacaacatgactgattgaaccaaagagaattgttcagctatgtaacatatctgaaagagcattctacatataccaaataatgttaaaagcgcacac

SEQ ID NO: 28333 - DNA, 85 bp, Homo sapiens
  misc_feature 20: s=g or c
  misc_feature 21: s=g or c
  misc_feature 26: b=c or g or t
  misc_feature 27: s=g or c
  misc_feature 32: m=a or c
  misc_feature 33: m=a or c
  misc_feature 69: s=g or c
cagtatttttttttgtggasstgggbsgcaammtatgttttcagttctttttcccttaggtctgtctasaatcctaaaggcaaat

SEQ ID NO: 28334 - DNA, 347 bp, Homo sapiens
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcat

SEQ ID NO: 28335 - DNA, 374 bp, Homo sapiens
attttcagacactgtgctttatcctgaaagatttggtgaaaagggatctctgaggtgaatatctgctctgcttggcctttgagagaaggggagtgggcaaggctggtcttgggcaaattacttccacctccctttttgcccctgcttcagctccaggggagctggaaatgcacaggaggagtcagaagacctgggttcgagtcctggctctgccacttactacctatgtgactttgggaggaagaaggcacctacgatcaaactctggagttccgtagggaggtgatggccagccaagacgatccactcggccaacccaacagttttaccaaccaccccgggctcggaactaataggaaaagactctttgtgaa

SEQ ID NO: 28336 - DNA, 241 bp, Homo sapiens
aacctgctggcagatgtccattcagaatccatttgttccactctagtagaaacaaactcactgcttaacaaggcagccccgtccactgctgggcacctcttgagtgctcatctcctctggatgcttcttagcttaacagccctcataaatcaaatgtagattccagaattggacatcatgttcctgaaggttactcaatgaaaggaaaacaacagctgccttgctctgaacactgttttgt

SEQ ID NO: 28337 - DNA, 55 bp, Homo sapiens
tttttatttttaaactagtcttcaaagtcatgaattggttgactaatataccttt

SEQ ID NO: 28338 - DNA, 105 bp, Homo sapiens
  misc_feature 24: m=a or c
  misc_feature 42: m=a or c
  misc_feature 101: m=a or c
gttcagtgactgagacaaactggmggtgaaaggagctggtamtgtccactgtgctgtcggtgctgaacctgagacgcgagcggaccagttgctccagcacmtgaa

SEQ ID NO: 28339 - DNA, 72 bp, Homo sapiens
  misc_feature 37: n=a, g, c or t
  misc_feature 40: s=g or c
  misc_feature 41: s=g or c
cccctccctccccagccttccccgcgagcggacgcgncasscctctgtctcgctttttcttatttttccccc

SEQ ID NO: 28340 - DNA, 326 bp, Homo sapiens
  misc_feature 87: k=g or t
  misc_feature 96: w=a or t
  misc_feature 99: y=c or t
  misc_feature 107: k=g or t
  misc_feature 112: k=g or t
  misc_feature 239: m=a or c
atgaatagtgttttgtttcacaaccatttttaattaattaaaaactttcaatggaattaggccaatttataaatgccttattgattkgagaacatwatycaaaattkattgkccttttcctcaaataggtaacttcagagaataaaataatagttgatcaaaaaatgggaaattaagccaggcattgtggcgtgcatctgttgtatcaactacttggaaggatgagacaggaggatccmttgagcccgggaatttgagttgtggtcactccattgtactccaacctgggcaataaaacaagaccctgcctcaaaaagcaaaagggc

SEQ ID NO: 28341 - DNA, 349 bp, Homo sapiens
  misc_feature 97: d=a or g or t
  misc_feature 98: m=a or c
  misc_feature 197: v=a or c or g
  misc_feature 249: w=a or t
ttgctcttttcgctcaacattaaggttttggagatgcatccatgttgatgcatctaagactttggtgtgttaataccaaagagtagtattagaattdmcattgtgtgaacctaccttggtgtgtgtattctcgtgttcatgaatataagggctgtttctagtttttggctgttatacatacaaatgctactgtgagvattcttgcctggcacaaggacaagaatgtctttgaaatacagtccaaggacwagaactgctaggccatatggtctaacaatcttgtttatttaggcaacttttcttagtgaaatatacaaacagaagacgcacaaatcaaaatgcataactc

SEQ ID NO: 28342 - DNA, 91 bp, Homo sapiens
tcttggtgtctgtcctttgccccctgtgccctctggattctctgggtctatgtaggcccctggtctgccctgggctcatcagccttcctga

SEQ ID NO: 28343 - DNA, 277 bp, Homo sapiens
  misc_feature 19: m=a or c
  misc_feature 95: r=a or g
  misc_feature 104: y=c or t
  misc_feature 259: m=a or c
  misc_feature 260: v=a or c or g
accgagtccgttactgggmtcagacttttaagttaatttactgcccccctaccttggccagtaaccagcgcctttagggctagcctcccccccarcttcctgcytgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattcmvcactgatcgaggcattt

SEQ ID NO: 28344 - DNA, 360 bp, Homo sapiens
  misc_feature 104: w=a or t
  misc_feature 129: v=a or c or g
  misc_feature 298: d=a or g or t
  misc_feature 311: w=a or t
  misc_feature 312: m=a or c
atagaattaatgagtctggggcctggtcatgggacaaacattttgctcttaaagtaaacagaaggtcttaaggggatcacagagaggggaagtgagggggtttwtgctccccaggttttaccgcatgcvttttttgctcatcactggctgaggtcaaagaaatatagacatcattttaaccctcaggaagttgtctcggacacccaggagacagtgctgaagggtctggaccaccatggtgggccctgtggtgggagaggcttcctagagtagagcagcccaagctggacctgaagcdtcaggagggctgwmagacccccatggtgagcagcagaaagtgtggaagtcaagtccatgggc

SEQ ID NO: 28345 - DNA, 357 bp, Homo sapiens
  misc_feature 36: r=a or g
tgataactaaatacaagcagggtagtgtgtataggraacattaagctaagagttaaagaaattttggctgggcacagtggcttacacctgtaacaccagcactttgggagtccaaggcagacatatcacttgaggtgaggagttcgagaccagcttggccaacatggtgaaaccctgtctctattgaaaatacaaaaaatagctggacgtggtggcgcatgcctgtattctcagctactacttgggaggctgaggtgggagaatttcttgaacctgggaggcggaggttgcagtgagctgagattgtgccactgcactccagcttgggtgacagagcaagactccattaaaaaaaaa

SEQ ID NO: 28346 - DNA, 209 bp, Homo sapiens
tagtgatgtgttcttttcagtccatcatctggaggcacctgatggcagttttcccaatattgcgaaattaagtttgattattttgttaaggtagtgtccaccagatctctccattttaaagacatccttttctctaattactcagtggactgtagagtgatgctttgaaactgaataactaacactccctaactcagtgatttagcacc

SEQ ID NO: 28347 - DNA, 350 bp, Homo sapiens
  misc_feature 109: k=g or t
  misc_feature 296: r=a or g
  misc_feature 297: r=a or g
taatcgaaaaattgggatctaagtaaactaaagagcttctgcacagcaaaagaaaccaccgtcagagtgaacaggcaacctatagaatgggagacaatttttacaatckacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcrratcaaaaccacaatgagataccatctcacaccagttagaatggcgatcattaa

SEQ ID NO: 28348 - DNA, 339 bp, Homo sapiens
  misc_feature 104: d=a or g or t
  misc_feature 116: r=a or g
  misc_feature 120: d=a or g or t
  misc_feature 138: r=a or g
  misc_feature 151: v=a or c or g
  misc_feature 308: h=a or c or t
ttcttaaaatgtaaaatgtgcctattgttaatgttgacatccaattaaaaaaaactgtctaaacattttgtatgcaagatataactgaaaggtggaatcaactdatgagatggctrtttdcaaactctagtctagatrggcatgtatgtgvatcaaccacagaggagatattaggtataggagtggaaaaagcttagcttccaatgagtctaggatggaataaaaaagaatgtgatttatgtgccatacgagacggtggttatattggattcattaatgcctaaaaccttgttcatcacaaaattgghggaggtgatgtaaacaaaaagagaagcatgc

SEQ ID NO: 28349 - DNA, 252 bp, Homo sapiens
  misc_feature 114: r=a or g
tcattaaaatactttttaaagagaaatgactactgtcagtcattctgtgcattcatcgcacctttaaggggtttctcggcgaataagcagcttccagttttgcaatccgggacrgcttctggatcaaccacagcagcgtggccggcctgccgagctcttccttcacctcttccttctcttctccgtcagactccgccttctcatctgcacaggccacaccatcttctaaagcttcttgttcttccaggtgcc

SEQ ID NO: 28350 - DNA, 343 bp, Homo sapiens
  misc_feature 39: k=g or t
  misc_feature 43: k=g or t
  misc_feature 95: r=a or g
  misc_feature 100: k=g or t
  misc_feature 110: h=a or c or t
  misc_feature 196: k=g or t
ataattagggcatgttgcttaggtcaatttttttttctktttktaacacaggatcttgctctgttgcccaggctggagtgcaagcggcatagtcrcggckcactgcagchtggacctcctgggctcaagcaatcttccggcctcagccttttaagtagctgggaccacacacatgcaccaccatgcccggctaatktttgtatttttggcagagatgaggtctcgctatgtggcccaggctggtcttgaactcctgagctcaagtgatcctcccaactcggcctcccaaagtactgggattataggcatgggccaccacgcatggcctaggtcaaatttttat

SEQ ID NO: 28351 - DNA, 316 bp, Homo sapiens
  misc_feature 153: d=a or g or t
  misc_feature 192: m=a or c
ctaaaaatgaccaatgtagccatcagaaaggcaaggatgcaaatttcacctccacttaacagctgtctggtgtaggacaagttgtctgactcacttagttttgtcttctctgaaatagggaaccttatacctcatggagttgtcacaggaacdtatatgatatagtgcttgtaaagcttttagcacattccmtggcataagttaagttgttctataaacaatagttattgtgattcattttgttatctttcacaagtttcagcagagtacaaggaaatggtagttgcgtattcaattgaagtggatgaaatcagac

SEQ ID NO: 28352 - DNA, 64 bp, Homo sapiens
cattttaaaatctaggtcatgattgtttttatcataagacatatttttaaatcactatgtaatt

SEQ ID NO: 28353 - DNA, 57 bp, Homo sapiens
agttgggaagatggtgaggctgctgctggctgctgggcggaatgtaagtgggggtgc

SEQ ID NO: 28354 - DNA, 169 bp, Homo sapiens
attttcagggacagtcttggttttattcagttccattcttttcagttacgatgattttttgtgtgttttgagatgggatctcgctcacttcgcccaggctggagtgcagtgttgccatcatggcccaccgtagcctcaacctcccgggctcaagagatcctcctgcctc

SEQ ID NO: 28355 - DNA, 167 bp, Homo sapiens
  misc_feature 69: k=g or t
  misc_feature 72: k=g or t
  misc_feature 77: k=g or t
  misc_feature 80: k=g or t
  misc_feature 144: m=a or c
  misc_feature 147: m=a or c
  misc_feature 150: m=a or c
catgaggcatgggaaggtgttttttttctttgtttgtttgtttgtttgaatgcagttgacttttttttkgtkgtatkgtkgcaaaagtaatccatgtgattgatgtttattatgaagaaaacatttaatacagatgaaccaggmgamgamaatgaagttcatcctta

SEQ ID NO: 28356 - DNA, 242 bp, Homo sapiens
tatttttttgaggtagggtctccctgtgtcactcaggctggagtgcagtggcactctcacagctcactgcagcctccacctctcaggcccaagcaatccttccaccctggcctcccaagtagctgagaccacaggcatgcactaccatgctggctaattttttatttttatttttgtacagattgaggggtgtccctatgttgcccaggctagtcttgaactcctgaactcaagcgacccga

SEQ ID NO: 28357 - DNA, 338 bp, Homo sapiens
  misc_feature 88: w=a or t
ctcaaaatcaactctcttatggtattatatctctgtatgccattaaaaaacagcttgttctagaatcatgtattttgtaaactgatgwttgtgatggtctctggttcttgaacagccatatctgaatgccgtgcctgcaaaactatgacatttttgctgttttcagccttcagatttgatggcttgggaaactgaggtgttattttcaatgaaacaaagaaagagatgttaagcaagtggttgttttagatccaaatgtaaaggcaggtttgggaaggtgtttaaagagttggaggaattggggattgagttgtaaagaaaacttacagaagaggcac

SEQ ID NO: 28358 - DNA, 272 bp, Homo sapiens
  misc_feature 150: y=c or t
ctctcattttgatttaaaaatagatgttataaggcagcaagtttgaaaaatcttggccttaaggtctatgcaagtaataaaaggttctctgaccactagtttaaaaagcacagttgggtttatgtgaaaatatgcctttaataacattgyatacatattaaattttacctttttatagtgctttgcagttttcaacattgcttcatataaattatttcttcctcacaatgattctgtgaggtagcattattatccttattttagagatgcac

SEQ ID NO: 28359 - DNA, 264 bp, Homo sapiens
  misc_feature 71: n=a, g, c or t
  misc_feature 72: n=a, g, c or t
  misc_feature 83: r=a or g
  misc_feature 86: r=a or g
  misc_feature 87: r=a or g
  misc_feature 98: m=a or c
  misc_feature 150: w=a or t
  misc_feature 174: r=a or g
cattgatgccttcctctaaccctaattacctgccaaaggccccaccttcagatatcacactgggggttaanngcttcaacatrcgrrttttggggggmcacaattcagcccacagcaatcatgcatttattacataatcataatgcattwcacaatcaacaaaattaacatgartttttctggtgtcatctaaaaatcaaggcatgggtggctcatgcctgtaatcccaaagtgctgggattacagatgtgagccactgcgccc

SEQ ID NO: 28360 - DNA, 296 bp, Homo sapiens
caatggctaaggcacgttagagggggaagggaagctatgaaacatcctaggagggtttttggtagataattggggcatatctaaaagctcagtgaggctactgcagttctggattcgcagctagcttattgataagatttggcgtgaagagattgtgtggagtggtcaaaaggggtacatggggagaagaaagattgagaaaggaacagtgagaaaggcgggagggaaaccaggagggctgcgaactacctctacacggatcgtttgaaagtagaagtagagtggaaaccaggcac

SEQ ID NO: 28361 - DNA, 353 bp, Homo sapiens
  misc_feature 179: w=a or t
aattcaggaaaaaaggttggttacatctgtactgaacatgtacagacttttttccttgtcagtatttcctaaacagtatagtaataacaaccatttcatagcatttgccatatattaggtattgtaagctagaaatgatgtaaagtcgtaggaggatgtgtatagcttatatgcaaacwctatgccatttcatgtaagagacttgagcattcttggattttggtatctgcaggggaccctggtaccagccccctacggatactgagagacaactatatttcctcacttcctggtctttcagaaaaagatataacaccgatccctttccttttgggatttaaaagccaaacctt

SEQ ID NO: 28362 - DNA, 362 bp, Homo sapiens
  misc_feature 84: r=a or g
  misc_feature 210: r=a or g
  misc_feature 321: s=g or c
cgtttttgaaaaattgaatgaaattttcactgtcgggggaaggcagagaaagaggtagtgagttgtattatatgatattggagrtgtaggcagtggctgaatcctgtaatgtttctagaccagattgaggattttggctcttaccaagaccgatgaggagtcatttaaaggtcctgagtagaggaacaacaagatcagatccgtgagtgraaaaagaatgtggtattgacaagaagaccaagagtagaccagttagaagtaaaaatgagaaattatgggaatttggttgtggtaagggccagtggagagtaaaaaaagggscgggtttgagaaatgttcaggaaaattgaggactaggtggt

SEQ ID NO: 28363 - DNA, 420 bp, Homo sapiens
tgctgaaacattgcttatatgttcagaaaattcagggaggttttagtcatctgcagaaatgataatgctttgaaaatggtctacatgctatgcatttgcttttcttagagacttttggagcccccctttagggaaggttaaccttttgttgtcattgccactaccagcaagtacatgatggcatgtgttgagagctgtgttctctttgttttggttagacatgattcctgccctaagagctaatctcatttggagggaaatgaagggaccaagtacagtattcacagtccaccagttaggactgaacacatagcccaaggtgtttaagaagaaaaaggccaggcgcggtggcttatgcctgtaatcccagcattttgggaggccgaggcaggcagatcacctgaggttaggagtttgaga

SEQ ID NO: 28364 - DNA, 360 bp, Homo sapiens
  misc_feature 299: k=g or t
taatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagttkcgtttgttttctcatatgaagtttataattcctttcagtcctaaaatgtcagatgccagga

SEQ ID NO: 28365 - DNA, 401 bp, Homo sapiens
catgttttgtttttaatcactattacctgagttgaactttgctcaccatgtttgtacttgttggtctgtttaatgaagtttggttgatgccatcctttgcactgccgaagcgtaatcttgtgtattacttagctctctgctgatctcagtatggacagtgtaacaacaaaaccaaaatggctggacagacttcttgtgttttgtaaatataaactaggacagttctgtaggtttgttcagtgtgctagtggagtatttccttaatgtaaaacttcacttaacagagagattctttgtttagcaagcttggagtgatgataaaatggtaagaaataatataaatgttgaagaaagcatcacaacagaactataggagtctaaatttaataaatctttaaaaa

SEQ ID NO: 28366 - DNA, 59 bp, Homo sapiens
aattgctctacagggttttcttttgtttcttgtctaattctaagcactttttttttttt

SEQ ID NO: 28367 - DNA, 314 bp, Homo sapiens
  misc_feature 264: d=a or g or t
aaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccgdcagcaccatttacaagctgtgtgcaagttgcttcaccactctgcgctgtt

SEQ ID NO: 28368 - DNA, 196 bp, Homo sapiens
  misc_feature 124: r=a or g
  misc_feature 160: m=a or c
  misc_feature 161: h=a or c or t
  misc_feature 162: n=a, g, c or t
  misc_feature 167: r=a or g
ttaaacagggttgccacatgacccaatgattctacccttgggtatattcccacaaaatgaaaacatatgtccacacaaagacttgttcacaaatattcacagcagaattatttatgatagccaraaagtggaaacaacccaaatgtccctcagatgatgmhngggtrtgttaaaagtggtatatccatacaatgga

SEQ ID NO: 28369 - DNA, 376 bp, Homo sapiens
tataagctctttgtatacattctcatttaatctcctaacactgcgatatatatatgatagcaatcccatttgaacactagaaaactgaggcatagagaggatgaaaaaaaacgtaactaagggtatttcaaccaataaatagtagacagtacccacattcactgttagtcttaaggatctggcatctgggaagaattttgatgtccatggtcgttcctaatccactttcatgttttgtcattatgctgaggaatagcaaataaaagatgagaatttctcaactgtgtctacatgtgaagcatatcatagacattatgtgcggtataaatactaacaaatgtataagtacacatgtacaatattgtgtattatttaa

SEQ ID NO: 28370 - DNA, 336 bp, Homo sapiens
  misc_feature 298: s=g or c
atttgagtaccgagaataaaccatatttctgtttagaggctggttggcttaaaattgtgtctaatccttcccctgcccccccaactccgaatcagagaatgaataacaaataaacatgacaatgaagtctcatgctgttgttttcatatttgtatttaggagtttcagagcaaatgacttggaaaacaggcaaatccactgacataggcatttttagccaccttggaatccgaggagggattctgcactatgccctgtaacctcgttcacatgccgtttgaatgtataccatgaagascccttagctcagggagctttgctctatttaagtaatgt

SEQ ID NO: 28371 - DNA, 219 bp, Homo sapiens
aaactaagaattgaagtgcatattacaattgagatgtattctcataccataaattcactcctataaaggatacagttcagtgatttttagtacattcacaaagttggacaatcaccatccctatctaattccagaacatttttatcacaccaaaaataaaccccatactcattaagcagtcatttaccatttctctctcccctcagcacctgggaaccg

SEQ ID NO: 28372 - DNA, 430 bp, Homo sapiens
  misc_feature 106: r=a or g
  misc_feature 416: b=c or g or t
  misc_feature 417: k=g or t
aacctgaccatgaaatacagacagccatattctgagctgcaaactaaatgaaggccttggtgatgggagaaaaatattcgatgttctacagccagccaagtgtttrccctcccttttttcttactactcctttcttgtttttgaaggcatcatgtgtgttgggaattggcaaaaaagcttattctgagtaaagcaatgccagttgtttggcagatggaagatgtgggataaaccctagcttacagatcctcccagagtacaatcgggaaaagagctttccttccagataatatacctagtgagaaatctgttcaattgggtgaggcgatctacagtgaaaaagggacagagctagagggtaggaaaattttcccctcgctttatctatacagcagacttttctttttctcactaabkactaacagcatta

SEQ ID NO: 28373 - DNA, 307 bp, Homo sapiens
  misc_feature 102: r=a or g
  misc_feature 103: w=a or t
  misc_feature 104: k=g or t
  misc_feature 209: h=a or c or t
  misc_feature 276: w=a or t
ctgcctaccgggttcaagcagttctcgtgcctcaccctcccaagtagctggctacttggcccagctaccaggcccagctgatttttgtatttttagtagagrwkggggtattgccatgttggccagtctggtcatgaacttctggccttaagggatctgcccgccttgggaagcactcccaaagtgctaggattacaggcatgagccahagtgcctggcttctatttacaagttctattaggtacttacagaaatgtatgttaggtttttaagaawgctgaaataggaaagtggaaatgctgtgggc

SEQ ID NO: 28374 - DNA, 383 bp, Homo sapiens
caaacagcagtcatctcgaggcattttattaatatgggtacaaaggattctcaagtaagaaatattagctgtccatttagagttggtcgtaaactacattttacagtcttttcttgcttccctctagggcgttgcctagctaaggcattagttatttctatgtctgtgacagtcttctcccaaacaaatatttcatgccagattgtgcacgtttgtgagatttcccagtaaggatgttgaaaaacagagtgcacgaataatatttcaatgaacaagatttatacatccctgaaacagcatttaagaacacgcacccatctaaaaatggaaaaatgcttcaatatataaagcaatagatttgtacatacagttttttttttttt

SEQ ID NO: 28375 - DNA, 206 bp, Homo sapiens
  misc_feature 99: r=a or g
  misc_feature 102: s=g or c
ctctgctaaaaatggaaaaattggtcgggcgtggtggtgggcgtctgtgggcccagctacttgggaggctgagaatctcttgatctcttaaacccgggragscggaaggttgcagtgagccgggatcgtgccactgcactccagcctgggtgacaggaataaacaaaacaaaaccatagagaaaaatatcaaccaagccccagtga

SEQ ID NO: 28376 - DNA, 243 bp, Homo sapiens
  misc_feature 97: r=a or g
  misc_feature 98: m=a or c
cattttggaagttctcagcatcaagatggtgtgaattactcaggctgtgagtgtgtagaatgagataaaaagaggatcacaaccagcatttaagggrmcagggaggaagaagaaaaaagactaaggaaagagggtcagagatatgggagaaaaccaagagcacaggatgccacaaagccaagggaaacaagggtttcaagaaggaataagtgccaagtgccactgagtgattaagacaaggcc

SEQ ID NO: 28377 - DNA, 253 bp, Homo sapiens
tgtgcttttacccaaggaacaatagataatttgggaatctttgaggccttctcagaactgaggttattcagaagacagcatggcagattagcatccaagatggaagttgctttggcctccacactccagcctcccaaaaccagctcttaaaatctcatgcactcttcctcttctatgatggtctcttagcctgtagggagggtggctatagctttagtagcagtacattggcaatggaaaacagctcaggccc

SEQ ID NO: 28378 - DNA, 175 bp, Homo sapiens
gttatctgggtgtggtggcatgcgcctgtagtcccagctactcaggaggttgaggtaggatagcgttcttgaacccaggaggcagaggtttcagtgagccgcaagatggcaccactgcactccagcctgggcgacagaacaagattaaatctcgaaaaaaaaaaaaaaaaaaaaa

SEQ ID NO: 28379 - DNA, 80 bp, Homo sapiens
tttttattctagagtctgtgcaagacccagacaataaagaactaccagaaaaaaagaaaaaggtttaaactttatcttaa

SEQ ID NO: 28380 - DNA, 228 bp, Homo sapiens
  misc_feature 94: k=g or t
cgtttaacttcttgtttgtttcagtgtaatgctcttaaagtcatagcatgaaaataattgaactgtcctattcttagtagtttgaaataatagkatttttttgtatgttttgggtgtgtctatgtatgtattaacataacagttttcactgcctaggtgttcataataaaaaagaaaatgaaaaaagttctgagtgtacataatattcaataataatctcccacacag

SEQ ID NO: 28381 - DNA, 237 bp, Homo sapiens
  misc_feature 129: k=g or t
ttcacaattgctcttaattcttggggtatagtttgcctcctacatgatgcaattcagtgaaattcccaggagacaaaacaagattttgacctgaataaaccacttattgttgtaattcacaagtgagtktatttttcctggcacacttccaggtaatatccattaggctaaggattttgtttgttcactgttctatccccaagcctagagcattgcccagtgcggaatagctaatat

SEQ ID NO: 28382 - DNA, 455 bp, Homo sapiens
  misc_feature 322: k=g or t
  misc_feature 323: m=a or c
  misc_feature 324: n=a, g, c or t
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatkmnggcaccagttagaatggcgatcattaaaaagtcaggaaacaacaggtgctggagaggatgtggagaaatagaaacacttttacactgttggggggactgtaaactagttcaatcattgtggaagacagtgt

SEQ ID NO: 28383 - DNA, 406 bp, Homo sapiens
tctcaaataagcatatttatttcataaatcttaatttgtataaaaataacttcctgcagaaccagcatatccaagaggagattcaagtgggtccacaagaagaagttgggaacttcggacactaatcagccagagtaaagatactgcttctaaactaggacccatagaagctatccagaagtcagtccgattgtttgaagaaaagaggtaccgagaaatgaggagaaagaatatcattggtcaagtttgtgatacgcctaagtcctatgataatgttatgcacgttggcttgaggaaggtgaccttcaaatggcaaagaggaaacaaaattggagaaggccagtatgggaaggtgtacactgcatcagcgtcgacaccggggagctgatggccatgaaagagattc

SEQ ID NO: 28384 - DNA, 74 bp, Homo sapiens
  misc_feature 38: k=g or t
  misc_feature 39: r=a or g
  misc_feature 63: r=a or g
ttggggaagtgtctgttcagatcttctgcccatctttkrttactggagtggtgagagttcctrggtgttctcgt

SEQ ID NO: 28385 - DNA, 402 bp, Homo sapiens
attacaacttttatcagatatctttcatgactagaatacaatttaagctaattattttcctgtttaaacctaggcctgtgatacttgggctgtgatcctctagagccagcttggactcacatcattctatggggttgaagacaactcattccctctgaggagccttgtacatacaagccttttatttataacttattttgtattgaaacttttaaacaatactgaagaaaaaaaaacttttccgacatctgttcttggtcttttgtgacgcaggttgaagggggaggaatagaaaaagacaaactgccttggaggagataaaccaattttatgtctatcatgttatacaaaaatctagaaataatagatttgtacagaaaaaaatgataataaatgagacaa

SEQ ID NO: 28386 - DNA, 271 bp, Homo sapiens
  misc_feature 102: m=a or c
  misc_feature 232: m=a or c
caaaaattttaagcaattcttagtctcaagtaaacaccatcattaaaagaactgagaactattatcaattcttcctttggagtccatcttcaatggaaaggmgaagggaaaaccttttttaaaaagaagaaagaaaactgaagtttttgatttgactagagaaatattcagaagactccttattttcacctagtctaatcacaaaattgagaaacaaacattatcccttgamcatgtaaattttacaccacattatgtcaacagcatgtac

SEQ ID NO: 28387 - DNA, 276 bp, Homo sapiens
cattctcagagataaaaagactcttaactagctcaaggttaatggagccatttttcccacaacggaattctgggtatgactctgtcttctggagtgcaacacaaagcactgaagaataatgctcagatatattaaataaattgatgccatatagcctcagttgttaacattcccagagtcccttgtgctctacctataagcagtgggtgcttttctttggtttcctttcaggttggctgatggagcaatatataaagcaattaccagtgagacaga

SEQ ID NO: 28388 - DNA, 350 bp, Homo sapiens
catattacttgaaaggcacaactaccaaaattcactcaagggaaaaaaaaagataatatcagtagtactttatctacaaaataaattgagtttgttttaaaaaacgtacctcaaagaaaacttcaagcccagatagatttgccggtgaattataccacacatttaaggaagaaatactactgattctgtacaaagtgttccagaacattgaagaggagagaaaattctttgcaacttatgtgaagccagcatagcactcagaaacccaaaccagaggaaagcataagaaatccacagtccaatatctctcatgaacacagatataaagattcttaataaaatattaaata

SEQ ID NO: 28389 - DNA, 232 bp, Homo sapiens
cccctccaaatctcatgttgagatttgatccctaatgttggagatggggcctggtgggagatattcggatcatgagggcagatccctcactaatggcctggtgccctccctgtggaaatgagtaagttctcactcttttggttcacctgagagctgtttgtttaaaagagcatggcacccctccttctctctctgtcttgctccttttcttgccatgtgacactcctgcccc

SEQ ID NO: 28390 - DNA, 377 bp, Homo sapiens
  misc_feature 106: w=a or t
  misc_feature 273: m=a or c
  misc_feature 274: w=a or t
ttattattattattaattttgcgtgatgtgaataccctctcccatcaatatttgtattatggtgctatatattggtaatgatctttaatattgggaagggattttwaaaaatactgtgattaaactgggtttcttcctttgattttcatattttaaataaagccacagtcatttatacaaaagaaaagcatctgtccctgggcaaatcttttgaggacagaggtcaaagtaaactgcataaggtttttacatcatttctgtatgtatttgatmwatagatcaatatctgtacaaatttaatcttttattttcttggtaactcgtgatcattgagaaagtgtttgaaactttctcatgaagtgtatatataatggcgc

SEQ ID NO: 28391 - DNA, 74 bp, Homo sapiens
  misc_feature 2: m=a or c
  misc_feature 17: s=g or c
  misc_feature 51: s=g or c
  misc_feature 52: n=a, g, c or t
gmgctgggccacgcaasatggcgccgtccgccctgctgcgtcccctttccsngctgctggcccccgccaggctc

SEQ ID NO: 28392 - DNA, 278 bp, Homo sapiens
  misc_feature 49: w=a or t
tgtttataggttttaactcttatggttagaatggttgtgagtcatacgwgtgtcagacctctgctaatttcctcaggacacattcccagaagtggaattaccaagtcaaagagcataaatactttagagatacatgataaattgtgccagctacctttccaaaagagttgtactagttgaggtttctgccagcagtatatgacagttgggctccatattttaagagattcactaatggtgtttctcaaccttttttttttaaactgtgacccacacag

SEQ ID NO: 28393 - DNA, 137 bp, Homo sapiens
attgaatcctgattaggacttacgaggtagatgttattatccccagaactagcctcatggctgtgggcagtggcacagggcccctcgtgtgggttcatgctctgctgtccctgtcttgaaattcttagaactttttt

SEQ ID NO: 28394 - DNA, 51 bp, Homo sapiens
  misc_feature 14: d=a or g or t
cactaaaacaaatdgggacagaatgcaacatacacatgtattactttaaaa

SEQ ID NO: 28395 - DNA, 338 bp, Homo sapiens
  misc_feature 96: r=a or g
  misc_feature 98: k=g or t
  misc_feature 104: s=g or c
  misc_feature 108: y=c or t
  misc_feature 109: k=g or t
ccatatctatcatatcagttcattttcaagatgtaacaggtaatataaatttttttttgagacggagtcgtgctctgtcaccgggctgtagtgtartkggtgcsggtykctgcttactgcaacctctgcttcccgagttcaggcaattctctggcctcagccttctgagtagctgggactacaggcatgtgctggctggttgttgtatttttagtagagacggggtttcatcatgttggccgggatggtctcaatctcttgacctcgtgatccacccagcttggcctcccaaagtcctgggattacaggcatgagccaccatacccggcctttttttt

SEQ ID NO: 28396 - DNA, 446 bp, Homo sapiens
  misc_feature 378: r=a or g
  misc_feature 419: r=a or g
  misc_feature 426: r=a or g
cagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggtcagcgagatgcaacggagtgtgggcagtgtcctcccggatgttcagaagaaaaggrccctgctgaacacatgcagtagtttccaccactattaatgrccgtaargcaatgaatctaaatagtga

SEQ ID NO: 28397 - DNA, 381 bp, Homo sapiens
  misc_feature 79: r=a or g
caccttagcagtttagtttatggatgggtttcacagagttacaacccgatttatccacaggtggttttcctactcttaraaacagcacctgatcaaacagaatttttatttgtcactaaatctgcaggcaactgttcttcctgctgtgtttctcttttcttttccacatacacattaaggggactggggagtgcccggggaagagtttgatattttgcatattaaaattgcacacatgacatgtttggaaggaaggatgtagtcactcaatgcaaatatttttttcaaattttgctttctcaatgctttttatagtaaaagcatcagtgaaaacacccaatcagcatatcttaccacacttgctggtactgtagaaaaagc

SEQ ID NO: 28398 - DNA, 383 bp, Homo sapiens
  misc_feature 35: n=a, g, c or t
  misc_feature 36: h=a or c or t
  misc_feature 39: h=a or c or t
  misc_feature 76: n=a, g, c or t
  misc_feature 77: h=a or c or t
  misc_feature 78: y=c or t
  misc_feature 79: n=a, g, c or t
catcgagttcctgaagacagcccatgagatgtggnhcchtcccactcacccccacacttatctaccacccacccgnhynggccccctgtgccctacagctgagagaggacccagcagaagggagggcggctcactagcacacccctgcatggactgggtgccctgttctccatgtgaggcctaatgggaaggagttcattgccatgctttggcaaccagtacgtggctcctgcttgtcatggcagccagagggaaactgaggcacagaacctgctagaatctgggaaagttgaaaatactcccaggaaccttttctcctaacctaaccactgggcatttttgaggacgattcaacagtagaagggagggaccttgaggaaggt

SEQ ID NO: 28399 - DNA, 344 bp, Homo sapiens
tggcagtttaaaatatatataattaataaaacctgtgcttgatctgacatttgtatacataaaagtttacatgaattttacaacaaactagtgcatgaattcaccaagcagtactacagaacaaaggcaaattaaaagcagctttgtgaacttttatgtgtgcaaaggatcaagttcacatgttccaactttcaggtttgataataatagtagtaaccacctacaatagctttcaatttcaattaactcccttggctataagcatctaaactcatcttctttcaatataattgatgctatctcctaattacttggtggctaataaatgttacattctttgttac

SEQ ID NO: 28400 - DNA, 280 bp, Homo sapiens
  misc_feature 84: v=a or c or g
  misc_feature 96: d=a or g or t
  misc_feature 101: y=c or t
tttcaagtatcacaagcagcctcttttcctgagtagttgagatgttcctattgcagttatgcctgcgttaatttctccctttgvgtggaccgtttdccttycccaaactcctgattttatgatcacaagcccagcccaggatggcatttcactgagcagaggggtctaagtgttggtgggatgaggtggagggctgggctccatagaccataactgaccccattggtgctgcctctctgcatggtaccatctcccaagtacctcactcagaagtggttat

SEQ ID NO: 28401 - DNA, 342 bp, Homo sapiens
caataatattagtattttatgtgcttattgatcattcagatatcttccttggtgaagtatctgttaaaatattttgcgcatctttactgcaacttttgtcttccctttgagttatcagagctttctaaatattccagattcgagttctttgactgaaatatgtattataggtaattccttccaccaacatttatccttttaatggtatatatttaacaacattttttagtcttaaaaaagtctaatttatgttttttcttttgtgtttcctgatttcatgtgacatataaaaaactttgaatttaactgatttttaaaatattaatctgtattccgtgactc

SEQ ID NO: 28402 - DNA, 55 bp, Homo sapiens
ccccattccatcatcctctatcccccacccagctttttttttttttttttttttt

SEQ ID NO: 28403 - DNA, 55 bp, Homo sapiens; identical to SEQ ID NO: 28402

SEQ ID NO: 28404 - DNA, 368 bp, Homo sapiens
  misc_feature 198: v=a or c or g
cagtgttcagaacccatgaaaataaggcaactgtgaccagctccagctgatcaaacctccattgatccctacacaaccgtaaagccaggggccctggggctaactaattaactgatttcaatcctcagtgctccttcttaccacctatggcctagaaagaagactccacttctcagtgcctcattgtcctcatcatcvttattccagtctgttctctgagaggcttttgtaaacttttaaagttctaccaaggacatgaccctcttctgttcacaaatctccatacatcccaggacactcagattgaaggcacaacccctaagacaaccaatacaggtgtgactctggctcatcttcagtttttacta

SEQ ID NO: 28405 - DNA, 283 bp, Homo sapiens
cttaaataattagagaggtggctgggcacggtggttcatgcctataatcccagcacttcgagaggccgaggcaggtggatcacaaggtcaggagttcaagaccagcctggccagtatggtgaaacccactctctgctaaaaaatacaaaaattaactgggtgtggtggtggatgcctgtagtcccagctacttgggaggctgaggcaggagaatcacctgaacccaggaggtggaagttgtagtcagccgagattgtaccactgcactccagcctgggcagac

SEQ ID NO: 28406 - DNA, 208 bp, Homo sapiens
  misc_feature 99: k=g or t
tttttttaatttgcgtatgtcgaaccagccttgcatcccagggatgaagccgacttaatcatcagtggataagctttttgatgtgctgctggatttggkttgccagtattttattgaggattttcacctcaatgttcatcagggatatgggcctgaaattctctttttttgttgtgtctctgccaggttttggtatcaggatgaggct

SEQ ID NO: 28407 - DNA, 327 bp, Homo sapiens
  misc_feature 297: r=a or g
  misc_feature 302: r=a or g
  misc_feature 325: m=a or c
taaaccacttaaaaaaaaaaggaggaaatcccaaacttttcagacaaggaaaaagaaagttccctataagagagaataaattatattggcataaatctttcatttacaacactggatgcaagaggaaaatataacagtataactggatttctatacccagccaaactattgttcacttcaaatggaaatacaaaataggcacttatcactaacttggatagtttatcatctttaatctgtaactgaaaaaatcactagaaattgtacttgaaaaaaaacaaacaaacaaaaaacaarcccargaggaagatgtgaggtaaaaggmga

SEQ ID NO: 28408 - DNA, 275 bp, Homo sapiens
tgtcttatcctggccctggccagacgttttctttgatttttaattttttttttttattaaaagataccagtatgagatgaaaacttccaataatttgtcctataatgtgctgtacagttcagtagagtggtcactttcactgcagtatacatttatctacacattatatatcggacatataatatgtaaataaatgacttctagaaagagaaatttgtttaatttttcaaggtttttttctcttttaatttgggcatttctagaattgagagcct

SEQ ID NO: 28409 - DNA, 453 bp, Homo sapiens
  misc_feature 360: v=a or c or g
  misc_feature 395: r=a or g
  misc_feature 418: v=a or c or g
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggvaacaacaggtgctggagaggatgtggagaaatagracacttttacactgttggggggvctgtaaactagttcaatcattgtggaagacagtgt

SEQ ID NO: 28410 - DNA, 187 bp, Homo sapiens
  misc_feature 99: v=a or c or g
caagaattgcataaaaaacattctgaacagaaaagcacaacctcaagattcagagggaaaagaagaaaacgctccagaaaagataaattgaagaatgavaaagaattacatagtgaaccgtcctcaaatgaaacccagtggaaagagcttactcagtattttggagtcaatgatagatttgacccgc

SEQ ID NO: 28411 - DNA, 351 bp, Homo sapiens
  misc_feature 165: m=a or c
  misc_feature 166: w=a or t
  misc_feature 172: r=a or g
  misc_feature 177: m=a or c
  misc_feature 183: k=g or t
ccatctttgttcactcgtgtgtctcaaccatcttaatagcatgctgctcctttttgctcagtgtccacagcaagatgacgtgattcttattttcttggacacagactattctgaggcacagagcggggacttaagatgggaaagagaaagcatcggagccattcmwtccggrgaaamcgtttkgatcaaatggagacttttgtagtcgtttcaaaagagcacctgagtcatgtgtattcccggcctttataaatgacccggtcaagttggtttcaaagtccgacaggcttgtctgtttactagctgcgtggccttggacgggtggctgacatctgtaaagaatcctcctgt

SEQ ID NO: 28412 - DNA, 393 bp, Homo sapiens
  misc_feature 156: r=a or g
  misc_feature 165: y=c or t
  misc_feature 170: k=g or t
  misc_feature 173: k=g or t
aaacattttagagttgagagactcatagcagtcatataatctagcagtaacaaatagatgtcctttcttgtgcctattcaaatgaattgacagtaactgtctggagttatttaatgtattgtttgggaagaatctgaggtctccagtacaacaggraagacagcyggtgkttkgtaccctccagtacaacaggagggttagagaatgaatgctagaatgttgccagccctgatctagccccactgcctcatttcacaggtggaactaaagcccagctgaatgatttgttcttgctttctccttctactcgagatagaaccaggacctgaatccaggcctacttgtttctagtcattgctgttttcactataaccaggtctctcatatccctgt

SEQ ID NO: 28413 - DNA, 114 bp, Homo sapiens
ctcaaactcctggccttgattgatcctcctgccttggcctcccaaagtgctgggactacaggtgcatgcaaccacacctggctaattttcttttcttctttctttctttctttt

SEQ ID NO: 28414 - DNA, 355 bp, Homo sapiens
ttatggtccttaggagagaggaacgatgtctgcaaaagtcaactggttgggggacgggtgaattattctttcaaattagcaatcattatttggacaacttggattttgtcatgagggttggagaggagcatttagaggccaaagttatgttcaaaagaagattggggaaaaacagctgtggcggataaagggatgcaagggcaacagtggaaaattctcagcccttaagtgtctcttacaagacacaggcctggtagaaacattttcctttgtccgtgacacttgttccaagtcagctggactggcatactccattggaaggttgggatgaagtttaaaatgttgccatagctac

SEQ ID NO: 28415 - DNA, 503 bp, Homo sapiens
  misc_feature 445: y=c or t
  misc_feature 481: m=a or c
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggaaacaacaggtgctggagaggatgtggagaaatagaaacacttttacactgttggggggactgtaaactagttcaatcattgtggyaagacagtgtggcgatacctcaaggatctaaaactmgaaataccatttgacccagcca

SEQ ID NO: 28416 - DNA, 263 bp, Homo sapiens
tatccagagtcaagattctcaaaccacacgtgctttgttaaagctggctataaggaaaactggttgcttggctttttcattgagtctatacaaactgctcaaaagaatgactcttaatgaaagcctgagtgaccctcaaattaggaaattctctcccagataattgagaagtggccttgactgtaccaggtcacacgtggaaataagtacaaaagtaatgactaaaataggccaagttgaccgagcactttgtacatagggtt

SEQ ID NO: 28417 - DNA, 244 bp, Homo sapiens
cactgttcttcattgtctgatatcaaatgtcttggaaacagttgtttcatatattttgccaggtttttagttgtttcagataatatagtaagttcagtcattcttactccatcattgccatgcacagaagtcgtccatataggttttatctggcctatatgtaagtaaggcaagccctgttatttagcactactctctggctttgaaggtcttggaatgtattggaaaaatattggagtcatgg

SEQ ID NO: 28418 - DNA, 341 bp, Homo sapiens
  misc_feature 109: r=a or g
  misc_feature 110: r=a or g
  misc_feature 303: s=g or c
  misc_feature 322: k=g or t
aattacagactctcaagaagttacaataatagtacaaggaagtctcgtgtactcatcacctggtcttctgcaataactacagtacataagcaaaaccaggacattgagrrtacaatttagctagagcttagaccttacttggattttgccagcctttgcatgcagtcatttttcttgtgtatgtttttgtgtatagctccatgacattttacctcctgtagaaaggcgtatcgtcaccaccaccaagacacagaactgctccatcaccgcaaagaaactcccttaggttgtccctttatagtsaccccgtccttctctccakttccttccctcaccccagc

SEQ ID NO: 28419 - DNA, 482 bp, Homo sapiens
  misc_feature 338: n=a, g, c or t
  misc_feature 339: n=a, g, c or t
  misc_feature 340: h=a or c or t
  misc_feature 377: w=a or t
ccatgaatcgcatattcttttctttgccactttttctcttgtgatgttgatctttttcttattaatttatatgagctctttatttattttttattttttgaaacaaggtttcattctgttgcccaggctggagtgcagtggcatgatcatggctcactgcagccttgaactcctgggctcaagcaattctcccacctcagcctcccaagtagctgggactacaggcacataccaccaagcctggctaatttaaaaatttttttttggtagagacggggtctccctgtgttgcccaggctggtctcaaactcctaggctcaagtgatcctcctgccttnnhttcccaaagtgctgggattataggcatgagccaccawgtccagcctatgagctctttatatattaaatcattaaccctatcatttggaatattgctatccagtattagtttttaggtggttagacttatcagactttcttta

SEQ ID NO: 28420 - DNA, 179 bp, Homo sapiens
agataagctgattggttccagccacttgacatgcaacagtcacgggcaagctgcgtgtccagaataggaactgaataagaaggcatgctatcatagcaaccctgctgagcatttgaaagccgtaagatggggtatagaagaaccttcaaaaaattccccaactgcattcaggcagatcc

SEQ ID NO: 28421 - DNA, 505 bp, Homo sapiens
  misc_feature 123: w=a or t
  misc_feature 377: r=a or g
  misc_feature 378: r=a or g
  misc_feature 379: m=a or c
  misc_feature 380: r=a or g
  misc_feature 390: m=a or c
  misc_feature 391: m=a or c
taatcgaaaaattgggatctaagtaaactaaagagcttctgcacagcaaaagaaaccaccgtcagagtgaacaggcaacctatagaatgggagacaatttttacaatctacttatctgacaawgggctaatatccagaatctacaaagaactccaacaaatttacaagaaaagaacaaacaaccccatcaaaaagtgggcaaaggatatgaacagacacttctcaacagaagatatttatgcagccaacagacacacaaaaaaatgctcatcatcactggccatcagagaaatgcaaatcaaaaccacaatgagataccatctcacaccagttaagcatggcgatcattaaaaagtcaggaaacaacaggtgctggrrmrgctgtggcgmmctagacacacttttacactgttggggggactgtaaactagttcaatcattgtggaagacagtgtggcgatacctcaaggctctaaaactagaaataacccatttgacccagcca

SEQ ID NO: 28422 - DNA, 223 bp, Homo sapiens
gtatgataaagcaagcataatcttagtttcagctctgccgtacgatagcttactgggctttaacaagtgtctggacctaagtttcttcatttgtttactgagaggagttgatccaaatgactcaaaaagactctcctattcaaaaataatcattctatcattcttcagaatgacatcaagttgttctgggtaacatccacctttaactggagaaacactgcct

SEQ ID NO: 28423 - DNA, 275 bp, Homo sapiens
tagagagtagatttggcacatcttttcttagtcttttgattcaaattcaaaacttaacagcacaaaccaggtcagagttactttcggttagaatttattgccatttattcctttttataaatttctatagattatactgttatttttatgttattggcctagagctacacgtatatgggtttgtcctgagtccgttttcaaatgaccttgtgatagggaaatggttttgtccatgttcttggaaatacttgtgtatgtacagaaggaagggagga

SEQ ID NO: 28424 - DNA, 176 bp, Homo sapiens
ctcagtcctgccctgctcaacctctagagtttagtcttagatcagatgcttttgactctgcaaacttgtgatttaaggctttctggatgtgtacactggtggttgaggtcatagaggttccaatattgaggagactgctgatactggatgttgtctccttgatttttttttttttt

SEQ ID NO: 28425 - DNA, 250 bp, Homo sapiens
tattcaatttgttctaaacagcctctctgtgggaaagggagctttgaaatgagtgtagagtaaaatcattgtgtgctagggattgagagcttggctttagtgctctcgtaagcactctgccatggcacttgctgtattatactgcagttacctgcttttctgtctgacttcactgaccatgcacacctttaggtatggaccctgtcctactcatctgtgtatccttagaacataacacactgccagacaa

SEQ ID NO: 28426 - DNA, 404 bp, Homo sapiens
taggaaaatgtgtgaaagtttcgaacctcccagagacttgttgaatggctttgacaaaaatgctgatagtgatatgaacaataagatccaggctgaggtggtctcagatggagatgaggaacctattgagaattggaacaaaggtgactcttgttatgttttagccaaaagactgtggcaatttgtccctgccttagagacttgtggaactttgaacttgagagaaatgatttaggatatgtggtggaagaaatttctaagcagcaaagcattcaagaggtgacttgggtgctgttaaaggcattcaattttaaaagggaaacagcataaaagttcagaaattttgcagcctgatgatgcagtagaaaagaaaatcccattatttttgagaggaaattcaagcc

SEQ ID NO: 28427 - DNA, 220 bp, Homo sapiens
gaaatacagctagaacaaaggggaggaatgagaagtgatgtgatggcgtggagtgggctgtagtgggaagaagagtcttccagggagctggcacagtatgtgaaaacagtaaagcaagtgcctggattttttaaggaactgaaaatttagttgagttgaaatttagagtttggctaggaaggttatgagagataagaataaagagttaacagcagccaga

SEQ ID NO: 28428 - DNA, 407 bp, Homo sapiens
  misc_feature 129: w=a or t
  misc_feature 336: w=a or t
  misc_feature 341: w=a or t
  misc_feature 342: n=a, g, c or t
  misc_feature 343: n=a, g, c or t
  misc_feature 354: w=a or t
  misc_feature 398: r=a or g
tccaaaaaatggttttaaacaatgcttaactaacagcatgtttttcttaatttgtattttcagtttagaatgcttttaactttatcaacataattagtcattgagaacttttctctgtatttttatttwatatgtactgcgagtaaacaaagtcctatattctgaaaggggacacgtaagggagagttgaagaaaatgataaatattgaagaatgtaattaacatgttgagagtttgcattcctgttgtatcagattggagctattttatagaattggatctaaatgaagtatacattttatggatgctaaaaatactctttagcaatgtttctawtcagwnngcatcaatcawtagagaaaagctattaaaggttgcagtgtgaatcaccagttggraaaagagaa

SEQ ID NO: 28429 - DNA, 148 bp, Homo sapiens
cttaatggatgttagtgtaggtaagcattattaattactttttgtgtatttagcaatataggaagttatttattattatgtcataaaactcatagagctattcatattaaaagtgggaacataataattgtctttttttttttttttt

SEQ ID NO: 28430 - DNA, 260 bp, Homo sapiens
cagaaaaagtgcctgttctttttgaagtgagtgtcttcaagagtgcagggaagacgatatcttaaggaagatagaaagtgacatgcattaagttgcatcttgggatctttcttggccttccctgtcttttcccattctcataaatgtcttccttaaaagcctcaatgtgtggtagtcaagcagcagcatgagttagaaatttattttcaatagataatgtgcttttgagttaattatccaaactgaccaagttatgcccc

SEQ ID NO: 28431 - DNA, 302 bp, Homo sapiens
atcatttatgtcacttctttgatgtacgttagatggtgtgaatggtactagaaatcctgactgttcagaggaactggttggcaccctttggcagatacagtcaaggtcatgggttccctaatcatgaggtccagtctggccagtgtatcctgtttaacctcaggcttctggccagtcacctgccaataggtacattaaacaccaagttagagaaggttggtttgacttaactccatcccaactcttagaaaaagtgagccaaagtctaggcccagtggatgttggattatcaaagggcaggt

SEQ ID NO: 28432 - DNA, 377 bp, Homo sapiens
ccacttgtgagaacgtgtggtatttggtgtttgtttctgcattaattcacttaggataatggcctctggccacatccatattactgcaaaatacatgttattttttttaatagctgtgcagtcttccatggtgtatatataatgcattttcttgatccaatccactgttaactggcacctaagttgatttgtgtccctgctgttgtgaatagtgctgtggtgaacaaatgcatgtgtctttttggtagaacgagttatagtcccttgggtatatagccagtagtgggattgctggatcaaatggtagttctattttagttctttgagaaatctgcaaactgttttccacagtgactggactaatttacatccccacc

SEQ ID NO: 28433 - DNA, 379 bp, Homo sapiens
  misc_feature 207: k=g or t
  misc_feature 218: k=g or t
  misc_feature 262: b=c or g or t
  misc_feature 353: k=g or t
tgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttcttttctgggtactcttataggtgttggggtatgaaattagtggtaattckttttgcttatkttctttttttttgtctgagataccctgagtctcgctctgttgcbcagactggagtgcagtggcacaatttcggttcactgcaacctccgcctcctgggttcaagtgattctcctgcctcagcctcctaagtagckggaattacaggcgtgtaccaccttgc

SEQ ID NO: 28434 - DNA, 255 bp, Homo sapiens
aaagcacattttaactcctattcaaagtgtgaaaaagaagcgaaatgtgaacggtatttcttgggaacggaggtattacaggacagcaactgctaaagcctctcaaagctccaagggtggaacccagctccatcttgaaacagaaaaggaatcccaaccacacaggcgccctgcagtaggaaccaaggacagccctgcagaagtcatgacgtaacctgaagtttgatttaaacagaaaaaagaacagcagcccat

SEQ ID NO: 28435 - DNA, 381 bp, Homo sapiens
  misc_feature 93: r=a or g
  misc_feature 101: w=a or t
  misc_feature 129: w=a or t
  misc_feature 130: n=a, g, c or t
  misc_feature 348: r=a or g
  misc_feature 375: r=a or g
ccaatgatgactgtcctggatatgctttctagtagcaggtgaaagcatggatctttagtttcgtttcttccctgtacccactgtgttttagargctttgtwggggggtagggtgagggaagttggagawncatggagtggtgaaggtctagtagtttgccacaggtgaaacaagaagtatgtagagtgtcatttgtgtgcatgtgtggtaagctacttgtcgattattctcagatgttattctcctaactttattcagatgactgtgaggaaatggttgtattacttatgtctttctctggtataaataaacaaaattagctgaaacagaagggagtttgttgcctgrtgcaacatgaggctcaagagtagttgratctaa

SEQ ID NO: 28436 - DNA, 379 bp, Homo sapiens
  misc_feature 109: k=g or t
  misc_feature 365: k=g or t
  misc_feature 376: w=a or t
tgtcaaatgttttttcctgcatcaattgaggtgatcgtgtggtttttgtctttcattctgttaatgtggtgtattttgatgattgagttttctgtgttgaaccattctktcaattccaggtagaactttcacttgttcatgatgtataatttgctactattttgttgagaatgtttgcaccaatattcatcagggatattgccctatagtcttatattacagcctctttggctttggtattagagtaatgctgtcttcacagaatgagtttggaagtgttcttcaattttttttgaaagagtttgaagatgattggtgttaatttttaaatgtttggtagatttctccagtgaagtcatcttgtkcctgggctttwctt

SEQ ID NO: 28437 - DNA, 204 bp, Homo sapiens
catgtattaattcctactctgtgccagctattgtgtgtatcaaagaaagattcttaactgtcaaggagcgtacagtttcctgcagttttccctccagtcacccctcttctgagtagggtaacattgagtcatccacttcccccaaaggtcccacacctaggaattccacccagtgccttggcatctcagcagtttaccccagga

SEQ ID NO: 28438 - DNA, 221 bp, Homo sapiens
tgaaaagtgtatttttggagatagtcaagcatttagaagtgcagtgaacttgctgtcacggagtaaaatgctaattatgtttcactttcctagcctagtgaaaaagaaaagtgctcttgagtacaataccttaattatttcttaaaatactgactttgacctagctcactgtattttttatttaatggattatggattacagtatttttcttctgagttac

SEQ ID NO: 28439 - DNA, 281 bp, Homo sapiens
  misc_feature 279: m=a or c
cctgttctggaccccactcaaaactggcagccttttgggtcgcttgataaatgagccagagtaacgcacccagatgaggaatgtgttgcctccagaatcctaattggcccactaggcgttgtgcctctttcttgattgtaggaggggccaaatgcagcaacttctccttcaccttagaaggaataccttaacaggcctaacaccactagacccctgtaaattttaccaaggtagaagtttcctgaattttagtcaaatttatttcccatcctctggcamac

SEQ ID NO: 28440 - DNA, 327 bp, Homo sapiens
  misc_feature 186: k=g or t
  misc_feature 187: m=a or c
ctcgaactcctggcctcaaatgatccgcccaccttggcctcccaaggtgctgggatgacaggcgtgagcaccgtgcccagcctgattgacaatggcctcttgaaggctgggttttcccagccggacagtgcccgccccacatgctccactcccacgctttcatctgcaggcctgccttcctctcakmcacctcactgctgagctctgtggtagagaatttcctttacccatcagggtatggtctggctggtaatactgactccaacccagctccttcattttatagaaggaggcatttctgaatcatgtttgttcaccatggcgagt

SEQ ID NO: 28441 - DNA, 106 bp, Homo sapiens
cccaccaccaataactttaaggggaagagaagctggttttttccctaaacatgtctttaaaataatgatacactgtatttattaattcttgatgcaaaaaaaaaaa

SEQ ID NO: 28442 - DNA, 107 bp, Homo sapiens
  misc_feature 7: d=a or g or t
ccaagadaacaaaacaaaacaaaattattgcctttgtggttagggttaacaattttatttaaaaaataaaaatatttgttataatattttatgttgactgataagta

SEQ ID NO: 28443 - DNA, 349 bp, Homo sapiens
cactaaatgggatttggaatgcatgtgggtgtgtttgagagtttgtcagaattatcgtgtagtaacattagatatgagatacctttgagagttatgggcttgaaagataaggtgacttaaatagactttctcaaaagaatacatagatacatttggccaacaagtttatgaaaaaacgtttgacatcactaatcatcaggaaaatgcaaattaagatcacaatgagatgtcatctcacacctgttagaattactattatcaaaaagatgacaggtaacaagtgttggtgaggatgtagagaaaaggaaatgctggtatactgttggtgggagtgtaaattagtgcaacc

SEQ ID NO: 28444 - DNA, 441 bp, Homo sapiens
  misc_feature 93: k=g or t
  misc_feature 115: r=a or g
  misc_feature 306: s=g or c
  misc_feature 334: k=g or t
  misc_feature 353: s=g or c
  misc_feature 354: r=a or g
  misc_feature 389: v=a or c or g
  misc_feature 391: v=a or c or g
  misc_feature 395: w=a or t
  misc_feature 405: s=g or c
cactcaatttttacgctgtgttccggatgctgctccgcctgccacggacgtgcagccgttaaaatattaatgtctggcatgtggcaaacattkaaaatatgctgagacttgggarctgttgagctgggccttgttgacacaccgcctcacctgggtgttgtttgctatgtaaatgccaaggattcctccctgaagatggaacctgcactcctcttctcacccctcatttcctcctgggactaggttggtaaagcagtttgtgcccatcccaggattgcctcgctgggccaaaggggtgtgttttasgtgccagttgctagggggcatttcaaakgggctggtttcagggcatsrtcaattacagcaaccccccagatgtgcctcgagtvcvagcwgtgtgccagsactgggcttggcattgtgggagcgtgagtatggggt

SEQ ID NO: 28445 - DNA, 402 bp, Homo sapiens
ttaatttaggattttttccctgtataatattatttgttaagcaacttataacttttatgctttaaataagcttaaattatttcacatcatacttctgaggagactttaacaccgtcttatctcttggagaaattgaaaacaaatgcagagaggaatacgtaatacgtgcatttaatgtgggttttggtcttatatattgcaattctgttctgatttcaggctgcggtgttattgagcagtttctttaacacctgcagcatggttaatatacctgttattattaatgctgtctcttgctgaggcttcctccctagaacttttgctaacttaagcaaataggaaatttatggagaagatattgggtagctcaaagaatcaaagtaagaacctaacaatcagtcc

SEQ ID NO: 28446 - DNA, 88 bp, Homo sapiens
  misc_feature 84: k=g or t
catctatctacctgtccatcatgtaccatctattcacccatccatccatctcatccatgcatccatctgtccatccattcatckatct

SEQ ID NO: 28447 - DNA, 233 bp, Homo sapiens
cctttaacattgagatacaaccaagttgttacttgtaacaattttttgtttgtgtgtttgtttatttatttttgagaccagagtctcactgtcgcccaggctgcagtgcagtggtgccatcacgcgtcactgcaacctctgcctcccggattcaagcaattctccacctcagcctcccaagtagctggaattacaggtgcctaccaccatgcctgcctaattttttttttttt

SEQ ID NO: 28448 - DNA, 346 bp, Homo sapiens
  misc_feature 262: n=a, g, c or t
  misc_feature 342: r=a or g
caagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagangaatgcttttttccttttcttgaaagtttctctttcaaatagatttcaggcctctagagtctttcaaccctcacattcargaat

SEQ ID NO: 28449 - DNA, 62 bp, Homo sapiens
aatacaaccagttcactggttttgtaatgtgtctttttatttttaatttttttttttttttt

SEQ ID NO: 28450 - DNA, 54 bp, Homo sapiens
aaaagtaaattttcctgtgtgtctagtcaagcaacacaaacaagatgctttttt

SEQ ID NO: 28451 - DNA, 317 bp, Homo sapiens
  misc_feature 305: v=a or c or g
catcctagatcttttaagatttaaccattagccatcttggcctggctaatgctgagtgaaattctctcacaggcaaaaaactggggtaagtaaaatttccactcccatcccccagttgccccagctgtgggttctgtggtcctaatgggacaacatagagaagctcgaaataagtttgcagtggccgggcccctccagaaggaaaacatgaatttagaaagcttctggagagggttggggtaggatggggagaggttgcaaataatgaaataaacaccagtcccaaatgggacctgcaggcctcvagggatgagcct

SEQ ID NO: 28452 - DNA, 318 bp, Homo sapiens
  misc_feature 96: s=g or c
gatagcactgtttaaaatggcggcttcaaggcgtttcacgggtgtcccggacaggcgtggaggtggggcgcaggcgaggatgaagcttgagttggscaggagtcggaaaacgattgcaggcgggaccgcgtccgtcggggctgaggaaacttagcgtggcagaccctaaactgggataactttagggatatggccttcttttcccagttgcctcaaacttagagcagcgtcgtctttagccgaagattcattttcccagcattttccttctccaggcggagtagttggagacagagggcaagccagaaactgaccttc

SEQ ID NO: 28453 - DNA, 425 bp, Homo sapiens
tgatttctaactgcttcctatgaatttaatttgaaactgttaactgttcttctccctctcccttgacccagtagctcctaggatagtagtgttaatactaattctaaatcagggatgactttttagcagtattgttattattattattattattattattttgagatggagtcttggtctgtcaccaggctggagtgcagtggtgcgatctcggttcactgcaacctccgcgtcccgggttcaagtgattctcctgcctcagcctcctgagtagctgggactacaggtgcatgccaccatgcccagctaatttttgtgtttttagtagagacagggtttcaccatgttggccaggatggtctcaaactcctgacctcgtgatccgcctgcctcggcctcccaaagtgctgggatcataggtgtga

SEQ ID NO: 28454 - DNA, 422 bp, Homo sapiens
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagttagaatggcgatcattaaaaagtcaggaacaacaggtgctggagaggatgtggagaaatagaacacttttacactgttggggggactgta

SEQ ID NO: 28455 - DNA, 68 bp, Homo sapiens
aaaaagacgagagttcgaactcagcaagttctcatcgaagcagctttcttttttcttttcttttcttt

SEQ ID NO: 28456 - DNA, 324 bp, Homo sapiens
tgaatagttactttgtgctaagcgctatgctgtgttaactgaaataacttgatgcagtaactggattaaatccttgcaaataattacaggcacacagataaagtagtgatttgtttttctgatgtggctggatggagtcagggcccagaaataagaaaaccaaggtagttcaaataaaacatggactgaaatctagaagtacagagctattttataaaacttatactttaatttcaatcactccattttgatagtaaattggttgttatattccattgactttggaggaaaatgatgagttgaatatcccactgttgaccacta

SEQ ID NO: 28457 - DNA, 227 bp, Homo sapiens
gatctcagctcactgcaagctccgcctcccgggttcacgccattctccggcctcatcctctccgagtagctgggactacaggcgcccaccaccacgccccgctaattttttgtattttcagtagagacggggtttcaccgtggtctccatctcctgacctcgtgatccgcgcgcctctgcctcccaaagtgctgggattacaagcgtgagccaccgcccccggcctt

SEQ ID NO: 28458 - DNA, 308 bp, Homo sapiens
  misc_feature 261: h=a or c or t
ttccttccagtctatcctgtgtaaaattacttcctacttccaaaatgagaaatactgggtctctacttaaatttgtaacctaaatgcctcacacctcattttctgaacaaataaagcccaaattcagtgtcctttttgataggatcctgtcctgacctttccaaatctgatgctagagccttgtgtaccctgagttcagccaaactgaactcttaatggtcccttgctccatactctccccttgctcatgcctttattcthctggtctgattcatctttgcatcttaacagtgtatagcatggtgctg

SEQ ID NO: 28459 - DNA, 246 bp, Homo sapiens
  misc_feature 78: r=a or g
  misc_feature 103: k=g or t
attccattccattcctttgcaatcgagttggttccattccattccattccattccattccattccattccattccggrtgattccattcgattacattccgtkccattacattcccctgcactcgggttgattccattccattccattccattccattccattcgattccattccaatccaattctttccattcctttctattccgtaccatttcattccattccataccgttccattccaaagcc

SEQ ID NO: 28460 - DNA, 379 bp, Homo sapiens
  misc_feature 98: y=c or t
  misc_feature 103: w=a or t
tgtatatgatgtcactgtgacctctttgaaatatagtgatggcttttacctactttgaaaagaattttcacatagagtcagaaaaaaaagggaatatycaaawcacttgcctttccacttggagagcacgacagttgccaacaacaaggggtcaagggccgcacaggagatgtgtgggggcctggccacctcccacctgctgcccagaggcttgtttgcattttcattttttctccacttgtaacaaccatagtttcagctcctaaattcttatcatggatttacttagtcatcttaactgacctgcagttacttgcctgttttcagtgaagagagagaagcagctctggtgccacatgccagtgccatggagggatag

SEQ ID NO: 28461 - DNA, 259 bp, Homo sapiens
  misc_feature 89: w=a or t
agaaaaacctaagcatagcccactagtttttactgtttcctttattatattgcaatctgcaaaactatttgtattcagccaagtatctwtgtccagttttaataaaatagtagcctaagcttacaaaatagacaaattaagcagcaactgttgattctgagtaagtctgtatgctatcaagaacacaagaatgcaggatcatgggaaatgcacgcaaatcctgttgaagcaatgcatgcttcaacaaccaccgaccacc

SEQ ID NO: 28462 - DNA, 237 bp, Homo sapiens
gattaagcttatttctggtttgttcagatctgagactgtatcctgtgggttctgctctagttacggggtctttcattacatgaggctgtcatttttacctgtgcatctatatagcagaaaataagatttaacactttttggttgaaaatttggaaataacaaaaagtttaaagaaaaaatatcaaaatgtatctataacttcactgccagaaataatctactgttcttcccggcccc

SEQ ID NO: 28463 - DNA, 362 bp, Homo sapiens
aacatactggcactgcccaaagaggacagctctgtcattggtggtacgtggacatcaccaagtgacacgcagcatctccttcatgtgtgatgggcatgggggccagagctaggctgcaaagtctcctctggaagaccgttgtgtcaaaagagcaggtgatgggcatagacaggtcaagctcagagctggggcctctggttcccccaagggaggattgggctgtgagtgaggcatggaaagcagtgcgatgagaactaaagggtccatgaaccccatcaggatcccccagaagggaaggttatatatagtcagaggcaagaaacaatattggaaaagtttcagaattatagatggtgtgacaa

SEQ ID NO: 28464 - DNA, 386 bp, Homo sapiens
  misc_feature 284: d=a or g or t
  misc_feature 364: k=g or t
aaatgatttaattgaatcaagctgcaaagtaactagccctaccacttatgtcttggatgaagatgaacctcgattccttgaagaagttgattacagtgcagaaaagtaatgatgagttagatattgagttggctgaaaatgtaggagattatgaaccttctgctcaagaagaagtactttctgactctgaattatcaagaacatacctaccttgagcccgctgccatctcttgttaactgcaaagaataaatgaaatatcttggtttttatttcccaggaagcdtgagagaaatgagtttatacagagctgactcaaaaagacaaaaagtaacttgggccagtttggtttcaagataataaatktgttattaattaatgataaaat

SEQ ID NO: 28465 - DNA, 250 bp, Homo sapiens
  misc_feature 107: r=a or g
  misc_feature 117: r=a or g
  misc_feature 210: s=g or c
  misc_feature 211: s=g or c
atgtagagtctggctagactccattcccctgccacccatggaccccagggatgcaggataagtgtgataccagcagagatttcctccagttctctgacatctattartagatgatarcagcaacttctagactctctggactatagctacagtagtcaatctgaaagttacatgcatcccctgattttctttttgttagcacccaattcsstatatttgatccctttctgcttgaaatacctagaatagt

SEQ ID NO: 28466 - DNA, 234 bp, Homo sapiens
caggatttgattaatagtagctattctaagtattttgaatagaatcagaatgtagggaatgagagatgtacattactattgaaaggactgggcagtgaaggtcaagaagaccactgctgactttcaggaaatctaaaagtggaatagggtaccacattgtgggtgggagagaagcagtggccaagaatggtgtttataaccacagagggtaaagagaatttctgtatagtgagt

SEQ ID NO: 28467 - DNA, 79 bp, Homo sapiens
tttatcacttccccccattttgtttatcaatctcacaaaaacctagggtttcctatcccctcttttttttttttttttt

SEQ ID NO: 28468 - DNA, 346 bp, Homo sapiens
ttgaagtccatttcagctgcatattgagtgaagtttctagcttaccaaaactacaaattgctactttcagagttgcttggggatgtagtcaacaacatggctattaggtatacaaatgttaaggatttgctacataagacactgtgattgttttagatcatcttacaatctagttgaggtaggactaacctgaaaataagttgtgcatagagcagtgagtgcccaatttagtgataaagatagtaattgctgtgggatcttgatggtggtggtttgctgcgagtgtatggcactaaccccacccaatccctctccacttcttggccttgtttatgcagataaacaa

SEQ ID NO: 28469 - DNA, 211 bp, Homo sapiens
taggaatatagaatttgaaagtgattcacagtgatgaaactacaagcctctacagagtttgtctatttttttctgtttttttttaatgtaatttagcatatcacattgtgagagactatgtcacaagatcttcttgaattaatgcaaaaagatgtaactacgagtgataaggtattggtcctggactcaatatttatgatgatgtgtggtg

SEQ ID NO: 28470 - DNA, 404 bp, Homo sapiens
  misc_feature 314: n=a, g, c or t
  misc_feature 315: v=a or c or g
acaattattgttagggaaatattttccccccaacgctagcattacccattggttagcactattacaagtatagttttctttgatcagacttttctatgtatcctgaaaggaaggtagtgttattttatttatcttacagatagaaaagtaaacagggaaataaagtaatttattgcagttcatacagctggcaaagggtagggcttcaactgaaataggtttttattattgcgataacagtgactgttaaaacaaaagtacaaggtcatcaaagtccctcccagaagttccacacaaaacatgcaatgaccagnvtatgggcagactctgtggctgcgtttctatttcatattgaatttaggccgggcgtggtggctcatgcctgtattcccaacactttggga

SEQ ID NO: 28471 - DNA, 496 bp, Homo sapiens
  misc_feature 227: n=a, g, c or t
  misc_feature 228: y=c or t
  misc_feature 229: s=g or c
  misc_feature 231: y=c or t
  misc_feature 241: y=c or t
  misc_feature 248: y=c or t
  misc_feature 249: s=g or c
  misc_feature 292: d=a or g or t
  misc_feature 496: w=a or t
tttattgactctgtaatcagatagaaaaaacaacttggtttgtgtggtatgacttataaagaaatgatgtatatttgttattttgttaccctttagattgtcagagactcccccaatttaatcaacaaagttttataaagtaaatgaaaatattaatagaaattagtttatttacttggttcttataactgatatctctgtgcttttataattgtgatttgtttttnystyttttttctcyattttcystgaacagttttaatgttcggttttggtgttttacactgaaatdacatataaatttttaatttatttcatacaggcaacttgcattttaaaaaatacactttgaagtttatcatcttgaaattggggcttacgttgtttatctgtcttgagcattagtactttatgactttggccttatggcaacatcatgattattaatccgtcagcctttaatgtggtcactgtttcttatccagacccgactgcw

SEQ ID NO: 28472 - DNA, 262 bp, Homo sapiens
ctttccaggtgagggggcctagctcacacccagagctggaccagggtttggccactggggctacccggaccagctgacgttgtgcttttcctccttaggtcttgtaagtagggtttgcgaactcagatggctacagaagccagatgagaaattaaaatgagagccaggaaggggatatggtcagctgaagagtgaatgccattcctactcagctgttaccatatctttcaggttttcttttctttttttttttttttttttt

SEQ ID NO: 28473 - DNA, 294 bp, Homo sapiens
agatacgtgtggtgggcttgctggagaaataggctcttctcacgtgagaacagcatccttccaatctagagctcctggctccaggaagtggtggtggctctaccctggtgctatttcattagtgaagggtggggtggtggaaagtgcagaaaaggcaggacccctgacaccagcaaggcattggatctctctggacctccgggtggtggactttgggactggacagacctggtcacagtctaggttctacatcttactggtcgagcaactttaggcaagtagcttaactcctcc

SEQ ID NO: 28474 - DNA, 248 bp, Homo sapiens
gttctcaacttgctccttggctgttctcctgacacttaagtcagagcattctgtagctgtattttacagaactgtaattgcacagattgttcctcttacaagagaaatatccagagctctaagaaaacaactgatgaaaacgacatgcgtgacatttggtgctgaagacccaggtcagagagactcctttgggggaccagtccgctgtccttgccctcactctgtgaggagacccacctacgacccca

SEQ ID NO: 28475 - DNA, 75 bp, Homo sapiens
  misc_feature 13: r=a or g
  misc_feature 27: m=a or c
aacttcacgctgrtgtatgtatacaamatgacagtttatttatttattatggaatagagacattttcagtgacca

SEQ ID NO: 28476 - DNA, 66 bp, Homo sapiens
  misc_feature 5: s=g or c
  misc_feature 8: s=g or c
agaascasattatatagtatcccgggcgcctgtgtcttcttacacttctcccttttcctcccgcct

SEQ ID NO: 28477 - DNA, 267 bp, Homo sapiens
  misc_feature 97: k=g or t
tatggatcaagaaactgggtgggatgagacctggagaccaggaggccacagcctctctcttttgcagtctccatactggtccaccttccccccactkgcgtctcatgcttccccctgggaatttttgatgctattgttattttatgtgtgtgtatgaaagggatggagcagttttaaagtatgatttaatgatgaaaataaaaccactgccttgagaaatatagactattaggtgagtgcaaaagtaattgcagttttggccatgac

SEQ ID NO: 28478 - DNA, 392 bp, Homo sapiens
  misc_feature 98: r=a or g
tacaatttacaagtacagtgtcttaccaatgtcattttccctcatattttattatgaaaattttcgaatatccagccaagtataaagaattttataargagcacatcacttaggatctatcctaccattaacattttaatattacttgctttatcatatagctatccatccatttaaattgcagatacctgtacactttcctttaaatactttggcatgcatgtcattgactagagtttgttgacggtttattttgatgtaaaatggaatatataaacctttaagtgtacgttcactgattttgactaatgcatacacctatacaatccaaccccctacgaagatatagaacattactatatcagtgtcatttgtgatgagtctttcacatt

SEQ ID NO: 28479 - DNA, 343 bp, Homo sapiens
tatttacgtggccaacaaacatgaaaaaaagttcatcactgatcatcggagaaatgcaaatcagaaccacaatgagataccatctcacaccagtcagaatggcgattattaaaaagtcaacaaacaatagatgctggcaaggctgtgaagaaataggaacgtttttacactgttggtaggaatataaattagtgcaaccattgtggaagacagtatggcgattcctcaaggatctagaaacagaaatcccataggacccagcaatcccattactgcatatatacccaaaggaatataaatcattctgctataaagacatatacacacaaatgtttactgcagc

SEQ ID NO: 28480 - DNA, 51 bp, Homo sapiens
  misc_feature 14: m=a or c
tgttgttttgaggmatataaaacaaaagacaaaactttttttttttttttt

SEQ ID NO: 28481 - DNA, 75 bp, Homo sapiens
tatagatgacggtttggatgcctgttaacttccaagtagagatgctgaagaggtagttgggattttttttttttt

SEQ ID NO: 28482 - DNA, 316 bp, Homo sapiens
  misc_feature 97: n=a, g, c or t
  misc_feature 99: r=a or g
  misc_feature 106: r=a or g
  misc_feature 113: k=g or t
  misc_feature 118: k=g or t
aaataataaagatggctctctaaagaaacatctgaaattagtagtaacatgctgtaatattattttccattgactgtagccaagggcctctgctagncrcccatgrgaacttkgtgtkcttgagaataagacacctttgctccagggcttagtgagcagggcctgaactggagttccctcccaccaccttaactgaactcttcatgcaggacacagcatgtacaacctcacatagagttcctgatcagacaagacttgctggaaatttcccaggatcttccttccttaaggtaggagtttataataggttataatt

SEQ ID NO: 28483 - DNA, 58 bp, Homo sapiens
  misc_feature 33: b=c or g or t
  misc_feature 52: k=g or t
ttctcaggtgtctctcacgtgtcctcaggtgtbtctcaggtgtctctcacgkgtcctc

SEQ ID NO: 28484 - DNA, 209 bp, Homo sapiens
  misc_feature 80: k=g or t
  misc_feature 85: w=a or t
tttcccaactccattttcacttcctagaggcaaccctttcagcatttttagctgtttctttttttttcttttcttttctkttctwttttttgagacagagttcgctctgtcgcccaggctggagtgtagtggtgcgatctcagctcactgcaacctccgccttccgggttcaagtgattctcccgcctcagtctcccaggagcctgtaa

SEQ ID NO: 28485 - DNA, 271 bp, Homo sapiens
cattcctcaaaaaatagatctacccttaaaggacaaagatttaccaacactgaagacccttacaagttgacagtttctaaagagggttctaggaatgttctgtgtaaggtcagcttcactggaataaacatacatcttcccaaggtgactacttcaaaggcaacactacccattcgggtgcagaaattaccgtacttactctgccataaatgtaaaatgtgtataaagttaagctattgcattttttcataacacatttaaatagaaattg

SEQ ID NO: 28486 - DNA, 338 bp, Homo sapiens
  misc_feature 31: h=a or c or t
  misc_feature 32: n=a, g, c or t
  misc_feature 82: n=a, g, c or t
  misc_feature 107: v=a or c or g
  misc_feature 126: h=a or c or t
  misc_feature 127: n=a, g, c or t
  misc_feature 128: n=a, g, c or t
  misc_feature 129: n=a, g, c or t
  misc_feature 144: m=a or c
  misc_feature 163: n=a, g, c or t
  misc_feature 216: s=g or c
  misc_feature 219: h=a or c or t
  misc_feature 220: d=a or g or t
  misc_feature 274: m=a or c
  misc_feature 275: n=a, g, c or t
catcaatatgaatctcctggaaggtttctghngggtttccttttttgtgggtgtcttcctaacaactaattacagtggctcnaaagaactgatactgtcattccagvatgagctaagaaggcctthnnncatctaaactctgamatagtactaattttaagtnctcaggacttggttatggccaaacatgagtgttagaattatgcatcaaaaatscchdgattttgtgcaagtggcttgaagccattggatttaactcagttcagatacaggmncatttggctctagaattggattcaggtccctctttttcccccccatccacagtccgtccactc

SEQ ID NO: 28487 - DNA, 385 bp, Homo sapiens
  misc_feature 312: d=a or g or t
tagtttatcaggtaaagacaaaacaaaacaaacaaaaagaaaataggcttaataaaatgtgaaattattaaaattcctcatttaatccttccttgttcccagaaagtctaggtagaaagcagctatctttgatgacagaatgataaagaaacccacctttctcccaacaatccataaacaccctgaggtaagaaaccacctcctaattctcgatatatccctggtacctatcccatgccctaacaacttacaggcaattagcaaatactttttgaaataacatacagatgaaatgattgactaacagactgdgatttcccaatcgttggttaactatttaaactatatttgaatctcaagtttgcaaaaatgggttgccacttat

SEQ ID NO: 28488 - DNA, 240 bp, Homo sapiens
ttttattgaatgtgtaggctgtaatctttcaccagtttttaaaaatttcttacctatttcctcttggaatacaacttctacttcgttcttactctttctccttctagaaatctgatttcatgtcttgcaacttttgattgtgcttcacgagcattcagtgaccttatgtaattttcgttttcatatttttgttttctgcatctttcagtttgtgtatattctatatatacgacttcacct

SEQ ID NO: 28489 - DNA, 105 bp, Homo sapiens
  misc_feature 77: r=a or g
  misc_feature 98: r=a or g
caaaaattagccaggcatgatggcagatgcctataatcccagctgctcaggaggctgaggcaggaagaattgcttgracctgggaggcggaggttgcrgtgagca

SEQ ID NO: 28490 - DNA, 365 bp, Homo sapiens
  misc_feature 292: h=a or c or t
atttaacatacataagaatctagggaaggaagacataaatgatttagttaccttttattgagtactgccaaccacagagataaacactttacacattatctctgatattctgagaaagttgtttttacctgttttgcagataaggaaactgagacacagaatagtaactggcctaagggtacatagctagtacaaatcagagctagattcagatctgggtcttcctgactccaaagacaagactcttcattctatcaccctgtctcacaaaagacttgcccaaggctacgahgcaaggcagtgactagagtccagacatcagaactagttccatgttttttttttcactaccagtccccaggccc

SEQ ID NO: 28491 - DNA, 280 bp, Homo sapiens
  misc_feature 237: h=a or c or t
  misc_feature 238: m=a or c
  misc_feature 248: r=a or g
cattagccttgtttgggaacccgttgcatagtgccatcaaccactgtctaacactatgaaagaattatgtgaggttcttaaagcccaggatatctgtcattgcagaccctgaattgtgtggtgcactgccacatcatctcacttcaataaatatactcttaccttcctgtatgtcaagattgaatgaaaggtgagactaattgcagtgggtcttagtcatttaaaactagatatgghmaaaatatacrggagaaattactaaaggattcgcagttttttt

SEQ ID NO: 28492 - DNA, 86 bp, Homo sapiens
agagtgaacaggcaacctacagaataggagaaaatttttgcaatctgtccatctaacaaagggctaatatctagaatctacaagga

SEQ ID NO: 28493 - DNA, 409 bp, Homo sapiens
  misc_feature 114: d=a or g or t
cttaatccctcttgatggaggtgaggttgtccagggttcactttggattgctgtgggaggaatgtgcaagagctctaacttggtaggtaaagtctattggtggaagcctaagtdcttctagcatgcacacccccttcatcttggtgatagagggacacgaaaaagtgtaatttgtctaagttagacattttctatatgttaagcccataaatattttaccttctctttattcactcatcaaatattcattgagttgctgctcagcatcaggtgcagcagcgagcgcttagtctctgtcctcctgctgcagcagagagtacggtatgggaaagagacagagccagttatttcacaagcaagaaccaattaaagctgtggcgatttctgtggtggagaagtgcatttggca

SEQ ID NO: 28494 - DNA, 149 bp, Homo sapiens
  misc_feature 120: s=g or c
  misc_feature 123: k=g or t
  misc_feature 125: k=g or t
ctaatgatgagtcttttgcagtagactcagtatatactgttttcaaatatattgctgtaatggcttgctaatatctcagactttttctttctttatcactggagtgacatctaatttttsatktktgtaacctgtctgcttgtctggcc

SEQ ID NO: 28495 - DNA, 318 bp, Homo sapiens
caagattagatcctgtgctgaaaaagaaaccaagaaaaaagatgacattccagaagaagacaaaggaaatgtaaaacaatgtgaaatcaattatgtaaagaaatttcagagcttccaagaccacaaacttaaaataagtaaagaagagagtaaaattcttaaaaaggctcagaaagatggatttttgcatgagacgcttctggacaggccgaagctggactgtactgctgccatctcggctcactgcaacctccctgcctgattctcctgcctcagcctgccgagtgcctgccattgcaggcacacgccaccacagcc

SEQ ID NO: 28496 - DNA, 364 bp, Homo sapiens
tatatttaaaaggaattacactgtatgtatctgcttctgcaacttacttttttgatgtaacattgtgtttttgagatttgtccatactgatgtgtggggctgtttattcatttttcactgctctgtagtttacaatggtgtgagtttatcagaatttttttatctgtgatggatatttagctatccaaaataatactgctctgaaccttcttgtacatgtttcctggctgcatgcaaaagaatctttctaggaagtatacctaggagtggtatattaactatgtatatttttctgcttcactggctaattccaaattattttctaaattgtttcatgtttttaccagcagggtataagggtaca

SEQ ID NO: 28497 - DNA, 237 bp, Homo sapiens
  misc_feature 61: y=c or t
tcagaagtccacagtccaaagtctcgtctgagacaaggcaagtccttttcacctatgagcytgtaaaatcaaagacaagttacttcccagatacagtgggggtgcaggcattgggtaaatacaccagtgccaaaagagagccgccagccaaaacaaaggggctgcgagccccaggcaggtccaaaacctagcaaggcagtcactgaattgttttttggtttcttcttttttggtttt

SEQ ID NO: 28498 - DNA, 360 bp, Homo sapiens
  misc_feature 102: r=a or g
ccacctgcttaatttggctgcaggaagctagcaaagtacattgtatcatggaaaaatctagttaaggaaggaagtgtttccaaatacagtttactactttgrtaggaaatacagtccttaataagacaggttttttgcccaaggatctccaggctcttccataatttctccaaagcccagcgctctgcatatatcttcctagttcttccttcagaaaacctaaatgatgcaaaatgataccacagtgttgaatgtttgattttaaggtgggtggatttaataaggaaaagatgttttgcgtctttttcattgatcgcttaggcattcttgcttttttgattgatttttaacctgggtgga

SEQ ID NO: 28499 - DNA, 338 bp, Homo sapiens
  misc_feature 84: r=a or g
  misc_feature 92: r=a or g
  misc_feature 95: r=a or g
  misc_feature 201: n=a, g, c or t
tacttcagcaaacaaataagttgcataaaggttatatacagagtaacgtatataaaatatgtatgatattataccatttatcaraagcttgraargcaatgataaagtttaaattcttgaattggtagtaatagtgtaaaaacataggaaataaatatcaaattcaagattatgcttgcatctttggaaagaatggaatgnaatcagggtatagctcacaaaggacatcatctgtatgtgtaatcaattttcataaaaaacaaagggaagtaagtatggcatagttttagatttcagtacagctggattgggagtccagagataggatatggaggttc

SEQ ID NO: 28500 - DNA, 55 bp, Homo sapiens
gcattccgttccattccattccattccattctattcgggttaattccattccatt

SEQ ID NO: 28501 - DNA, 162 bp, Homo sapiens
  misc_feature 112: r=a or g
  misc_feature 117: r=a or g
  misc_feature 121: n=a, g, c or t
cattaattttgaattagatttatatttttctatatggaatttcagttctagcaccatgtgttgaaaagactttgctttcattattggattgcttttggtgcctttgtcaaaragcaratgncagtgtaagtataaatctgtttctgagcccctctgtttttt

SEQ ID NO: 28502 - DNA, 358 bp, Homo sapiens
cttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctttttaatcttggtgttttccaactttctgtactaatagatacatttctgtgcataagattataaagcatatactcacagttcagtagttttcgttaaggatttactgtgtgagtactttactgtgaggaattgcaga

SEQ ID NO: 28503 - DNA, 317 bp, Homo sapiens
  misc_feature 307: d=a or g or t
cattttttttctaagatataatctcgctgtgtcactcagactggggtgccatggcacgatcacaacgcactgagacctggagctcttagatcaagaaattgtcctgcctcagggcctctagtggctgagactacaagtgcatgccaccacaccagctatttttttttttccatgtagacagggtatcattttgttgcccagacttatcgtgaactcctgggccaaagcaaccatcctgcctcagcctcctaaatagctggaattataggtgtgggccaccaattctggcttcatgttcatttcttcdtgccgacgta

SEQ ID NO: 28504 - DNA, 356 bp, Homo sapiens
cacgtgatctcattgttcaattcccacctatgagtgagaatatgcggtgtttggttttttgttcttgtgatagtttactgagaatgatgatttccaatttcatccatgtccctacaaaggacatgaactcatcattttatatagctgcatagtattccatggtgtatatgtgccacattttcttaatccagtctatcattgttggacatttaggttggttccaagtctttgctattgtgaataatgccgcaataaacatacgtgtgcatgtgtctttatagcagcatgatttatagtcctttgggtatatacccagtaatgggatggctgggtcaaatggtatttccagttctaga

SEQ ID NO: 28505 - DNA, 117 bp, Homo sapiens
ctaggttcttctagtcagtatttctggacataaggccgttattacctttctacgagttttgtctctgacacgcacgcacacacacacacacacacacacacacacacacacacccct

SEQ ID NO: 28506 - DNA, 233 bp, Homo sapiens
aataaggaaagagagcaagataaagccccagctccagctccctccagggctgaagtttcggactgacctctgcccagaccattccaccctccaagcccagccctgcctgccctgggctgcgagtatgagagagctcagggcagacaaaacgcccctcacacttctccctttctttcttccacctccctgtcctctatcccgtagaacagtggtccccatttttttttcttttt

SEQ ID NO: 28507 - DNA, 395 bp, Homo sapiens
  misc_feature 290: k=g or t
caaataaaaatagttttaaattaaatttacattgctagcaccaaatcacttgtgtggatgtctgaaaaatatgtttttacttgatataaccataattatgcatttaaacaaattttatcctaattactaatgttctggctctaggcaatgccttggccttgataagatccttaaaagataaactataaaactagaaaaagaaaaaacagaaagtccccataccacagacaaatctcaaatctgtggacacctctttgcaatctcaagtcttgctcaaaggtataattatkcctttaaatacagaccactagtcttgcaaaaatatgtgagtaattccatgatccaatacagtataatccaccatgatagggcagagaaaggctgctagagagaca

SEQ ID NO: 28508 - DNA, 359 bp, Homo sapiens
ttcttgctctgaaatgttaagctctaactgatccatttctgtgtcctttagcctagtatgtctgaacttccattcttgttatatatttaaactttccctctatattataggttttgtggcatccacggtcaggtgtagaggaagctgccccttgcagaactgtactgtaatatttttcttttataaatattttcacaggactgattgtacacagggcttgtaataaaattttaacactgtgctgtgaaacaactatggggaatctccattgaaggctacttcatgggcacctgaaagtggagtgttatagctatgactttctatttcttgtttcctaagtaaattaaacctaattttca

SEQ ID NO: 28509 - DNA, 245 bp, Homo sapiens
tggaacggaatgtaatgaaatggaatggaatggaatcaacccgagtgcaggggaaaggaatggaatggaatgcaatggaatggaatcatccagaatggaatggaatggaatggaatggaatggaatcaactcgatttcaatggaatggaatggaatagaatggaaaggaattaacaagaatagaatggaatggaatggaatagaatggaacagaaaggaatggaatggaatggaatggaatcaac

SEQ ID NO: 28510 - DNA, 365 bp, Homo sapiens
  misc_feature 86: y=c or t
  misc_feature 290: d=a or g or t
  misc_feature 337: r=a or g
  misc_feature 344: d=a or g or t
  misc_feature 353: r=a or g
cagactcgagattttcctttctcttttaccagctgatccttcctatgtattataaatattagactccgtaaacaaacttcattttyctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaatdccatgcaaagaaatgtatctaaattatttttgttagatgataagagracttgcdtggtcaggrcagcagccagcc

SEQ ID NO: 28511 - DNA, 339 bp, Homo sapiens
  misc_feature 88: r=a or g
  misc_feature 272: v=a or c or g
  misc_feature 328: w=a or t
ttcctattccgttccctaaatattttccccagtccacgaagagaggtcttcaagagcctacagggctctaaggacacaggttctagtratggatagtgaacagttagctccaagtgaaatgatgttgtcttggggttacaaacatgtttgtctctcaaaatgaggaatagttacgagagtagatgatagtgattttcttgcgtgacatcctacctcttgctttttaaaatatttctcccaaatatgaatttggcaagtgccttttaaatgcvttattgtcaacaaatagtctcattcagtacatgttcagaaaccgcatggtggattwatggatcttta

SEQ ID NO: 28512 - DNA, 303 bp, Homo sapiens
  misc_feature 84: k=g or t
  misc_feature 85: y=c or t
  misc_feature 92: r=a or g
  misc_feature 236: r=a or g
caagatgttaataataagggaaactgtgtgtggagggaagggcatatatggcatctttctgtgtcttctgctcaattttcctgkyaagtctraaactctctaaaaagtaaagttggttgggtgcagtggctcatgcctgtaatcccagcactttgggaggccgaggtgggaggatcacctgaggtcaggagttcgagaccagcctggacaacatggtgaaactccatctctactaraaataaaaaaattggcctggcgtggtggtgtgggcctgtgatcacagctacttgggaggctgaggca

SEQ ID NO: 28513 - DNA, 262 bp, Homo sapiens
  misc_feature 215: k=g or t
  misc_feature 216: k=g or t
  misc_feature 225: r=a or g
  misc_feature 234: k=g or t
  misc_feature 235: k=g or t
  misc_feature 236: k=g or t
tgaatgtgggaatcatcagatagtctaggtctgtggaagtgttagaaatgattttacttgactttcatggatcagcctaactttgaaattaacactgttatattctctttgcctcattaagaccaaattatctttaattagcttcacataagtattagatattataccaaatgaaattttgtgtctgctgctcagattgctgggtggttaaatckkacttacagrtgagttgtkkkgcatgtgtgttttcaaattagcaaat

SEQ ID NO: 28514 - DNA, 176 bp, Homo sapiens
  misc_feature 46: y=c or t
  misc_feature 118: m=a or c
  misc_feature 139: s=g or c
ctagtctttgagttcccacacaggtgactttactaacatttctttytgtattttaaaaatagtccactcagtccaggtgcagtgcctcatgcctataagcccagcagtttgggaggcmaaggtaggaggatcacttgasgccaggggtttgagaccagcctggcagcatagcaaga

SEQ ID NO: 28515 - DNA, 286 bp, Homo sapiens
catggaattgtcaaaagtacaaactgacagtgtgtatatttaatttaaagacttatttaaaaactcacaagctctcacctagactttggagagcagtctgttttctgtaatgtctgatactagaaactaatttgcttattttagttgtattcaagatttgaagatgtattttatagacaagttctgtttttgaactttgtggaactgttccaatcaatcaatttcccagttatgatgagtatttacattatgaatgtataacccagacatgatttgtaaagccgac

SEQ ID NO: 28516 - DNA, 228 bp, Homo sapiens
taacattttaaaggaagagacttgaggcttctgatgtgtgaaccataacaatccaccagcccctaaaacattgctctttggagtcttgttttcagtagttcagagctattcttctgtatgtctgtgtggtaaagtagacataacagaaaatgtaccatcttcaccatatttaggtggacagttgagtggcattacatgcattcccattgttgagtgaccatcacccca

SEQ ID NO: 28517 - DNA, 238 bp, Homo sapiens
  misc_feature 191: k=g or t
  misc_feature 216: k=g or t
tatattttcggaaagcttggaaggtagtattgccttgggaaagcttagttattctttataagggcaatgactcttacaggataggtgtaaacagtgatactgcaaaactctgagaaaggatacttcttgagggatatctaattgtgataatattttccattcatcgtctttggaaaaatataatctagttktgttgaaataggaatattattttckagatattttatttttccaaaga

SEQ ID NO: 28518 - DNA, 275 bp, Homo sapiens
  misc_feature 92: w=a or t
  misc_feature 247: m=a or c
  misc_feature 248: y=c or t
tctttgtgttgggaacataataattcttcttttgtagctattttgaaatatacagtaaattattgggaaactataatttccctactccacawtttttcttttgtgaattaaaaaagcttcagagtggtacgactcgtgggatgttgatttttgtctttttctttgctatttaggatgagctgacaactaccaagaggagttacgaggatcagttaagtatgatgagtgaccacctgtgcagcatgamygagacattatctaaacagagagaagtc

SEQ ID NO: 28519 - DNA, 54 bp, Homo sapiens
caccacagtcagttttaggacatttttagtattccacaagaaactccattcccc

SEQ ID NO: 28520 - DNA, 125 bp, Homo sapiens
aagtattgttctgttctttttgtctggattcagttcagcatcaggatgactttaaagccagagcaccacaatgttgatttctatttagctcttaagcctattataatctgagtgttttttttttt

SEQ ID NO: 28521 - DNA, 373 bp, Homo sapiens
ttatagaaaataactagaaatagaaggaaaccactctataataaggccatatgcaaaaatctcacagctaacatactccatggtgaaagactgaaagctccaacatcagcaataaggcagcaatgcccacttttgccacttatagccaacagagtattggaagtgttagccagagaaaataagcaagaaaaagaaacaaatgccatctgaatgggaaaaagcgaagttatctgagtttgcaggtggcgtgatcttaaatgtggaagaccctaaagactaaacacacacaaacctattagaactagtatatgaagtcaacacacagaaatcagttgcatatctatacacttaacagtgaacaatcctaatagaa

SEQ ID NO: 28522 - DNA, 409 bp, Homo sapiens
  misc_feature 82: r=a or g
  misc_feature 83: m=a or c
  misc_feature 86: d=a or g or t
  misc_feature 94: r=a or g
  misc_feature 98: k=g or t
  misc_feature 100: w=a or t
  misc_feature 101: r=a or g
  misc_feature 106: r=a or g
  misc_feature 300: k=g or t
  misc_feature 313: n=a, g, c or t
  misc_feature 314: r=a or g
  misc_feature 328: k=g or t
  misc_feature 349: k=g or t
  misc_feature 354: w=a or t
cacagcagcaaattagacgaaaggaccctagttgaagtatacagattttatttttatataagatatttgtttagtatcaagrmagdggtttacrtackgwraaacratgtaactgggaatagagagattttatttgttaactcagatttagttcaaaagtgattttacgtaggtagaaagcacatatggagtttcttccataaattccgtaattttggctgaattaatacattctaaagtaggttttttcttatcaaagtgtcttgctatttgtgttttatatgcgtgtttcctgcagtkttctttgcaaatnrcatgttttaatgtkttcatcacaggttttacaatkttttwctgtttgaatctcgctctgtcgcctaggctggagtgcagtggcacgagagctcac

SEQ ID NO: 28523 - DNA, 58 bp, Homo sapiens
  misc_feature 5: m=a or c
  misc_feature 16: m=a or c
aacgmcgaccctcagmtcgccagtccggtcgctggcttcgccgccgccatggcaatga

SEQ ID NO: 28524 - DNA, 412 bp, Homo sapiens
aaaggctggtgtggaggtgcacgcctgcagtcctagctactcccagaggctgaggcgggagacttgcttgagcccaagagttgaagtccagcctgggcaacatagcgagacccccatctctaaaaataaaaataatgcattagaatattattggattcctgggcagggcacagtggctcacacctgtagtcccagcgctttgggaggctgaggtgggtggatcacctgaggtcaggagtttgagaccagcctggccagcatggtgaagccccgtctctactaaaaatgcaaaaattggccaggcgtggtggcgggtgcctgtggtcccagctgctcgggaggctgaagcacgagaatcgcttgaatccgggaggcggaggttgcagtgagctgagattgcgccattgcactc

SEQ ID NO: 28525 - DNA, 415 bp, Homo sapiens
  misc_feature 110: k=g or t
  misc_feature 127: r=a or g
  misc_feature 319: m=a or c
  misc_feature 368: m=a or c
cacccatttttcttcttcagaaggcctttcctgtgtgagacccacatattttaaccttttgctcctatcccatttttaaagaattagagaataaaccaggcctgtttctkttcccctgaaatccctrcctctggcttcctaaacccatcatctaaggtgacagagcagtgctggaatagcatctcctttcactttcccaaaactgccacagatagctgccactggcatgctctttgattcctggaagcaaacgtgggactgtcggaggaaagggattgttctggtcttactcataactgggtggtttgagggtgactgmagtcgtgcttttcctgtgtgtgctgccagcacagggctgtaaatgcagmtattgcgcctgtgtgcgtgtgtataagtcaagctccaagaggctcct

SEQ ID NO: 28526 - DNA, 345 bp, Homo sapiens
ccatccttcaaagaatttgacattctaatgtcaccaatttttcgacatgctaatgccagcaattttttttgaaagttgaaatagaacataataaggcaacaaaacgagactaagagggttctgcaccgtgttccaacaatcttcagtccccttcactgttcatgtctaagcactgaggcgttctaaagcaggtcaccttttgcctcaaggacttttcttgaaatatcatggtcttgctctgtcgcccaggctggagtgcagtggcgtggtcgcagctcactgcagcttcgacttcctgggctgaagcgatcctcccatctcggcctgtcaagtagctggaaccac

SEQ ID NO: 28527 - DNA, 409 bp, Homo sapiens
  misc_feature 80: s=g or c
  misc_feature 84: k=g or t
  misc_feature 85: v=a or c or g
  misc_feature 96: k=g or t
  misc_feature 103: s=g or c
  misc_feature 105: m=a or c
tactaaaaatacaaaaaaaattagccatgtatggtggcatgcacctgtagtcccagctactcgggaggctgaggcaggasaackvcttgaactggkgatacasgmagggaagtgctgggaagggaagggcacagtccctttaaatgacatggaagggagaaagggcgtggtccctggctagggctccaccccagcctgtgcccatggacctaggtgaggacaggcatttttgttttcctgcccaaatgttgcatttcccaagaccaccctggccggccacgcccccatcctgtgcctataaaaaccctagcaggcagacacacaggtaactggacggctagaggagcacatcagtggaggaacacacaagcggctggacgtcgagaggaacgcaccgacaggcactgcg

SEQ ID NO: 28528 - DNA, 283 bp, Homo sapiens
  misc_feature 99: s=g or c
  misc_feature 108: s=g or c
  misc_feature 117: s=g or c
  misc_feature 130: m=a or c
  misc_feature 131: r=a or g
  misc_feature 181: s=g or c
  misc_feature 277: m=a or c
atattggatccagactcgtccgcaagcctccgcctctgtgcggcgggactggaggagcctcgctgagcccagggcgcgagcgcgcagaggagagggaasgcgggggasggctggaasggagaggaagggmrtggttgggagccgggctgccgcagcctctagtctcctcagccgcggaagsacccctcctcctgcgccgcggccgcctccctcctcgctgtggaaagatgcccttagcccaggggtgtgaagaagggggagaagtagctgccagagmcgcccc

SEQ ID NO: 28529 - DNA, 338 bp, Homo sapiens
  misc_feature 89: k=g or t
  misc_feature 92: d=a or g or t
  misc_feature 114: m=a or c
tttgtaacataaaaaaatactaaatgatcttaaagcttcctaaattgtgaaaagggtatgtgctaacatctcagaactttagacctgcktgdtgtcatctttaccgatctctgmtgataaatgcagaagggatctgagagtttttaaagcaagtagagtcaatcagagttttgaacatcatagtaatacttccgtgattcagagttagatcatataaatcaaagtaacaatttggattttttttaaacaacaatatcataactgtcataaaacagatggtccaaccccaggagcagataataacttgggcagctctgtggggaacaagacggggtact

SEQ ID NO: 28530 - DNA, 347 bp, Homo sapiens
  misc_feature 72: r=a or g
  misc_feature 313: m=a or c
  misc_feature 320: r=a or g
gcattgtggtaaaccattcatgagaaatccacttgcatgacccagtgacctctcaccaggttccacctccarcaatggggactacagtttggcatgagagttgatagggacacagatccaaatcatatccctaggtattctattttgcttagagactatcattatttctccctacctttattcactcattctttgtcatcttccattactctgttttcacctggtgggctctctatgtgctcctgctcaaactttctctcctactctttacttagcacagagctgaggtgacagaggtaaaatcatagagtgmcacaggracaaaaagtttttttgaggagggagta

SEQ ID NO: 28531 - DNA, 303 bp, Homo sapiens
tgaatctggttctcaactctcctcaactctgttgtccagactagagtatgagtatagtggcgtgatcatggctcactgtagcctagcctgaaactgctggcctcaagtgatcatcctgcctcagcctctagaatagctaggattacaggcacaccaccgcagctgagttttttatcttctagttgttatctttttaggacaggaccttgctgtgttgctcagcctggtcccagactcctggcctcaaataatcctcccaccttggcctcccaaagtactgggacaataggcatgagcatcaca

SEQ ID NO: 28532 - DNA, 315 bp, Homo sapiens
tgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccgt

SEQ ID NO: 28533 - DNA, 251 bp, Homo sapiens
tataagagccttgcactagtatactatcatttccctcttccctaccattatgctattattgtaacatgtttaacttctacatatatttcacaattcatttttaaaaataagacaactttattgagatgtaattacatagattacaattcacacattcaaagcctacaatttaattgtctttaatgcattcacagagttgtacaaccatcaccacagtcaattttagaacattttaatcattcccagaagca

SEQ ID NO: 28534 - DNA, 166 bp, Homo sapiens
tagtagttgagaatttgctaatattaatgaggcacaaagaaaataacctttttaaaaaaacagtgcataaaaagacactaacatgactaacatgaataaagccttctatagcctgacacctaagcagaaagttttcttaggttttatattttagcataggaaatcc

SEQ ID NO: 28535 - DNA, 217 bp, Homo sapiens
taagatgtacactggggccaggtgcggtggctcaggcctgtaatcccaacactttgggaggccgaggcgggtggatcacaaggtcaggagatagagaccatcctggccaatatggtgaaaccccgtctctattaaaaacgcaaaaaattagccgggtgtggtggcgggcacctgtggtcccagctactcgggaggctgaggcaggagaatggctttc

SEQ ID NO: 28536 - DNA, 367 bp, Homo sapiens
  misc_feature 28: s=g or c
  misc_feature 93: r=a or g
  misc_feature 306: y=c or t
  misc_feature 314: y=c or t
  misc_feature 325: y=c or t
  misc_feature 334: y=c or t
cccaaagtcctgggattacaggcgtaascatcacgcctggcccttcatttgctttctaggttctcgaggtggcagcttagattgttgatttgraaactccttttttcaaaatatgaatttagtgctataaattttcctctcagtactgctatagatatattccataactttttaatgttatattttttctttcagtttaatatattttaaaaatttcctttgagacttcttttgttgacccatagattatttatttccctttttatctttactgttttctcccttcatttgctttctttctttttytgattttytaattttcatyttatttttyttgagacagagtctcactctgttgcccaggctg

SEQ ID NO: 28537 - DNA, 330 bp, Homo sapiens
  misc_feature 97: n=a, g, c or t
  misc_feature 102: v=a or c or g
  misc_feature 121: y=c or t
  misc_feature 280: s=g or c
  misc_feature 308: m=a or c
cacatggtgctgtcaatgagcagagaacagtcacctgcttacctgtctgttcatcttacttcatttatggtgcagttttacgtgtgactgaatatgncttcvaccctcctatgatcatgtytaagtttaggttgccatgaggaggcatggcaaatgcttttgaacactttcgtacccctcatcttatgtctctccaggccctagattagtggtcatctttcagagaatggctagaactcgagtcttctgggatagcctactaacacgctttaccattgasgagtgtcttcaaaactcacatcatttgmcttgccatgcgtctctatatgt

SEQ ID NO: 28538 - DNA, 334 bp, Homo sapiens
  misc_feature 97: s=g or c
  misc_feature 101: r=a or g
  misc_feature 102: m=a or c
  misc_feature 106: w=a or t
  misc_feature 112: m=a or c
  misc_feature 113: v=a or c or g
  misc_feature 309: m=a or c
tgtgtttaaggaagtgaagataaaaaggacattgtcaaatggaaaagaatatttttcttacaaagttggtatatgctagttttggaaatgtttctgsaagrmctgwatttamvatttagatctcttatcattttcacatttgtaaatatgatttggtaaatgccaacaaataattgtttaaaaacattttgggctgggcgtggtggctcaagcttgtaagcccagcactttgggaggctgagggaggtggaggagtttgagaccagcctggccaacgtggtgaagctgtgtctctactaaaaatacgamaaaaaaaaattattcgggcctgcga

SEQ ID NO: 28539 - DNA, 255 bp, Homo sapiens
ctagggaaatcatggccactggaattaatacatttagttaaagtgatttgggaactcatctccataaaacttaggttatctttgtagagctccatcctgctctgaactttctgtctagtgctcgactcctttgttttttgttttgttttgttttgtttgttttgttttttgtttttgagacagagtcttgctctgttgcccaggctggagtgcagtggcacaatctcggctcacttcaacctctgcctcccgcgc

SEQ ID NO: 28540 - DNA, 54 bp, Homo sapiens
ttctataataattcaaagaatactctaataaatgtctgcaattgtggtcacatc

SEQ ID NO: 28541 - DNA, 60 bp, Homo sapiens
cttctttatgttctcagggaaatgcttaggtggtgtcacaaaatgtgccttttcttttct

SEQ ID NO: 28542 - DNA, 436 bp, Homo sapiens
  misc_feature 315: r=a or g
  misc_feature 325: r=a or g
  misc_feature 391: r=a or g
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagrtaccatctcrcaccagttagaatggcgatcattaaaaagtcaggaaacaacaggtgctggagaggatgtggagaartagaacacttttacactgttggggggctgtaaactagttcaatca

SEQ ID NO: 28543 - DNA, 361 bp, Homo sapiens
  misc_feature 242: d=a or g or t
  misc_feature 323: v=a or c or g
caataagaaaaagataactttctcaacaaaaaatggtaaaagaatataacaagcagcgcacagatccctgatggctaataaaaatgagaacatgttaaattgtcatgaaaatgcacattaaaacaataagatacaattcacaccatcggacaggttatatttaaaattgaaacactttaacgtttggcaaagatatggagagacaggaactctcaaagtaatgattgacagttgatacagcdtgtctggagagtgatttggcaacagtcagagaggttgaagatgtgcaccaaatcccacagttgcatgttaagatgtttgcvttagaggaattttcacacgtgttaattttagcattgtc

SEQ ID NO: 28544 - DNA, 316 bp, Homo sapiens
  misc_feature 281: d=a or g or t
taacataagaaaatgatttcatttcagaacaggaaaatgctaaggatgtagctagagagcagtaattattttactgtctcaagacaatagctagagggtaccagaaagtagtcaattaacagtctgcagtctagcctacaaagtaatcacattgaagaggtacaaaactgtggacacttgacttaattcatccagaaaagataataagcttgtctggattgctgaagggttggcatctacataggcaggtaatatttcagagattttccacaataagaacdttaggatttggtaatactactattctattgtacac

SEQ ID NO: 28545 - DNA, 312 bp, Homo sapiens
  misc_feature 271: b=c or g or t
catgttttaaatccaaggcattgagactatctagaagcaaaaaagttggttttaaaaattctttttattagaagtgtgtttaaaaacatgtctttttttcccttgagcgacagtggcctcactacattgcccaggctagtcttgaactcctgggttcaagcagtcttcctgccttggcctcctaagtagcagggattacaggcatgcacccacatgccaatttttattgcttaaaatggcgagttctatggatattatctagccccaagcbcatatctgtacacttttgttcattttataataccagaaagt

SEQ ID NO: 28546 - DNA, 65 bp, Homo sapiens
  misc_feature 33: k=g or t
gcagtacgataatgatacataggcagtctcatkccaattatcagtagcttacagatatacttatt

SEQ ID NO: 28547 - DNA, 233 bp, Homo sapiens
gaacatttttcagtaacgtgttctgttcactatccatccaagcttctgtcattagataagacttcacccatgtaacctgctacctagacacgctcggagggccggggctgggtgtgcttgctcagggtggctagtatatacatttgttgaatgaatggctgatggaacttgaattgaatcacagtatattactttctcatttattccaatggtccacttagtatagatccaac

SEQ ID NO: 28548 - DNA, 256 bp, Homo sapiens
  misc_feature 99: w=a or t
  misc_feature 123: w=a or t
  misc_feature 131: w=a or t
  misc_feature 230: w=a or t
  misc_feature 237: w=a or t
  misc_feature 241: w=a or t
cagttaaattaggtttgttttaaagtcacttgaagtaattcttctttgtaggttttgctaccagctctatataattagggccttttgtttcattttgcwttcagattttagggattcgttttwcctctttwggttttattttgtaatcaatgtaaaatatctacagtgtggcagagtgaactctacaaaagaatggatataagtccattcttgtctcttttaccattttwtcaagtwtatwtccttccctcccacc

SEQ ID NO: 28549 - DNA, 287 bp, Homo sapiens
  misc_feature 91: s=g or c
gcagagaagtgtgcagtgagggacttgggcagacagcatgagaggcagagtctttgcttacctggaggttgccttctaatgtactgggctsctgggagtgcatgaaggcttcttagatgaagagtaatggggatgtcttacacagcaagatgagaaaacacagaccacttggctctctagcgaggaccagaatttgagtcaaaattatatgaaagcaacagcccacaattgcctgcattttctttcctcttcaaaaccacttctgctccaaagaccatgaacctgaa

SEQ ID NO: 28550 - DNA, 334 bp, Homo sapiens
  misc_feature 89: k=g or t
  misc_feature 94: r=a or g
  misc_feature 100: k=g or t
  misc_feature 103: r=a or g
taatcgaaaaattgggatctaagtaaactaaagagcttctgcacagcaaaagaaaccaccgtcagagtgaacaggcaacctatagaatkggagrcaattkttrcaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccacaatgagataccatctcacaccagtta

SEQ ID NO: 28551 - DNA, 291 bp, Homo sapiens
  misc_feature 22: k=g or t
  misc_feature 113: s=g or c
  misc_feature 119: r=a or g
  misc_feature 120: s=g or c
  misc_feature 121: s=g or c
  misc_feature 132: s=g or c
  misc_feature 178: r=a or g
  misc_feature 179: s=g or c
  misc_feature 246: s=g or c
  misc_feature 247: k=g or t
gttagaggaagaagaagaagakgaggatgaggaggaggaagaagaactggaagaggtggaagacctggagtttggcacagcaggaggggaggtagaagaaggtgcacctccasccccarssctgcctccagstctgcctccccctgagtctcccccaaaggtgcagccagaacccgarsccgaacccgggctgcttttggaagtggaggagccagggacggaggaggagcgtggggctgacacagskcccaccctggcccctgaagcgctcccctcccagggagaggtgga

SEQ ID NO: 28552 - DNA, 261 bp, Homo sapiens
cacgttttggctgtatcctttatcccagccagtcatccagctcgaccttatgagaaggtaccttgcccaggtctggcacatagtagagtctcaataaatgtcacttggttggttgtatctaacttttaagggacagagctttacctggcagtgataaagatgggctgtggagcttggaaaaccacctctgttttccttgctctatacagcagcacatattatcatacagacagaaaatccagaatcttttcaaagcccatc

SEQ ID NO: 28553 - DNA, 276 bp, Homo sapiens
tgagaaccatttaagagataaaagccacagaaactggtgattgatttgatagaaggaaggtaggagagggagtcatcagcagataacccaggtttaagacctgggcagctggtgagtgtagcactcactgcactggagaacagcaggggaaggacatgctggggcagagctttgcatatgttgagctaaaggtgcccgggagaggcatttcaagatctccattaagcagtttgatatgtgagtcagaagaagagagagccctccaaacagaacaat

SEQ ID NO: 28554 - DNA, 262 bp, Homo sapiens
  misc_feature 91: r=a or g
  misc_feature 94: m=a or c
  misc_feature 102: m=a or c
  misc_feature 118: r=a or g
tggtgcagtggatcatgcttgtaatcccagcattttgggaggcagaggcaggaggatcacttgagtccaggagttcaaggccagcctgagrcamataaggamgaccctgtctctataraaaaatagaaaaattagccagatgtggtggcatatgcctgtagtcccagctactcaagaggctgaggtgaaggattgcttgagtcagggaggttaaggctgtagtgaactatgatctcaccactgcattctagcctgggcaaca

SEQ ID NO: 28555 - DNA, 190 bp, Homo sapiens
  misc_feature 100: r=a or g
aggacacaaatctgcttttctgcccatacactggcccaagggctcacctaacttgggagggaaggggctgttggtacaaggatgattttctgttagactrccattttgcacggtctcccccttcccatctgatgtgtcctgcccctcagctctttgccttatctgtgtcactgtcactttagcaaaaaat

SEQ ID NO: 28556 - DNA, 211 bp, Homo sapiens
  misc_feature 90: w=a or t
  misc_feature 93: w=a or t
  misc_feature 95: n=a, g, c or t
  misc_feature 97: r=a or g
  misc_feature 100: r=a or g
  misc_feature 109: s=g or c
tcgattccattcgattgcactcgggttgattccattccattccattccattccattccgttccattccattccattacattcgggattgwtcwantrcarttcccttgsactccattacattccattccattcgggtaggttccattccattccattccattcctctcctttccaatgcactcgggttgattccattccattgcattccat

SEQ ID NO: 28557 - DNA, 310 bp, Homo sapiens
  misc_feature 310: r=a or g
tgtcttggactttctttttacttgaaaaaactatatatattccaaaaatttaagaaaatgcttcatatcttcagctaaataaagcttgttcctttacaaacagtaaagaaccatgaaagataattctatttgtttcttgctactgtactcagtcagaaaattaagaatctagaggtgccatggaggggagagtgtggaagatcctaggacaataatcttttaaaagaatgtccttcatggctctccagtgatctacgacttttcatttttcttcagttcaactttgtttaaattaacgtgaccccacgar

SEQ ID NO: 28558 - DNA, 269 bp, Homo sapiens
  misc_feature 92: r=a or g
tttttcttttaagcagagtcttgagtcttgttctgtcacccagctggagtgcagtggcacgatctcagctcactgcaacctccgccttccarggctcaagagattctcatgtgttagcctcctgagtagctgggattacaggtgtgtaccacacctggctaaatttttgaatttttagtagagacgggctggtcttgaactcctggcatcaagtgatcctcccacttcggactcccaaagtgctgggattacaggcctgagccatcccc

SEQ ID NO: 28559 - DNA, 295 bp, Homo sapiens
  misc_feature 241: r=a or g
  misc_feature 264: k=g or t
ccattcctgagtgacatcacttagaataatagtctccactctcatccaggtcactgcaaatgctgtaaatccattcctttttatgactatgtagcattccatcatatatatatatgtatgtatgtacatacacacacactacagtttctttatccactcattgattgatgggcatttgggttggttgatggtcatttggggtggttccatgattttgcagttgtgaattgtgctactataracatctgtgcgcaagtatctttkttgaataatgacgtcttttcctcggggtagg

SEQ ID NO: 28560 - DNA, 226 bp, Homo sapiens
ggagtcttgccttgtcacccaggctagagtgcagtggtgtgatctcggctcactgcaaactctgcctcctgggtttaagcggttctcctgcctcagcctcctgagtagctgggattacaggtgcccaccaccgcgcctgctaatttttgtattttttagtagagacggggtttcaccatcttggctaggctggtctcgaactcctgacatcatgatctgcccaacc

SEQ ID NO: 28561 - DNA, 160 bp, Homo sapiens
tagccgggcgtggttgtgtgtgcctgtagttccagctactcaggaagctgatgcgggagaatcgcttgaacccaggaggcaaagttgcagtgagccaagatcgtgccactgcactccagcctaggcaacagagtgagactatctcaaaaaaaaaaaaaaa

SEQ ID NO: 28562 - DNA, 322 bp, Homo sapiens
  misc_feature 300: n=a, g, c or t
  misc_feature 322: n=a, g, c or t
tagttaatatttaaaaaaatgtattgtgcattttggcttcacatgtttaactttttttaagaaaaaagttgcatgaatggaaaaaaaaatctgtatacagtatctgtaaaaactgtcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgcnatgaattaactctgccgccatn

SEQ ID NO: 28563 - DNA, 78 bp, Homo sapiens
ctatttttccttgtgtctctattgattgtataaatttttcaattaaaaaagaacatacaaatattacttttttttttt

SEQ ID NO: 28564 - DNA, 148 bp, Homo sapiens
  misc_feature 85: w=a or t
  misc_feature 98: w=a or t
  misc_feature 101: y=c or t
  misc_feature 107: k=g or t
taatggttgaagaagcataaaaaataggactaaactttaattgcttaacaccctaacttttggattttaggtattctgtggtgcwtctactggtcccwggyttcatkcatttttctctctaaagtatgagactgtctcgaaaagaaaa

SEQ ID NO: 28565 - DNA, 291 bp, Homo sapiens
  misc_feature 90: y=c or t
  misc_feature 96: w=a or t
  misc_feature 103: k=g or t
  misc_feature 127: k=g or t
  misc_feature 159: k=g or t
  misc_feature 160: k=g or t
  misc_feature 163: w=a or t
  misc_feature 178: w=a or t
  misc_feature 274: w=a or t
  misc_feature 277: w=a or t
  misc_feature 281: w=a or t
cctttgccaacatatccctggttatctcttggttaaatgaaacacatcctctagaagattcctcagaaagggcttgtgtgtacagcattytctgawgttcctkcatattcaaaatggtttttttccktcctatggcctcgatatttgaaggacagcttkkgcwgggtataaaatcatwggcttacacttaaaaaaaatcagctttattgaggtataagttatataaaaattcaccagttgtaagaatacaatttgaaaaatgtgacaaacagawagwgtawccaccaacga

SEQ ID NO: 28566 - DNA, 203 bp, Homo sapiens
atacaaagtgaaataaataaaggttcctctttttcaggagtgactacctagaccataggacaggtacaccatagcgagagttgtctctgactaattttaagctcaacaggtgcaggaggtgcagggaaggttatgcctatgggggaaagtgtaggttggagatggtaggggctgtgttcatcaggtggaccagcagaacaggc

SEQ ID NO: 28567 - DNA, 327 bp, Homo sapiens
  misc_feature 246: h=a or c or t
  misc_feature 248: r=a or g
  misc_feature 252: n=a, g, c or t
  misc_feature 315: r=a or g
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagcharcagncacacaaaaaaatgctcatcatcactggccatcagagaaatgcaaatcaaaaccacaatgagrtaccatctcaca

SEQ ID NO: 28568 - DNA, 268 bp, Homo sapiens
  misc_feature 145: k=g or t
tatctggtagtaattttaatgtttatttgccttttaattgagatagaaagcatattttcctgtttttggagccatttggatttccttttcagtgaatgacttatttataacctttgcctaatgttctcttgggttgtttgatttkttttccttatagatttgaaggagttctttatatatttaatgtaaaaataggtcttgggacaaagctatagtcaccctgtttgcttctgtgtagttcttgccagagttttgatttttgtggagt

SEQ ID NO: 28569 - DNA, 237 bp, Homo sapiens
  misc_feature 139: d=a or g or t
attatttgccatggtttggtaaatagggggtcctcagagggctcttgacagacattctattctacccttaattaacagcaatacatctgtttgttgtgtgcttcccccaagtgataggtactcttagactgtcccttgdcaatctcctgcaatatgttttcagctcaagcagtgacaaactagaagtaaatttgatgtggattaacatccagtgaacttaaattttcataccggata

SEQ ID NO: 28570 - DNA, 143 bp, Homo sapiens
  misc_feature 42: w=a or t
  misc_feature 74: r=a or g
  misc_feature 100: h=a or c or t
  misc_feature 113: h=a or c or t
  misc_feature 117: h=a or c or t
  misc_feature 118: k=g or t
  misc_feature 120: n=a, g, c or t
ctcaaagctctatatgtttacatattatttctgtagattgtwttcaggagaaagttttgcttctatggtaagartgagcactttggcttatgtataagthagaaataattgthagthktnaatatgcacttcgtggggaaatt

SEQ ID NO: 28571 - DNA, 287 bp, Homo sapiens
cccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctct

SEQ ID NO: 28572 - DNA, 310 bp, Homo sapiens
  misc_feature 73: m=a or c
  misc_feature 95: b=c or g or t
  misc_feature 102: r=a or g
  misc_feature 106: k=g or t
  misc_feature 116: k=g or t
  misc_feature 118: s=g or c
  misc_feature 126: k=g or t
  misc_feature 137: m=a or c
  misc_feature 193: r=a or g
cattatatttggggagaagcagggtttatgtgcacattcagttgccccaatcagagactttttgaacctggamaaagccattgtaggaccttctbgggctartcckctccatatckastccacctkcttcatttgcmtatgttggcatctcaggcactatctactatctacttctagtactttctacactcaraacaggaaaacatacacacatgtgtaggggcgtatacacacacatccacacactcacacccacacacatacacactcatacacaccacacccccacacacacacacatacacacacc

SEQ ID NO: 28573 - DNA, 268 bp, Homo sapiens
  misc_feature 71: k=g or t
  misc_feature 72: m=a or c
  misc_feature 73: n=a, g, c or t
  misc_feature 128: v=a or c or g
  misc_feature 129: m=a or c
tttttcttttaagcagagtcttgagtcttgttctgtcacccagctggagtgcagtggcacgatctcagctkmntgcaacctccgccttccaggctcaagagattctcatgtgttagcctcctgagtavmtgggattacaggtgtgtaccacacctggctaaatttttgaatttttagtagagacgggctggtcttgaactcctggcatcaagtgatcctcccacttcggactcccaaagtgctgggattacaggcctgagccatcccc

SEQ ID NO: 28574 - DNA, 90 bp, Homo sapiens
  misc_feature 21: k=g or t
  misc_feature 22: r=a or g
  misc_feature 50: r=a or g
tggatgaggaaactgagacckrgagacattaagtggctttttaaagcttrcgtagtaactggcagagctaggaccacaacccgggtgctt

SEQ ID NO: 28575 - DNA, 396 bp, Homo sapiens
  misc_feature 98: y=c or t
  misc_feature 311: s=g or c
  misc_feature 317: w=a or t
  misc_feature 322: d=a or g or t
  misc_feature 323: r=a or g
  misc_feature 326: w=a or t
  misc_feature 388: w=a or t
caaggcaattgttttatggtggattttgttattactgatgacattaaataaaaatgtagtctcaagagttgggggtcaagggctggaaaactaccccyttggggccggacgtggtggctcacatctgtaatcccagcactttgggaggccgaggcaggtggatatcttgaagtcaggagttcgagaccaacctggccaacagggtgaaacccaatctctactaaaaatacaaaaattagctgggtgtggtggcgcaagctacttgggaggctgaggcaggagaatcgcttgaaccagggaggcggaggctscagtgwgctcdrtawtcgcgcactgtactccagcctgggtgatagagcaagactctgtctcaaaaaaaagaaagaawaaaaaaaa

SEQ ID NO: 28576 - DNA, 252 bp, Homo sapiens
tccttaccaaaaatacatgatcatcatatacataatttttttcatacctttctcccccacttgtttccttactaccttgtttcataaaaaacttttttcaagcccataatttgaattaacttttagataacttctgaattaaacaaaattattatttttctcataacattttttggggcacattttttaaacagaattatatcttatccttagtaaccttaaatgttagtgaaaccctagaaagcagtcccc

SEQ ID NO: 28577 - DNA, 344 bp, Homo sapiens
  misc_feature 302: n=a, g, c or t
  misc_feature 303: m=a or c
cacgtttaaattaaccttttttatttcaagatagtttaagactcacaagttgcaaaatagatcagagttcccctgtacccttcatccagcttccattgatatcttacataatcctggcactttgtcaaagctggaacactggcattgaaacaatactattaactcaggtacagaccttatgtacacttttttcccccggcatagagttttatgaaatttatcatgtgtgtatattaatgtgccatcaccacaatcacaacatggagctgttccatcaccacaaaggaactccctcgtgttanmccttagctgtcactctcttctccccaaacttgaacccccgt

SEQ ID NO: 28578 - DNA, 155 bp, Homo sapiens
  misc_feature 95: m=a or c
  misc_feature 110: r=a or g
taatcgaaaaattgggatctaagtaaactaaagagcttctgcacagcaaaagaaaccaccgtcagagtgaacaggcaacctatagaatgggagamaatttttacaatctrcttatctgacaaagggctaatatccagaatctacaaagaactcca

SEQ ID NO: 28579 - DNA, 383 bp, Homo sapiens
  misc_feature 98: r=a or g
  misc_feature 308: h=a or c or t
  misc_feature 309: n=a, g, c or t
caaaattcaaactaaatttctcattaacttgaccagcttgatcttaaaaatcatttggaagagaaaaataaataaaatattttaaatgataaatgggraaagcacctgaatctatcagatatacaaatattattgtaaaatgtggaataggcaaataggttaggggaacaaagttcaaagacatgcccatttatgaaatttagcatgggataaggtggtattaaaagccttaatgttgaacacatacagaataacagtataaagtggtagagaaaatataccctttgggtagaggtggacttcctcahngtataaaatgtagaaacaaaaggaagactggtaagtttgactgtatcaaaatagaaaacttctgtgtgaagaaa

SEQ ID NO: 28580 - DNA, 346 bp, Homo sapiens
  misc_feature 239: n=a, g, c or t
  misc_feature 240: n=a, g, c or t
gatgggccccaccacgctctcaagagaacgcacctgcaataaaacagtcttgtcggccagctgcccaggggacggcagctacagcaccctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgccnntgcttatgactttcgcctctgggacaagtaagtcaatgtgggcagttcagtcgtctgggttttttccccttttctgttcatttcatctggctccccccaccaccaa

SEQ ID NO: 28581 - DNA, 297 bp, Homo sapiens
  misc_feature 138: h=a or c or t
  misc_feature 139: n=a, g, c or t
aaatcaacctattgaaactgactcagaattgacacagatgttagagttagcagacaagaacattaaaacaagtttttaaaaaattatttttattatttttttagagacaaggtcttgctctattgcccaggctggathntagtggcgtagtcatagctaactacatcctcaaactcctgggctcaagtgatcctcctgcctcctgagtagctgggaccacaggcatgcaccactacaccaagctgatttttcaattttttgtagagatggggtctcactatcttgcccagggctgta

SEQ ID NO: 28582 - DNA, 274 bp, Homo sapiens
  misc_feature 206: v=a or c or g
gaccggagggtgagcccggcagaggcagagacacacgcggagaggaggagaggctgagggagggaggtggagaaggacgggagaggcagagagaggagacacgcagagacactcaggaggggagagacaccgagacgcagagacactcaggaggggagagacaccgagacgcagagacactcgggaggtggagaaggacgggagavgcagagagaggagacacgcagagacactcaggaggggagagacaccgagacgcagagacactcacgga

SEQ ID NO: 28583 - DNA, 54 bp, Homo sapiens
tccaagaaaattctgtaaaggttttttttttaaaaaaaaaaaaaaaaaaaaaaa

SEQ ID NO: 28584 - DNA, 424 bp, Homo sapiens
cagttatttcagttataatgtgttttagaatgtggatttaagccaccttctcaccctttgcaccagtagctttgttaaaacattttattatgatcaaataacaagcctgttgcttttaagtaatctaagtattaacagaaggtaagtcttcaacttctccctgttctcacctgggccaagatcaattttctaaataaaaaatagctttgtaatttgtctccaacaaagaatgggaaatggaagggaacacaaaactgtggtcctgacaatactaattctacccgttttcaaataagaataattaaacttataaagtgatatactgattatttttgtgttactctcccttttttttgtttaaagtcaaattccagaagtaaaaatctttatcatactgttttcctcttactaaaactggaaggga

SEQ ID NO: 28585 - DNA, 357 bp, Homo sapiens
aatcttgctactgctcactgtttgggtccacgctgcttttatgagctgtaacactcaccatgaagatctgcagcttcattcctgagcccagcgagaccacgagcccacggggaggaacgaacaactccagacgcgctaccttaagagctgtaacactcaccgcaaaggtctgcagcttcactcctgagccagcgagaccacgaacccaccagaaggaagaaactccgaacacatctgaacatcagaagggacagactccagacacgccaccttaagagctgtaacactcactgcgagggtccacggcttcattcttgaagtcagtgagaccaagaacccaccaattccagacaccct

SEQ ID NO: 28586 - DNA, 460 bp, Homo sapiens
  misc_feature 403: h=a or c or t
  misc_feature 404: r=a or g
aaagtgtatgtttctaattggaaaattgattgagaagagagaatggacactaacttctaaccaagcagcacaattttataaaacaaagagctggtaaagtgaggataactaagcttttaacatggactttgaggtgcttgggaaagtaatgcataattagtgcatagtaaggccttccctgggtcatgtctaaaggccctctgctccactggctcttgacacatcattatgtaaatccctgacattttgtgagcttaactgaggtgtgcagctgttaaactaagactttggtgttttcagaatgttgagacaaatattaagttaatggctagacttctctcagttaaaatacttctttcggtatttttgttaaccctttggcttttgccactattttgttathrtttttgctagcatgcagcaaatcatagtatatatgaatttgagacatgatagctta

SEQ ID NO: 28587 - DNA, 341 bp, Homo sapiens
  misc_feature 307: r=a or g
taatcgaaaaattgggatctaagtaaactaaagagcttctgcacagcaaaagaaaccaccgtcagagtgaacaggcaacctatagaatgggagacaatttttacaatctacttatctgacaaagggctaatatccagaatctacaaagaactccaacaaatttacaagaaaagaacaaacaaccccatcaaaaagtgggcaaaggatatgaacagacacttctcaaaagaagatatttatgcagccaacagacacacaaaaaaatgctcatcatcactggccatcagagaaatgcaaatcaaaaccrcaatgagataccatctcacaccagttagaatggc

SEQ ID NO: 28588 - DNA, 164 bp, Homo sapiens
ctgatagttgcacagcataaaatggtgagggtggggccattgtgggttgagccaccaaggaaggccatccaggcctggatgggccagaacaaaggtacagatgagagaacgcacagggtatcgtgttcaaggtagtgagtaactgaggatagtcaaacggagct

SEQ ID NO: 28589 - DNA, 96 bp, Homo sapiens
  misc_feature 91: k=g or t
caggttgtaccccagacccaggcaatttgaatctctgagtgtggggcccagacatttgtatttcttttttttcttttctttttctttcttkctttt

SEQ ID NO: 28590 - DNA, 336 bp, Homo sapiens
tgtgtgttattttacttgttaactttcagttttagatgattcttgtgggcaaggggtgggcaatactgtgtagtgaaaatagttcccattccctcattcccaacaatgaataattttccaaagctgctgtaataagtataagggggccaggcgctgtggctcacacctgtaatcccagtactttggaaggctgaggcgggtggatcgcttgaggtcaggagttcattaccaacctgggcaaggacaacatggagaaaccccatgtctctacaaaaaatataaaaattagctgggtgtggtggtgcacacttgtaatcctagctactccggtagctg

SEQ ID NO: 28591 - DNA, 279 bp, Homo sapiens
  misc_feature 61: s=g or c
  misc_feature 62: r=a or g
caaatatccatgcgctgaaacccacataccatcacttggcaattttttagaataagacccsrttattatctattgctataaacctagccagttctcttgctcttctgtattttcctatttccctgccatcatctgctatttctgccacttctcttagactccttgtctgcaaagcccaagctagaactcactgtctatggcagaaggacatccagagcccattctggagttttgttttttccttctgccagatgctttgtgtcctgtcttccttcctct

SEQ ID NO: 28592 - DNA, 52 bp, Homo sapiens
  misc_feature 27: m=a or c
  misc_feature 30: d=a or g or t
tacagagctcttgatatcttgaatgtmttdtctgtttggcctggctcttaat

SEQ ID NO: 28593 - DNA, 313 bp, Homo sapiens
gaaaaataatactcttaggcccgactgggccactcagacctgtaatcccaacactttgagaggctaaggcaagaggtattacttgaggccaggagttcaagaccagcctgagcaacgtagtaagaccctgtctctaaaaaaatttttttaaaaattagctggacatggtagtgcctgtagtttcagctactcaggaggctgaggtaggggaagatcctttgagcccaggagttcaaggcagcagtgatttatgatcacaccaccgcactccagcctgggtgacagagtgagaccccatatctcaaaaaaaaaa

SEQ ID NO: 28594 - DNA, 328 bp, Homo sapiens
  misc_feature 68: r=a or g
  misc_feature 83: w=a or t
  misc_feature 86: m=a or c
  misc_feature 152: r=a or g
catcttttcaaggaccaacaactaattttgtgtgtatgtattgatacttaacataaattgctgctttrctgtgtggtctgggwagmattattcattgttttctagcaaaaagggacatttgtctcttttttcctgcatgtattatgtggttrggagaataatttctgtccccattctcccaagatgctcatacattaatcactggaatctgtgaatatattaccttacatggcaaaagggattttgcaggtggaattaaggtcatgagacttaaaatagggagattatcctggattatctgggtgggccattgtaatcacaagcatcc

SEQ ID NO: 28595 - DNA, 116 bp, Homo sapiens
ccatgttactatattactttggaaatttccagttttaaatataagtacttatgctatgcaagaaacgtaaagtaaatactcaaaagtagctatattgtcttgttaataaccttttt

SEQ ID NO: 28596 - DNA, 362 bp, Homo sapiens
  misc_feature 66: n=a, g, c or t
  misc_feature 331: m=a or c
tgataactaaatacaagcagggtagtgtgtataggaaacattaagctaagagttaaagaaattttngctgggcacagtggcttacacctgtaacaccagcactttgggagtccaaggcagacatatcacttgaggtgaggagttcgagaccagcttggccaacatggtgaaaccctgtctctattgaaaatacaaaaaatagctggacgtggtggcgcatgcctgtattctcagctgctacttgggaggctgaggtgggagaatttcttgaacctgggaggcggaggttgcagtgagctgagattgtgccactgcactccagcttgggtgmcagagcaagactccattaaaaaaaaaaaaaa

SEQ ID NO: 28597 - DNA, 397 bp, Homo sapiens
  misc_feature 90: s=g or c
ttgagatccatggggtgcccgcagactgtgcccggcaggagactgactacgtgctcaacaatggcttcaacccccgctggggggcagacsctgcagttccagctgcgttccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagc

SEQ ID NO: 28598 - DNA, 137 bp, Homo sapiens
  misc_feature 91: r=a or g
  misc_feature 95: r=a or g
  misc_feature 96: k=g or t
atgcttagttcttacctctgatgaatcttcaatttgcagcaaattctaaacacagttctctttcaaaaccaacttttgaccccttaattarccarkaatagtttgattactaaaagaactaagtttttttttttttt

SEQ ID NO: 28599 - DNA, 217 bp, Homo sapiens
  misc_feature 2: n=a, g, c or t
  misc_feature 16: n=a, g, c or t
  misc_feature 29: n=a, g, c or t
  misc_feature 30: b=c or g or t
  misc_feature 125: r=a or g
tncaagtcgctctgtncacctcccccttnbtggcccccaccccactcctgtgcctcccaggagccctccctgtgctccacctgcctccgcagaaggaagcctctttctctgtttccctgggtgarggggctggcaggtggctaaccccatttagcatctccaggccctgccatggtgtctcatcttgctgttatctctagctctttccctcctccca

SEQ ID NO: 28600 - DNA, 445 bp, Homo sapiens
  misc_feature 373: w=a or t
atgcgcaccccatgtccccgcccgctgtagcgccacagctctttgggcgttgattctagggtcagggccctcactcacactgctggaaggttaaagtacttcacgctagtttaaggaaatagctgacgctgataaccatgtcccaagcactgctctaagttcccaatgtgtccggaattggtgggttcttggtctcactgacttcaagaatgaagccacggaccctcgcgttttagactatgctaaaaacagcctcaggaccttcagcactgatcaacaatcctgggcatgggctgaccgacagttttcacccagagagtgaagatcatggaggagccatcttaaattccgcccagcgcaggctcccaggaawcctaatgtcacgatctcactgcagccaatgtgacaaacacagcagtaattaagtctagagagctaaacacac

SEQ ID NO: 28601 - DNA, 433 bp, Homo sapiens
  misc_feature 275: n=a, g, c or t
  misc_feature 309: r=a or g
  misc_feature 310: r=a or g
gtttattttgcaaatatatttgtaagttttccactgatatcttaaagttaggtatgattattaattcaagctggccttgtgcccctataaaatgacagtgtctgttcttgggaaactccacggctagatagactacaaacttgtaaacatactgttgtagagtcagaaagtagtatgtaaaagccaatttaaaatgtggtatcataaaggagtggtcactgcccttttctggagttttaattaaatcttcacacacaaagatgaggccaagcatngtggctcacgcctgtgatcccggcactttgggarrccggggtgggaggatcacttgagcccgggcattcgagaccggactggccggcatggtgagaccctatctctataaaataaaaaaaaattagccgggtgtggttatgagcacctgtagtccagc

SEQ ID NO: 28602 - DNA, 382 bp, Homo sapiens
  misc_feature 61: v=a or c or g
  misc_feature 63: r=a or g
  misc_feature 69: r=a or g
  misc_feature 171: w=a or t
  misc_feature 192: r=a or g
  misc_feature 239: r=a or g
  misc_feature 303: r=a or g
  misc_feature 322: m=a or c
  misc_feature 344: w=a or t
  misc_feature 347: s=g or c
tagttgaacacttaagattgctagtcactgtgctgagtgctctgtgaggaaggaagatgavtraaacaraaactccatcctcaaggagtttgctttccattggaaaaatggtgataataataacacacaaaaacatgaagatggccacagctaagttacagataatgcttwtgtagttcagcagagtgtaargatagttgaggtgtttggtgatatctgaatttgaatttggaaatgtratgaaggaaaagaaggtatgtaccagcaagggctgctttccactgcagataatcagaaaaattrgccagtagtagcttaaacmaaagattaagttattttttttwcasataattagaagtatagaggtgggtgactgttgaca

SEQ ID NO: 28603 - DNA, 347 bp, Homo sapiens
  misc_feature 9: n=a, g, c or t
  misc_feature 141: s=g or c
  misc_feature 159: n=a, g, c or t
  misc_feature 208: m=a or c
  misc_feature 307: m=a or c
  misc_feature 308: v=a or c or g
  misc_feature 343: s=g or c
agacctgangctccgcgggctcggggcaagagcccgcaggctaccttccccgggcaggggcgctcaacccaaccggctccagggcactgatctgcgatttccttctggttggctgtcctgcgtgggtgccaagttccacasatgatttaatgaataagnaggagatgtcagtgaaaaaagggatccagaatgattactaacctatgamtcccaacagtatgacagaaaatggccttacagcctgggacaaaccgaagcactgtccagaccgagaacacgactggaagctagtaggaatgtctgaagmvtgcctacataggaagagccattcagggaggcgcasaccg

SEQ ID NO: 28604 - DNA, 121 bp, Homo sapiens
  misc_feature 8: n=a, g, c or t
  misc_feature 9: n=a, g, c or t
aattagannctttggttattgctgtagtggtaacatttacacatttactatcttatgattcttcttatttttagaaactgtgtggtggtgatttttaaaaaggaaaatggcaaggacgcac

SEQ ID NO: 28605 - DNA, 234 bp, Homo sapiens
  misc_feature 118: n=a, g, c or t
ttctctttttcgagacagtgttactggaaaggggtcccaatctggaccctgaaaagagggttcttggatcttgggcaagaaagaatttggggtgagttcatagaataaagtgaaagcnagtttattaagaaagtatgggaataaaagaacggctactccatagagcagccctgaggactggtggctggctgtttttatggttatttcttgattatatactaaacaaggggtgta

SEQ ID NO: 28606 - DNA, 96 bp, Homo sapiens
  misc_feature 7: s=g or c
  misc_feature 8: n=a, g, c or t
  misc_feature 30: d=a or g or t
  misc_feature 58: r=a or g
ccctcasnaatggactttgatataattttdctgctatttgctaaaagctggtggtgaratacataacaataactgttatttagtgaatacctattt

SEQ ID NO: 28607 - DNA, 189 bp, Homo sapiens
tgtctttatatcttattactagtgatattagccttgatcacttagttgagaaggcatttgccaagtttcttcatggtaagattgtttttaacctttgaacttaaaagtagactaatttattactttgatggcccaatggtgattttcaatttcctctcatgccctgtacatgtattcattggaacacac

SEQ ID NO: 28608 - DNA, 98 bp, Homo sapiens
agcacttgaattgtctatgctgtagaaatgtcccttagctacagcaattctaaataatataagataaaataaaatcatgccttgcaaaatgccctgca

SEQ ID NO: 28609 - DNA, 152 bp, Homo sapiens
catctgtgaaatagatctactcatttatattttatagtcttcttccctgaaactgctaagggtaaccttcacaagagtccatacacttatatgagggaaccagtttgagcagaaacacagtaagaaaagaactcactacatacctgggctac

SEQ ID NO: 28610 - DNA, 80 bp, Homo sapiens
cgaacgccgggcagcacaaaggatccccgactgccggggagcggtgctcggagggcacaggtctacgccatcccccacgc

SEQ ID NO: 28611 - DNA, 149 bp, Homo sapiens
acgccacatttctttgaatatcttcaggaagtttttatctagaaatttgcataatggtttgcataaaaggttagccttttcacctgttttattttgtataaacactgatatagtgattaaaacattagctacataactatgagtcactg

SEQ ID NO: 28612 - DNA, 110 bp, Homo sapiens
gtttagcatataggtatactcagtcaagtagcctgcattgctgccctgcctatgtagtagccattcttttgtttatttacttctctagtaaacttgctttcactctaaaa

SEQ ID NO: 28613 - DNA, 114 bp, Homo sapiens
ctaacttttaactctttatgtttcaaatgttcctctttcccagcacacacaatccagttgtcaataaattttagtagtttttttctctgaaataataattttttgtccccgccc

SEQ ID NO: 28614 - DNA, 109 bp, Homo sapiens
ctcatcagcattcttcacagaaatagaaaaaaatcatacaatttctgtggatccacaaaagatcccaaataaccaaagcaattctgagaaaaaaaaatcctggaggcga

SEQ ID NO: 28615 - DNA, 215 bp, Homo sapiens
  misc_feature 55: k=g or t
taagagtaatattcttttgcattatgagaaaactagtatattattcatatatttkactaattgtactttttttattatactttaagttttagggtacatgtgcacaatgtgcaggttagttacatatgtatacatgtgccatgctggtgcgctgcacccactaactcgtcatctagcattaggtatatctcccaatgctatccgtcccccctccc

SEQ ID NO: 28616 - DNA, 188 bp, Homo sapiens
ttgtttttttttgagaacggagtttcactctttttgcccaggctggagtgcaatggcgcaatctcggctcactgcaacctccgcctcccgggttcaagtgattcccctgcctcagcctctggagtagctgggattacaggcatgtgccaccacacctggctaattttgtatttttagtagagacggtt

SEQ ID NO: 28617 - DNA, 175 bp, Homo sapiens
caaaataggtctttacaggcaaatttacattctatcacagaaacagtgactatcagataaccaactcccttctcaattcttttttttggcttgttttcttgcttacttgcttggttgctttctctctttcctagctgaatagcattacaggccacttctaaaataaactgggtgg

SEQ ID NO: 28618 - DNA, 117 bp, Homo sapiens
ttctgtgaaataggttctatttttaatcttaattttacagatgatgaaactggaatgtcaagaagttcaataactttccaaaggatcttactgttagtaaagttgtgaagccagtca

SEQ ID NO: 28619 - DNA, 191 bp, Homo sapiens
  misc_feature 110: d=a or g or t
tctaaattaggtgcaatgactgttctataaatggaaccactttataagaatatgagatccggcaaaatagacaatcaatatttttaaaatgagttaataatatgacaggdccagtgagagaagaaggacagacaatattgtaggaaccattgtgcctgactagagagaaatttcaaaataaagagtgggca

SEQ ID NO: 28620 - DNA, 364 bp, Homo sapiens
  misc_feature 303: n=a, g, c or t
  misc_feature 349: v=a or c or g
agcgactaaggtttagtgaggcggcaccgcgcggcccgaggcgggtcttgaagcactcgttttcccactcgttttccggggttcccccgcggtgggacagtgagcagttcagggcgccgcagccgaggccttcctccagaaaaagtttgccagttcctaatccaggacacatgtatttacatggttgttaaacttttctgaacagccagtgggatgtggtaaatatttaacagcagcttctctggaagagaatgtattcgttagtatgtatttatgtgtgtgtatatagtttattgtaaattntacttatttttctatcactttcttaagaccacaagacaattaatavaacaaattgaaccct

SEQ ID NO: 28621 - DNA, 174 bp, Homo sapiens
  misc_feature 82: n=a, g, c or t
  misc_feature 137: n=a, g, c or t
  misc_feature 138: n=a, g, c or t
taaatttcacatttcttttaaagaactcttaaagtgtaacagttacgccatacttcataagtggtaaagaaaggtataaaanttggaaacattttgttgggcatagtagtgattgggtgaaaaggataaattatatnnaaatgagaatgtgctgtaattggaagtaggggcatc

SEQ ID NO: 28622 - DNA, 134 bp, Homo sapiens
aattcacacagagacacattccatacacatgcacacacattccatacacacacacattccatacacacacacatattccatacaaacacattccatacacacgcacacagacatattccataatcacacgagac

SEQ ID NO: 28623 - DNA, 206 bp, Homo sapiens
  misc_feature 30: s=g or c
  misc_feature 55: s=g or c
caggaatgtttgtgcctttccatgtgagasagtatggaaacggaaggtgcaaaasagaagagaagaggcccagtgagagatctggagacattcttaaatttggaattggcaggaaggagaaaaagaaaaattggcagtgacagaggaaaagaaggggtcaaagaggaaggaagctgagccagagaatgcagcatccagggggatac

SEQ ID NO: 28624 - DNA, 202 bp, Homo sapiens
ggattttgaaaaaggataggctctaccaaaaagtggaaaaattgtaagaagggtgaaaggtaggttgaaaggctgagaggtgagagcaagacagatgtgtgggttaaggacagaagtgatgtcacaaaaaaatgccctttgtttatgtatagatgggattatttgtgtttgctgaggatgttttgatatcaggaggagtccc

SEQ ID NO: 28625 - DNA, 138 bp, Homo sapiens
ttgaatcttttttgggattactgaacatcctgtatctggatgtctgtatctcttgcaagacttaagaaatgtttgactgttattttgctaaataggttttctgtgcctcttcccttctctttcctgaaacaccgagtc

SEQ ID NO: 28626 - DNA, 210 bp, Homo sapiens
tacagtagatatgaaaagacattagctgtcgtatgaagatttcaatgtgaaatagccagcattttcttcctgtaaagtatttaaatatgtttttaagtatttctttgtttgacaggtgggtacatgtcattattttgtaatcaaaggtggaaatatatgagtcatgtcagagctaaagatgttttaattttttctgcttctcagggcggc

SEQ ID NO: 28627 - DNA, 102 bp, Homo sapiens
aagcgagttccggcgcccagaacggcttcatcctctcgtcccgtccgcggcaaatgcatgcgcctggaaaacccgccaccctccagggcaactcacacctct

SEQ ID NO: 28628 - DNA, 227 bp, Homo sapiens
cattgaaaaaatagaaaacttggaaggatgtgaagagctggcaaaacttgacctgactgtgaatttcattggagagctgagcagcattaaaaacttgcagcacaatatccatctgaaggagctctttctcatggggaacccatgtgcttcctttgaccactatagggagttcgtggtagcaactcttccacaattaaagttcctctttagagagcaaagaccacctc

SEQ ID NO: 28629 - DNA, 333 bp, Homo sapiens
  misc_feature 154: r=a or g
taccttaatcataggtgacgcagataatcaagtagtttatctgcacaagattacggattctgttttgctaaaagctggaagttgggctaaaaagattgctgtgaaaagagctcttaaatctgaagatcttagcataaatctaataagttctgartttgttgggcttgatattcagcagaaacttacagtcttttacttagaacccaagaggtttggaaatcaaatcactatgcaaagaaaatctgaaacacagatttcccattctaaacattcagacatatctacaatagcaggacctaataaaggaacgactgccagcaaaaaacctggtgt

SEQ ID NO: 28630 - DNA, 74 bp, Homo sapiens
  misc_feature 22: n=a, g, c or t
tgaataaaatgtcacgcctgtncttgttggtctgcataataactcttacagactgaatgtttgtgttcccctgt

SEQ ID NO: 28631 - DNA, 188 bp, Homo sapiens
  misc_feature 7: s=g or c
tgatgcscttcgtatcgcgatcagtcgtcacaggattcgttaacgccttggcgatcctgattttcatggcgcactgccagaactcaccggggtaacctggcccgtttacgcaatgactgctggcggactggcgattatttacctgttcccaaggctgccgggcgtaggaaaactgctcccctcgccgc

SEQ ID NO: 28632 - DNA, 119 bp, Homo sapiens
acttgtatgatgtgcgtcctccaagctcgcctctccctcgttacccgctccatccaccccctgcctgcctgcgccaaacaagagccactgcatgatgaattatttaaaacccgaagccg

SEQ ID NO: 28633 - DNA, 152 bp, Homo sapiens
  misc_feature 17: k=g or t
  misc_feature 35: m=a or c
  misc_feature 119: k=g or t
  misc_feature 132: k=g or t
  misc_feature 134: m=a or c
  misc_feature 143: w=a or t
ccatttttctattgggktattggttcgttcttcamaaattttagaaactctttatctgttaaagaaattatatttttctttctgtgaaacaagttggaaatttttttcccccagtgtgktacttgtcttggkamtttacctawtgtgtgcgg

SEQ ID NO: 28634 - DNA, 309 bp, Homo sapiens
cttttcattgtaatcactgctattcttatgaccatattctatagcttctttgctttcctggtactcacatttcaatgtgaaggacctattcaaatgaattaaccagaatgaatgagttgatatattagagcacagagtccaaagagaatctagctattattacttcttataataagtcttaaattcgggatacaggacattataatgagagattaaaattctatcaagtgtcttaaggatggacataactaagtagcataagaatgtaccatgttttgctaatgagaaactctgacttcattggtggat

SEQ ID NO: 28635 - DNA, 239 bp, Homo sapiens
ctaaagccagggtgtatcagtaaaaatgtaatcctaccccagtacacatgtaaagtagagaattgcatgcaaagtgccggttttcatatatggaaatacactcttttgcaggtgcacctttgcttctcacttaggaaataagccgaaaaattgacaaccgagcttctcttttgagaagatcaagatacttatttagcaactggagaacagtgtagtgtaatggtaaaagaccaaggctc

SEQ ID NO: 28636 - DNA, 108 bp, Homo sapiens
aggcgtttacaagcgagcacaagagcctccgccggctccgcactgcgcttccgcttcacccggagtacagcggtcctggcggcctccatagtggctgccgctgagcac

SEQ ID NO: 28637 - DNA, 219 bp, Homo sapiens
gtaattcgagcgtgggactgtgcaattctcggattgggaaagggaggagtggaaataaccccggcagtgccaggcttgctggtggtcaggaacagatgattccagccctgtgctgatcgcctgccttcctcctgccattcagaatgctgctgtctcgtgtacttactgttaaggatcctggaaaagggagtggttcctcctagctgcaaacaaggccac

SEQ ID NO: 28638 - DNA, 189 bp, Homo sapiens
aatttcatacttgtttctaagtgtatacatgcattctcattcagatagagatgtttgagtaccgtgaatcacataatttaaccctcttaatttttcagatgaagaaatgttgttcactgagaaaatttaagtggcaaacaaggctgcacatttaactagtggcagtccccaaactaaaactccaggcga

SEQ ID NO: 28639 - DNA, 143 bp, Homo sapiens
aggagaagccaggggagtggactgaaaggaaggcccaggtcaagtgctttccttggtacctctgaaaaatcagagagatgggctgcttgacctcatctgcttgtagtaaggatgggaaatggtcactttcaaaaagggctgtc

SEQ ID NO: 28640 - DNA, 204 bp, Homo sapiens
tagatagaagtgactataatgcacacatatgtaatatatatagacacacagagcccttcagttcaggtacaatttgcgctatgaatgctgcaaacatttttgtttaaatatttgtatttatactttctaagtcagcatttatttttgtggctgtttacccacaatgaaagagttctataaagatgtgctgaagttgcaaaaaaa

SEQ ID NO: 28641 - DNA, 205 bp, Homo sapiens
  misc_feature 75: k=g or t
  misc_feature 167: r=a or g
  misc_feature 183: r=a or g
tgagatgatcattcagttacttgtcaggatttctcctcttcagagagatttttttttatagcacagattcctttkccccttttatctccttatctggatatgataagtggttatgagggtctcactaactattttgtgtttaccttttatatgtgtaaaactttgcrgtagcattaaagtgtratttatttttctatcaagtgca

SEQ ID NO: 28642 - DNA, 150 bp, Homo sapiens
cctcccttccctcccttgctttcctttcaaagagccaagtcacgctgcactgcgctccgtggagcctttcccgatgggagaagagaagggaggcctgagatgtcctttgctgggatgtggagaaacaccatctatatgaaaagccccatc

SEQ ID NO: 28643 - DNA, 167 bp, Homo sapiens
ctcacgcctggaatcccagcactgtgggaggccgaggcgggcggatcacaaggtcaggagatggagaccatcctggctaacactgtgaaaccccgtctctactaaaaatacaaaaaattagccgggcatggtggcgggcgcctgtggtcccagctactcaggggggc

SEQ ID NO: 28644 - DNA, 122 bp, Homo sapiens
  misc_feature 73: k=g or t
  misc_feature 78: w=a or t
  misc_feature 79: w=a or t
gagtcagagaggaaatttaggagtctactgcttcttacacagattttgacccttttatttatttaaacttttktcttwwtttgttttaaggctgcattactagccgattcccccccccaagt

SEQ ID NO: 28645 - DNA, 147 bp, Homo sapiens
atatgtacaggtttgctacacaggtatactgcataatgttgggtttggctttctcttgaacccatcacataaatagtgaatataatacccagtaggcagtttttaaaccctcactgccctccctcccattctgaagtccccagcgta

SEQ ID NO: 28646 - DNA, 103 bp, Homo sapiens
acacttggctgatatgtttcttccatcccttccctggccctggcagaacctgaatggcgtgatggtggcagtggcggagctgctgagcatgaagatccccggc

SEQ ID NO: 28647 - DNA, 114 bp, Homo sapiens
tttataggtaatttctatcacaaaccagtgacatttcctgaaatcaagcctggtaacacctgatgtttatatgatattcagtaaggacttttaccttactgatttcatggagcc

SEQ ID NO: 28648 - DNA, 99 bp, Homo sapiens
aattcctagaaaatctagacagaaaatgaacaataatatagaagacttgaatggcactagtgaacttgatctgacatatatgtacaatataccaccact

SEQ ID NO: 28649 - DNA, 368 bp, Homo sapiens
  misc_feature 318: k=g or t
aaagaagatccaaataaatggatagatagactatgtttatatattgagatatttaatagtgttaagataatagagctcccttaattgagccatagactcagtgcaatcctaatcataatctaagcaggcttttttgaagatattggcaagttggctctcaaattacgttgaaaagtcaaggacccaaaacagccaaacaattttgaaaaagaacaagaaaggtctttcactgcctgattttagaataaagctaaggtaatcattacagtgtggaattgacgtaatggtagatgtataaattaatgggatgcaatagakttcagatgtagacctgtacacatggtcaaatgttttttgacacgggagct

SEQ ID NO: 28650 - DNA, 199 bp, Homo sapiens
  misc_feature 76: m=a or c
  misc_feature 77: r=a or g
ttttttattcacagagacagggaacacaggaggaggtgtagttcttagggggatggtggtgggacccgtgttggamrcgttgcatttgcagcgtctgtggagtgtgcaggatgcttgctgtatacttggctgcacaggggtgaagctcagggacaagtctgggctggagactcagcgtgtgtttggcaaccgaagccac

SEQ ID NO: 28651 - DNA, 150 bp, Homo sapiens
ttatagatcttgatattgaatccatcagtgattcaagagatacacctatttgcctaaaacaacctaaagatgtattggttatggaatcatgtgttggataggttcttaagacctgtttcctcaaatcttgacacagttttcaaaggtggc

SEQ ID NO: 28652 - DNA, 334 bp, Homo sapiens
  misc_feature 234: m=a or c
tctctctccagcctcagtgccattcttcctgggaccatgactccctgaaaccagttctagtcagccctctggcaataagcaaaggtcctttagaatcctggtagaaggttctcctcagtaatgtgaggaattttaaaattcctttttaggtaaatatccattaagacagaaaaggcaattataaaaatgccctcagggcttacagttattcctgggtgatttggaaattgtgcmaactggagactccctcaatgtagccatgctatgccatggagaaaccgggagggaggtttaagtcacatcctgaccagatgtcttcctgaatgtgtgtgag

SEQ ID NO: 28653 - DNA, 215 bp, Homo sapiens
ttttcctcatctttgaaaaaaataggatgtgtgtgtgaataatctctctatcatgagcttattttaactggcatagacgtatacatgagcctcttaaatgccttgttgaccatgcctttatgttctcagtttctggcccagaacctgggacattagggagggtttcaataaatgtcaatcacatcagattacactcagcttatctgtaggcgatt

SEQ ID NO: 28654 - DNA, 139 bp, Homo sapiens
caagtaagaacatcatcaaagttcactttgtattgtaccctgtaaaactgtgtgtttgtgtgctttcaaagatgttgggattttatttatctggggacagtgtgtatggtaagacatgaccttctattaataaaactac

SEQ ID NO: 28655 - DNA, 132 bp, Homo sapiens
  misc_feature 12: h=a or c or t
  misc_feature 13: n=a, g, c or t
  misc_feature 75: s=g or c
tggaagagacghnacctaattgttcagtttaagaatgacgaggcctcccgaagtgctgggattataggcgtgagsaccatgccaggccagtgctaatttttatctaaatgatagcatgcagcatgccctctt

SEQ ID NO: 28656 - DNA, 156 bp, Homo sapiens
aatgaggttaaatttaacctttaaaaaatgatttattgtggctgggcacagtggctcacacctgtaatcccagcactttgggaggccaaggcagacggatcacttgaggccaggagttgaagaccagcctgaccaacacggcaaaaccccatctcc

SEQ ID NO: 28657 - DNA, 98 bp, Homo sapiens
taattcatataaggtatattgggtatattgaagtatatattgtattacaaagacttgttcttgtattttaaaatgtcagtgcaaaaaatatatggtgg

SEQ ID NO: 28658 - DNA, 152 bp, Homo sapiens
ttatttgaaaggcatgtttgccatgtttgccactttccctctttcacattgaggcgtgcacttcaactaagaccatcttgtttgctttatttgaaagcaagagagcagagtccacagcctcattcagttcccattacacagcttcctggtcc

SEQ ID NO: 28659 - DNA, 200 bp, Homo sapiens
taaattgctggttcatgggtaattttatttctgttttttcagaacagtcggatggtttcccaccacagctgcatcacatcacgatcgcaccaacggtgcaggtgtttcagcctctccaaatcctgtcagtgttgttatattctgtttaacggatagtgaccatggaaacggcaatgagttagttccttatttctttgcca

SEQ ID NO: 28660 - DNA, 145 bp, Homo sapiens
tatgtgggtcttctctcttttgttgttcattggtctggcttaaaagtgtgttgattttgtttatcttttcaaaaaaccaacattttatttcattgatttctgtatttttttaaatttcaaattcctttactactgctctggtcga

SEQ ID NO: 28661 - DNA, 198 bp, Homo sapiens
gagagagaaatccacttacatcactagaactgcattgagtgtgagccttgcaggttaagagacagactacagtgtcttgctttctgcaggaagcagcaatgccgtttgtttcctaagaggaattttttatttagaaaaggaagctttctatccaggaaatggctttccttgtgcgttgctatgccaactgcccgcagc

SEQ ID NO: 28662 - DNA, 134 bp, Homo sapiens
aaaaacagaaagaaagaaaaagaaaactgcagataaccctatacattaatactggtatctcgaggtgactcttctgaccaagggtggttaagtgacacatagaacttttctaagagaagacagacaagttgaca

SEQ ID NO: 28663 - DNA, 262 bp, Homo sapiens
ccttagttcagttagatacatggccatgttctaatgccactagctaaactcttgagtttttctcaaatgccttctgtatgcatgctctttgacctcaagatgtaacattcatttagctatttgttcaataaactatatgccaggctttgggttaggttctgggcttataaaactgaagacatatgcctgcatttaaaaagctctacatagtcaactgggagccacaataaacacaaaatacatcattttagactgagggagt

SEQ ID NO: 28664 - DNA, 80 bp, Homo sapiens
ttttaagtgggccaactagttttgataccatggaatacttagccaaaagatatttatataatcagagtgaatgaggctac

SEQ ID NO: 28665 - DNA, 127 bp, Homo sapiens
ctaaaaatagctttgagattaaggaaaaataaataactcttgtacagttcagtattgtctattaaatctgtattggcagtatgtataatggcatttgctgtggttacaaaatacttcctctgggcta

SEQ ID NO: 28666 - DNA, 63 bp, Homo sapiens
  misc_feature 43: y=c or t
  misc_feature 45: m=a or c
cctcccttccctcccttgctttcctttcaaagagccaagtcaygmtgcactgcgctccgtgga

SEQ ID NO: 28667 - DNA, 140 bp, Homo sapiens
tcaggagcatattgtttaatttccatgtgttagtttctgaagttcctcttgttgatttctagttttattgcactgtggtcagagaagatacttgatatgatttcaattttttgaatttgttgaactttgttttgtggccc

SEQ ID NO: 28668 - DNA, 114 bp, Homo sapiens
cttcctgctgatatcacgcagctaaataatattccaccaactcaggaatcctactatgatcccaacctgccaccggtcactaaaagtctagtaacaaactgtaaaccagtaaca

SEQ ID NO: 28669 - DNA, 89 bp, Homo sapiens
gaggacactggccactaggagaacgcaagcagggtgctgcatgttctacattctgtgagaggttccgagagtaaatagaatctgatggc

SEQ ID NO: 28670 - DNA, 170 bp, Homo sapiens
agatgtacacaagttaaagccatattttatctggtgagccccttaactgtttctgaaggaatgaacggtcagccgggaaggtgtccggcttagaccttgacaacagacactacccatctgtcagccatgtgcagtggttagaactcttcttgaaagtccaaagagccaca

SEQ ID NO: 28671 - DNA, 144 bp, Homo sapiens
attcaggaaccgctttagcttcggccccggccggccgggcggggaagactggtgtggtctggccatggatgggctcgctacatcaacggacgacgcgagaccctgaaccccaaccgaggaactggctctgacatccagccccct

SEQ ID NO: 28672 - DNA, 289 bp, Homo sapiens
  misc_feature 255: h=a or c or t
tgttaaaagagataaaagtcaggttaatactatcttaaacactgagtcagaaaatcattactgtatagaagttgctttcctgatcaagtctgaacgtcagctagtgctagagaactattttctatgacttaactctaaccaagttttattttaagctgtttctttgatagaagggccatgaaaatagagtaatgatatagtaggagataagggattggtttggtctttttcaataaagatagaagttgctgaaghtttctgaattaataatgacttagattgtgaccta

SEQ ID NO: 28673 - DNA, 217 bp, Homo sapiens
actcatctcttgggcactgtactaggagtgcactggcgtgatcacggcatactgcagccttgacctcccaggctcaagtgatcctcccatttcagccttctgagtagctgggaccacaggtgtgctctgtcataccgggccagtttttttgtttgtttgtttgtttttgagatggaatctggctctgtcgcccaggctggagtgcagtggcgcgggg

SEQ ID NO: 28674 - DNA, 89 bp, Homo sapiens
caccttcttagaatcctcagtgcatctctctaggcatagactgtcaaccaattggaattactatgtgaaatgaaatgtatttgccaccc

SEQ ID NO: 28675 - DNA, 358 bp, Homo sapiens
tatttgaagacaattcaagtactgtatacttttctttggggaatattcattgctttatggaatttcttttaatttttgtactctgttgttaagttcaaatacaattgtacttttctctttcttcaaatagaggaaagaaagtcactcacaaagtggcaatgtgcaaaggactacaaaaaacatctattctccatctgagacctagctttatagagacaataagaaccactgggaggaaaccagtgagtgtcagtggtttactctagtgtaaaacatttggctctggaaaaaaccatgttttttataaaattgcacagcacaagacacagaagcactttttataaaattatgaatgaca

SEQ ID NO: 28676 - DNA, 459 bp, Homo sapiens
  misc_feature 332: h=a or c or t
  misc_feature 333: r=a or g
tcatccaaatttttaaattggtggttaccaaagagttcacaaaacaggtttgtatgtagcacctttcatgcaaggcatgcaaaaagcctattttaaaatcactgtgcatattatagagttgtagccacctcacaatgaagtactacagcctgtgctgtcttaatggtttatgtcaggaaatgaaaaagatactgtaccaaatctggaattacaatggggagtaataatgtatactaaatgacttttgtattttaagttactttttgtgagtggtgaatttttgtgtttttcttttcagctacacttagtcctgagatgtattttttctttahrtcttgaatgaatacaaaaggagcccattttataatataaaccttgatgtacatgttgagatatttggacaatgaaaatgccttaaaaggcaatgcatatggataaagttgcacttataacacccct

SEQ ID NO: 28677 - DNA, 226 bp, Homo sapiens
gagataggatttcaccatgttggccaggctggtcttaaactcctgacctcaggtgatccacctggcttagcctcccaaagtgctgggattacaggcgtgagccacagtgcctgctcatcctgtatttcttattcgttcttcctaagcctgctttgaggcggtggctgtggcagctgctttccctccattctcttcctcgttttgtgaggtgctggctcccatgtgc

SEQ ID NO: 28678 - DNA, 487 bp, Homo sapiens
  misc_feature 115: n=a, g, c or t
  misc_feature 116: n=a, g, c or t
  misc_feature 250: n=a, g, c or t
  misc_feature 287: v=a or c or g
  misc_feature 384: b=c or g or t
ggaagaagtgtgttgtggctggaatgtagagactgtgtgcttatgcaggacgttatagccatgctgtggagtttggaccttattcagagggctgtgtggaaccagttagttttannctgagttgtgaagttgctacatttacatttgaaaaatctccattctggctagttacgatgaggaagttttgaatttatagggtgagtagaaaggtggggttggccttcttggattggaacagcaataagaagtngtggaacatgtgggggagtaaaaaataattttctccvtactcttcctagttcttaggatggaccctgtattaaaaggcacattaacaagagagaaaagaacaagtttattaacatgtatacctcatatatccabgggaaataaccagggaatgagtagttctcaaagagatggcttagaaatccagattatatagcatcttcagtaaggagcaatgaatttttagagaagagacaaa

SEQ ID NO: 28679 - DNA, 157 bp, Homo sapiens
  misc_feature 112: w=a or t
  misc_feature 137: w=a or t
  misc_feature 138: v=a or c or g
attatactttgctttttggtaagtttaatgatagatgtgtttatgcttcatacaaagttgaatgattgattggcgtggtggacatataccatcatgctcatttttttttttwaaagctttttaaaatgccacctcawvgaggcgagggggaggcgta

SEQ ID NO: 28680 - DNA, 72 bp, Homo sapiens
ccattaataagcccattttactaggcccctatttctttctagaagctcagggttttcttagtgcctcccaga

SEQ ID NO: 28681 - DNA, 152 bp, Homo sapiens
acgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgca

SEQ ID NO: 28682 - DNA, 317 bp, Homo sapiens
  misc_feature 104: s=g or c
  misc_feature 108: y=c or t
agagagatattattattattattattttcttttttgagacagggtcttgctctgttgcccaggctgcagtgcactggcgcagtcttggctcactgcaatctccsgctycccgggttcgggcgattcttctgcttcagcaccaccaagtagctgggattacaggtgtgtgccaccacgcccggctaatttttgtatttttagtggagatggggtcttgccgtattggccagcctggttttgaactcctgacctcaggtgatctgcccacctctgcctcccaaagagctgggattatatgcatgacccaccacacccgc

SEQ ID NO: 28683 - DNA, 316 bp, Homo sapiens
  misc_feature 96: r=a or g
  misc_feature 101: y=c or t
  misc_feature 103: y=c or t
  misc_feature 110: k=g or t
  misc_feature 116: r=a or g
  misc_feature 126: r=a or g
agcatcaaaataaatgagtgaattggatcacaacccattgaataaaatagacccaaactgatatcaataaatgaataaatcaatgggacagatggraaacycytcctackgcacartacaaactartatatgtagaaggaatgatggaaacagataatcattatttggcaaccattattgtggtagttaatacatgcaggagtcttcaatggatgccaaggctcatgaaggaacaggatattggtgagcaacacaatatactcttgtagaacgctaattgaatacaaaaggagaaaaggtttgcttgtggtagagg

SEQ ID NO: 28684 - DNA, 388 bp, Homo sapiens
  misc_feature 307: n=a, g, c or t
ttctgtgttacagataaggaaactaaggcttagttaaatgacttgcttcagtgttccacaggtgtaacaggtggagtcaaatctcaaacatagggctgtcagattttgatggttagtgctcttaatgactgtgattactaaataatatctggtagtttttaacaatagaaaatgcaactttaaaaaatttttattgtggtaaaatacacataacatttaccatttttaagtatattgtttgaaccatttttaagcatatagttcagtggcattaagtatattcacattgttttgcaaccatgagcanctattcatctccagaacattatcatcatcctatactaaaacttagaaaatgtacttttaaacttcttcagttctcttttaa

SEQ ID NO: 28685 - DNA, 150 bp, Homo sapiens
attttacttactttcccgcttcattgtcatgtctgaaattgcagataatggtggcggggaaagctgttgtgagcattgggtggtggtgctggtggtgactctttacctgcttctctgattagaaagcaaacttccccaaaacaggcagac

SEQ ID NO: 28686 - DNA, 234 bp, Homo sapiens
  misc_feature 72: y=c or t
  misc_feature 80: y=c or t
  misc_feature 86: y=c or t
  misc_feature 114: y=c or t
  misc_feature 126: w=a or t
  misc_feature 162: w=a or t
  misc_feature 165: y=c or t
  misc_feature 172: w=a or t
cttggccgggtgcagtggctcacacctataatcccagcactttgggaggccgaggcgggtggatcacgaggycaggagtycaagaycagcttggccaacattgtgaaaccccgyctctactaaaawtacaaaaattagccaggcgtggtggcacgtgcctgwagycccagcwacttgggaggcggaggtaggataattgcccgaacccgggaggcagaggttgcaataagccaa

SEQ ID NO: 28687 - DNA, 224 bp, Homo sapiens
  misc_feature 192: r=a or g
  misc_feature 193: s=g or c
gtcgttattctgattttacaggtggggaagtgctagggcccagagaggtttagagacttgctggctctcacagccagtgagcagagctgggcgaggctggagggtcagctatgggccctcgagatgggtcagccgagagtgaccagactgctctctaggttgtgagggtaaggtgggcatggctgctgtgcrstagcccccggccagactttcgacggggtagg

SEQ ID NO: 28688 - DNA, 109 bp, Homo sapiens
tattttcaatttgttttctaacaaaaaacatagaaatagaacaactaggtcatgtactctgggcttagctctcacagttatgatcagtctcgtttcatttgtacccaac

SEQ ID NO: 28689 - DNA, 127 bp, Homo sapiens
cagatgctgaggcaggagaatcgctggaacccaggaggcggaggttgcggtgagccaagatgctctactgcactccagcctgggtgacagagacagactccatctcaaaaaaaaaaaaaaaaaaaaa

SEQ ID NO: 28690 - DNA, 436 bp, Homo sapiens
  misc_feature 97: h=a or c or t
  misc_feature 98: h=a or c or t
  misc_feature 99: w=a or t
  misc_feature 107: h=a or c or t
  misc_feature 108: n=a, g, c or t
  misc_feature 149: m=a or c
  misc_feature 253: w=a or t
  misc_feature 308: d=a or g or t
  misc_feature 309: n=a, g, c or t
  misc_feature 402: n=a, g, c or t
  misc_feature 404: n=a, g, c or t
  misc_feature 405: n=a, g, c or t
  misc_feature 406: h=a or c or t
  misc_feature 415: s=g or c
atatgcaaagcatgcatcagccacatccatgctatctcctaaagcagtcattctgaaacccaatctggggacagtgcagactaaataaaatttcathhwgatttgghntcccgctgcgaatgggactgctttgtctcagccgacagaamcagcaagccagaaagggaatgaagacatttggagaagaagcgtttactgaaaggagattcctgggctggaggaaaaccatgatctacagttcatgttgacagawattgtatttttggtcctagatctgacttttgaaatgacttatcacaaattcaaadntagcaatcatgagtgaagtacccacgatgtgctaagcatctacctctgcagatagaagaacacttactgttcctgagcatgggagggaatagnannhcctgggtcstggcctcacctcatcaggcac

SEQ ID NO: 28691 - DNA, 105 bp, Homo sapiens
tgaaagttcccaataaacaaaaaatgataaatatttgagaatcttgatatgctagttgtgctaattactatacattttatgtatcaaaacatcactgtatgcccc

SEQ ID NO: 28692 - DNA, 357 bp, Homo sapiens
  misc_feature 245: w=a or t
  misc_feature 265: b=c or g or t
  misc_feature 282: w=a or t
  misc_feature 291: w=a or t
  misc_feature 296: y=c or t
  misc_feature 313: n=a, g, c or t
  misc_feature 331: y=c or t
  misc_feature 335: w=a or t
  misc_feature 339: y=c or t
tttggtctgttcagagattctatcttttcctggtttaatctaggagggttgtatatttctaggaatttatccatctcctctaggttttctagtttatgtgcataaaagtgttcatagtagccttgaataatcctttgtgtttttgtgatatcagttgtaatatctcccattttatttctaattgagcttatttggatcttctctcttcttttcttggttaatctcactaatagtctatcaatttwattgatcttttcaaagaacbagatttttgtttcattwatctttcgwatttycttgtttcaatttcatntaattctgctctgatatycgtwattycttttcttctgctgggcg

SEQ ID NO: 28693 - DNA, 194 bp, Homo sapiens
actttcttcagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcatc

SEQ ID NO: 28694 - DNA, 153 bp, Homo sapiens
tcacaactcctgaagacgaaatactatgagtccctgctttggacacatctgtagtagagtaggaaaagataaatataacccaagtaattgttacagaattttctgaaatatactaatggtaaaaggttttgtagggcttgtactggggaaaac

SEQ ID NO: 28695 - DNA, 135 bp, Homo sapiens
tctgcctgcctcggtctcccaagatgctgggattacaggcgtgagccaccgtgtctggccctccataacacttttataaaggatgaaaaacattctaggcatgtgtatacaagaccgttcttgccaaggggtcct

SEQ ID NO: 28696 - DNA, 439 bp, Homo sapiens
  misc_feature 278: y=c or t
  misc_feature 279: s=g or c
  misc_feature 320: n=a, g, c or t
  misc_feature 321: s=g or c
  misc_feature 370: r=a or g
ttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaysttccatcagcatcgtcccaaatcccagctctcgaagagacnstgaggctgtggaagcccgagaaatcatgtggtttaagactcgtcaaggrcagatagcaaagcagccatgccctgcaggaactataggtgtatcaacttatctatgccttgctcctgat

SEQ ID NO: 28697 - DNA, 243 bp, Homo sapiens
gtgtaaattagttcaaccattgtggaagatagtgtggcgattcctcaaggatctagaaccagaaataccatttgacccagcaatcccatcattgggtatatacccaaaggattataaatcattctaatataaaaacacgtgtacgcatatgtttattgcagcactattcacaatggcaaagacttggaaccaacccgggtgctcatcaatgatgggctggataaagaaaatgaggcacatgac

SEQ ID NO: 28698 - DNA, 72 bp, Homo sapiens
agaaccttcctggcgtcgcgtttgcacctcgctgctccagcctctggggcgcattccaaccttccagcctgc

SEQ ID NO: 28699 - DNA, 160 bp, Homo sapiens
  misc_feature 145: k=g or t
aatgtttagaaggtctggagctcaaaaatgcgttcttccacattgataatttagtaaactgagaacattgacatcactacagggcagcataagaggttgcttacatgtggtagcagctctggtttgattcaagttgctaccatgkacattgacagcacat

SEQ ID NO: 28700 - DNA, 243 bp, Homo sapiens
gaattgccagtcttttgtcctgcatcatcttgaacattaatccacatgtttcagagctcaccaggcagtaccaatgctcttttcacagctatgaagagctagagaaattcttgttatggtagaaaaatttcacggttcatttttgaaactgcatttgtgcgtatgcagtgtagattttatagtgtgttgtgctttcaagatctaaatcatatataataaattaagggacaatggggctgacta

SEQ ID NO: 28701 - DNA, 171 bp, Homo sapiens
atttccatcacagcaatgaaaaattaaagaacacttgggaaacaggaggcggcttgtgactgaccggatccaaaatttgaaattcctgccagagcaacaaataggtttctgcaaaattcaccccaaggccaaagctccaccgcccaggtagccctcacacaacctcccctt

SEQ ID NO: 28702 - DNA, 408 bp, Homo sapiens
  misc_feature 122: n=a, g, c or t
tagttaggaaggcagtaggatgtggcctgcatgtactgtatattacagatatttgtcatgctgggatttccaactcgaatctgtgtgaaactttcattccttcagattttggcttgacaaangcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatgggga

SEQ ID NO: 28703 - DNA, 348 bp, Homo sapiens
ttttgtactttttgtagcgacatggtctcactacattgcccaggctggcctccaactcttaggctcaagtgatcctcctgcctcagcctcccaaagtgttgggattacaggcatgagccattgcacccagtcatctcaggcagtttttaaaaaatttttatatatagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaa

SEQ ID NO: 28704 - DNA, 160 bp, Homo sapiens
taattgtaattgcatgacaaaccttatggaaaaggggtgacctagtagagtgtaatggggaagggaggattcttttctggttttcctttgtgcggtgaaactttgtgttgctgttgctttggctgtctgtgctgtagtggagtatttgtcagtctggggg

SEQ ID NO: 28705 - DNA, 231 bp, Homo sapiens
caacttctttgtgatttttctagaatgattgcaggacaattacagtgtttatacttgaattacaagaataatataaaagccttgtaaatgtgatgttgtgtggttgatttgggaatttacttgaaatgcatttctcattttattttctgacaactggaaatttttcctttttaaacaagtttttagtggcttctattttaattcatcaaccttcttcactctcgggaacgc

SEQ ID NO: 28706 - DNA, 140 bp, Homo sapiens
  misc_feature 54: s=g or c
  misc_feature 130: k=g or t
tcgcggccctgtccagccgtcctcgcttgcacgttgacctctgccggccggagsggcactgcagtcgctccgacccgcggggcaagcaagaccgaggttgcctttttggaatgggatgagtttctgtgtkatgtcccgcc

SEQ ID NO: 28707 - DNA, 419 bp, Homo sapiens
  misc_feature 330: k=g or t
  misc_feature 331: r=a or g
tatctttgccagaatttaggattaaataagtagaatctgcagtccagctcagccccccaatgattgttgtttccgtggaaacagttgaaggctctcaattaaaactgcctctgaaggctggagagagtaagtattaaaatgagtttgtctgagaagccaatttttatcctccaaattaaacccagagagtgcagatgatctaggaatctcctgacagttgggatcatacttctttgtctttgggggagggattattttgctatttcgggcataggtatgtttgctagcttgttgcttgctttgctgagttgctcagatcatcgtctttgkrcccactgagctctttatgtacaaccatggatcatgggcaagggtttgggagcaatctgatctttgttcagacttgtgagccgcaacta

SEQ ID NO: 28708 - DNA, 176 bp, Homo sapiens
catgtaactttgtctttcaattcgtttttgtttttttttcctgtaaggagaattagacatagaaaaattataaatttaagccttaaaataatgtctgggccagagtttgttgttacttttgctgtagattgtttacttaaagaattaggtgaatttttttttcctggtaggttacc

SEQ ID NO: 28709 - DNA, 334 bp, Homo sapiens
  misc_feature 328: n=a, g, c or t
gtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcctgattgcacagtattcactattgaaggaacatgaagtggaaaaatgttcacacttaaaggaaatcgtttgccggcagctgatgtgaagaatataattttttttgtcagancagact

SEQ ID NO: 28710 - DNA, 110 bp, Homo sapiens
  misc_feature 99: r=a or g
agagggggcgcagagcagggcagatggcaccaagagtgggtccctcaggcctcgagcgcacgcattccagcggccacccagaccatgctccgccgactrggcgcccaagc

SEQ ID NO: 28711 - DNA, 71 bp, Homo sapiens
atgggtttgattccagagcaggttgcacattggtcctgggtggctcgcaggctcaggtcgtgcttgggcgc

SEQ ID NO: 28712 - DNA, 238 bp, Homo sapiens
  misc_feature 41: k=g or t
  misc_feature 45: s=g or c
  misc_feature 46: h=a or c or t
  misc_feature 99: m=a or c
  misc_feature 102: m=a or c
  misc_feature 113: y=c or t
  misc_feature 128: m=a or c
  misc_feature 219: k=g or t
  misc_feature 236: r=a or g
agaaacgtgttcgctgcccagaagaagggaaggcgcgagtkagcshaaggaggtactgtagcaacaagctcatcagtagagaattgacctcttacaacmagmatcaagttttytatgacatcttcagmacagtcaacatcaagtaatcctccaataactacaggaagtcgacttggattcacctgtggttaaaaagaagtagaagaatgttattatgtkattaaaagcaaagaggrta

SEQ ID NO: 28713 - DNA, 297 bp, Homo sapiens
ttgaagcagagatctggagctcagcagaaagaaaaagatcaacgctaacagcttgatttggggaccctggaaatgagcaggaatccaaggcatcagaaagccaggacagccccacagcacagggctgcagagagggcagcaggagctcgggcagcgcaggggcttgtcaaaaggtcataggctgtttttacacctgatgcaaggacagaaacacacacaaggtctggaggattcctgtgagacagccatacatccctatcacttcaaaataagtgaggacattcttgtttgagaggt

SEQ ID NO: 28714 - DNA, 107 bp, Homo sapiens
ccattcaagccaacaatttcagaaaatgcctggaaggtaacagccttcccccgtgggtagctcacagccaatgactgattgatacgggtgtacagaactgaggctcc

SEQ ID NO: 28715 - DNA, 185 bp, Homo sapiens
cgagaatttttgcctatcgccttgtaggacgacatagggaataaactgtattaggtacccagttcctccttcgtgttacttaagagtctggtgaggtatttaggttggacgtattctgttctaatgaagataaatttgacatcctgatggctgatcccatgtgctttagaatttgaatcccagct

SEQ ID NO: 28716 - DNA, 222 bp, Homo sapiens
gaggcctccacctcggcaggactgcttcgagctgacctggactgtgtttagaacagtgtttggtgcacttgtatcctagctggtcttgatgtcaggatccttacccctcaagcaatcaaaaaagttatccagcttctttcacaaatgagaacttcagaccttcagccttaattaataactcattaacgtgaaatgaattccagtgagtgaaaacagttgcct

SEQ ID NO: 28717 - DNA, 219 bp, Homo sapiens
ttttaatattatttccattttgaaattctcgacacttgaatgaaggcagtagaggcctctttttggatttctcttctaataacaaaactttatttagggaaaggtttccctgtgctatcgtaagtttgttttgagcactgcattcactttaaaattctggaggaacaaaggctgggcacataatcacaaagcccaggccacacaataattcggggttgt

SEQ ID NO: 28718 - DNA, 417 bp, Homo sapiens
  misc_feature 348: v=a or c or g
  misc_feature 401: w=a or t
catccattcatcccccctctccaatcctatcaccactgccctagttcaggagcttctcatatctcccagcagtctttcatttgcattcctagtctcaagaattattccttccaatcatctatcagcttaccagcacagttacctttccattaaaataaagatcaaataaataaataaaaactaaacagaggtttcacttaaaaacaaaagtgtctctcatgacaaaggcaatatatatatatacacatagttaaaagcctagaaaacaacatatgagtgtgaagaataaaacaaaattcatctataatctcacaacccagaaacacttaaaaagtagtacatgccagvttcagtggctcgtgcctataatcccaccatttcatgaggctgaggtagaagawcacttgagtcaagagt

SEQ ID NO: 28719 - DNA, 248 bp, Homo sapiens
gcatcaaaataaatggcttattttccattttagcattaatcacattataattgtatttatttgttgacttgatcattgtctgtctccccaactagtccctaaaattgcatgagagcagggaccatctttgttttattgtgtccgcaacacttagcacagtgcctggcacataatcatacttaactacttactaaatgagtaaatgaaccaatgaataaccatatacgactttttgttaacgctgacat

SEQ ID NO: 28720 - DNA, 272 bp, Homo sapiens
tattgacatcgctgaaagagattgggagaacagaaacaacttggaaaacatatttcaggatatcatccataagaactttgccaacatagctagagagacgaatattcaaattcaagaaatgtagagaacccctgcaaaatacttcacaagaagatcatctccaagacacacaatcatcagattctccaaggtcggcatgaaagaaaaaatgttaaaagcagctagagagaaagtacaggcctacaaagagaagcacatcagactaacagcag

SEQ ID NO: 28721 - DNA, 297 bp, Homo sapiens
tattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagccg

SEQ ID NO: 28722 - DNA, 327 bp, Homo sapiens
ttgagacagagtttcactcttgtcacccaggctggagtgcagtggcacgatcttggctcactgcaacctctgcctaccgggttcaagcgattctcctgccttagcctcccgagtagctgggactacaggcgtgcgccatcatgcccagctaatttttgtatttttagtagagatgaggtttcaccatgttggccaggctggtctcaaactcctgagctcaggtgatccacctgcctcagcctcccaaagtgttgggattacaggcatgagccaccacacccggcctaagctatgtgattgatttgttaagaaaggggagaaaaaaag

SEQ ID NO: 28723 - DNA, 291 bp, Homo sapiens
  misc_feature 290: r=a or g
  misc_feature 291: r=a or g
tcattcctcatatgtgaccatcagctttcgctgcagaggtcaaagcacttcgggcattcatgccatcatatacacttgtaccagaggacctaggatatgccaaaatcccacttacaaaatgtcactgggagcaactacattgtcgaaataagctgttaaggcagcaatcacaatttaccagaagtagacacatcccagctttatggcttcttgggtggggccaatgaatcagttagagatgccttgtctagtgtggtggccgctaactgcatgtgactatcgagcccgarr

SEQ ID NO: 28724 - DNA, 153 bp, Homo sapiens
aacatgaaacagtgcagagatgaaggagttgagtagccagaggcagttggttaaattagcaaagacaggggatgtggtgatctgtactccgtgttttttgtgtatatctttttaaacactttgtctttctcctttcattaacccagacgtggt

SEQ ID NO: 28725 - DNA, 234 bp, Homo sapiens
agaatgatgtggaccagtctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactg

SEQ ID NO: 28726 - DNA, 357 bp, Homo sapiens
  misc_feature 288: n=a, g, c or t
cccactttctagtgaacagctaaaattcctgagagtctctactgttaaggtacctttaataggataaagcagggaccacctatctcagtgggtccatttttcttttaaaattagttatctgaaaaaacttagcagtagttcccatctttaaggtaagtctttcatttggtccccattgtgtaaaatactaatcaacattttcaagcttctgtacaacagactgcttttgtctagatttctcaactccacttataaagcttatcagttttcagagaggaatgtgaattnttttctaatgcaaataaatggatatggcaggaactacagcataagtgattattgtgattctgggcggac

SEQ ID NO: 28727 - DNA, 175 bp, Homo sapiens
cttcttttgccttctttcacttgtaataattatattgcgattaatccatgttattgcatgtagcagtggacaattactttttatttcagagtagtagtccattgtatgaatataccacattttccttattcatttatcagttatttgacatctagggggtttccagtttggggcc

SEQ ID NO: 28728 - DNA, 215 bp, Homo sapiens
ttcaggaccttagcaattagcagtgagttatgaagagctttttaaaaaatctttaaaattgtttcaaattttatccaattaatgtgagcctaattttcaaacctagaatcaaaagtagctgcctttaccacaatcctccctctaattttatcaccattcggaatatttcaaatcattccccttgcatttacctatacatttcaaatgagagccca

SEQ ID NO: 28729 - DNA, 242 bp, Homo sapiens
acagggctgggtggtaaaggtggctgggcgggggtgagggcgagcctctcttgcttcatcatttgactagggagcagggctctgtgtgcaaagacaccaggaaagggacctgagggtgctcactggttgcaggtgacttcacagggacaggggaagggaaaggagtagagagtctttaatttgtactctggctggtgtatctctccgtgtgtcctagcttgggaaaaaagaaatgagccctt

SEQ ID NO: 28730 - DNA, 337 bp, Homo sapiens
  misc_feature 98: h=a or c or t
  misc_feature 138: d=a or g or t
  misc_feature 275: s=g or c
  misc_feature 276: n=a, g, c or t
  misc_feature 283: s=g or c
  misc_feature 284: n=a, g, c or t
  misc_feature 326: r=a or g
gaaaagataaaatttcaaggggccgttgactgtcacatcaaagcagtaatttggggtttgagaggtggcaatactctacagcaggtgtagagtattahtaatctaacaaatatttcaggtgcctcatgttttcacctdatttgcttgtttaaatcactttatataaatttcatggaaagacttgctttgccagtgtatccgaaacctctgttatttctccatagtattttctatagaagatctaggatactttacattattctgaaccatttacsncctactsnaccccacccatattatgtacctaattggtaatttcaaagtaragagactttta

SEQ ID NO: 28731 - DNA, 264 bp, Homo sapiens
  misc_feature 142: s=g or c
  misc_feature 201: n=a, g, c or t
ttttttccctttcctctcttccaagatggccgaaacgggctccccgtcttaacgatttggcgtctccctcgaccaccacctctttgtgcagcagcccccgggcagaccctgttccgagggcaacgctccccagtccccccasccccgaccccggaatcatgcatcggactacacggatcaaaatcacagagctgaaccccnacctcatgtgtgccctctgcggggggtacttcatcgacgccaccactatctggagtgcctgcc

SEQ ID NO: 28732 - DNA, 149 bp, Homo sapiens
  misc_feature 120: r=a or g
tggaaggaaaggctcagtggggcagcaacatgcaggtgacactgatcccaactcatgactcagaagtgatgagggaatggtaccaggagacccatgagaaacagcaagatctcaacatcrtggttttagcaagcagcagcacagtggtc

SEQ ID NO: 28733 - DNA, 177 bp, Homo sapiens
  misc_feature 29: y=c or t
tatcaatttgaaattaatatggaaaggcyagagagagtgtattaagtgattaaaagatggaaactggccgggcgcgggggctcacacctgtaatcccagcaccttgggaggctgaggcgggtggatcgcttgaggtcaggagttcaggaccggcctggccaacatggtgaaaccctc

SEQ ID NO: 28734 - DNA, 191 bp, Homo sapiens
ttatcttgtaataagaatgacatgtaggcaccagactgagtttgttaaatgtgatacttaatgtttgattgtatctgtaagagactatcttccaaactctccctcattttctttctttaacactatttagcaatatttcttcagctctattccataaggcagtgggcacccagatgtttccatatgcatgg

SEQ ID NO: 28735 - DNA, 237 bp, Homo sapiens
acatatatttatatacacatatagctgttgcaatgtaaaaattgtttacgttacttaccatcgagtaagactggtgctctaggaaagttctctctgtatagacagagaccttaagactttaagatactaaggcttctgggtataataataccacattgtccagttcaagtcacttcaagacttctggtataataatacacattttcctttaagactttaagatttctggaacaaagt

SEQ ID NO: 28736 - DNA, 75 bp, Homo sapiens
  misc_feature 27: n=a, g, c or t
agggtggcagagatgggtagaggcaangtaattctttcttggaggcaagagtggaggaaaggtagaacaggacgg

SEQ ID NO: 28737 - DNA, 229 bp, Homo sapiens
tactgtatggataaatacataacatacatagatgtattttctccttagaaacgtttccttttctctagcttactttattgtaagaatacagtatataatacatatagcatacaaaatacatgttattaactgttgctggtcaacagcaggctatcagtagttaagtttgggggaatcagaattatacctggattttctactgtgtacggtcagtgtgccaagccccatt

SEQ ID NO: 28738 - DNA, 114 bp, Homo sapiens
tctcgaactcctgagttcaggcaatgcccgccttggcctccaaaagtgctaggattacaagtgtgagccaccgtgcccagcctttatcgtacttagcactttctaacagcctga

SEQ ID NO: 28739 - DNA, 274 bp, Homo sapiens
agcaggcttcctactttgacgcctcacgcgctcttcagctctctttttctgtgggtctcgcggctctccccctctacaattacgagtagtgccttgagccgggcgttcggagacccacacaggagggacaggatggggagagcggcattaaagggtggtgactcaggagttcaagaccagcctggccaacatgacgaaaccccgtctctaccaaaaatacaaaaattagccaggcatgatggcggacgcctgtaatcccacttactcgggtgac

SEQ ID NO: 28740 - DNA, 220 bp, Homo sapiens
tcaacctcatttccagtcgattcctcacccagatgttgccttgtagctatacagcctggttgatctcatatgcgtacgacttacttatttctaccctgctggctttgcatttaccattctttctacctagaatttaacttttttctcccctttcctaacatcttgttcttcgtttcagagacagaagagtgtacaaggggcaattctttttttttttttt

SEQ ID NO: 28741 - DNA, 284 bp, Homo sapiens
  misc_feature 17: k=g or t
  misc_feature 25: k=g or t
  misc_feature 28: k=g or t
  misc_feature 31: w=a or t
  misc_feature 34: w=a or t
  misc_feature 40: k=g or t
  misc_feature 88: k=g or t
  misc_feature 94: r=a or g
  misc_feature 117: r=a or g
  misc_feature 124: r=a or g
  misc_feature 125: w=a or t
  misc_feature 157: k=g or t
  misc_feature 214: w=a or t
  misc_feature 215: w=a or t
  misc_feature 227: k=g or t
  misc_feature 256: r=a or g
tcctacatgttcccttktttttatkttkatwttwtaagtkatggatacataatagtcatacatatttatggcttacatgtgatacttkgatgcragcatacaatgtgtaataatcaratctggrwaactgggattcccaggagctcaaacatttatkatgtctttgtattgggaacattccacatcttctcttctagctattttgaaatatagwwtaaattattgtkaactatagtcactctattttgccatcaarcactagaatttactccttctgactgtat

SEQ ID NO: 28742 - DNA, 185 bp, Homo sapiens
aaacccaagatgtagaagtttcagaagaaacagtagaaccaagtgatgaattgatagaatatgattcgccagaacagttgaatgagcaattggtgactctttcacttcttcctgaatcacgatggaaaaaccttcttaaccttgatgttattaagaaaaagaataaaccaaaggaaccacctcga

SEQ ID NO: 28743 - DNA, 158 bp, Homo sapiens
  misc_feature 2: r=a or g
  misc_feature 13: r=a or g
arctctgcaggargggcgcggcgccacgccacctggaagtgaaagagaaatgtccatcgcttttatcagattattttattttcagaagttgtcatctcgggtactaggcttagtacctgggtgacgaaaccatctgtacaacaaactcccgtggcgac

SEQ ID NO: 28744 - DNA, 248 bp, Homo sapiens
caaactgaatggaatgttgaaagaataatacaataaatgttcatatttcctggattcaataattgttagcagtatgccaaatatgtgttatctatctacctattgaattatcagtcttttgatgtatctttccctaagtagatagccagattatcttcacagaacaatttgaaagtaagttgcagacatagtaattttaatactcatcttctataaaactataatggtgttaccacacaagagacaaa

SEQ ID NO: 28745 - DNA, 146 bp, Homo sapiens
ccacaagcgtttgtattttttgaattgcaaacactgtgttttctggtctttgggggttagttgaactttctgtattaccttttggaaaacctgagttttaccacagtcttaagcagatttgaaataaattcttttgacactgccct

SEQ ID NO: 28746 - DNA, 193 bp, Homo sapiens
tgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgtgt

SEQ ID NO: 28747 - DNA, 79 bp, Homo sapiens
ctgggcacggatcagaccacctcctaccaccatctccatcacctcagacccgggcacggatctgaccacctccaacacc

SEQ ID NO: 28748 - DNA, 80 bp, Homo sapiens
ctaagaaattgggcggttactctaagcagaaggggaacatgatgtgagattgtgtaagggatactttcaggtgggaccga

SEQ ID NO: 28749 - DNA, 187 bp, Homo sapiens
cacagattcaggagtcaaagtgaaaacaaaggatttagtgttctttcccctacttactacccatttgttgtttgggatgtagagtcaggactggagaagagggtgggaaattctatatcctctgccaatacagaggcatggaggcactttctataactttgtgtcatgaaacaagacttaaccccaa

SEQ ID NO: 28750 - DNA, 336 bp, Homo sapiens
  misc_feature 159: s=g or c
  misc_feature 311: d=a or g or t
tgtaagcactagggacagagtaataaactgaggcccttacattttaggtgtgcatatcaagggtcctcaagatggcctttcacattcagacactcactagaagaactcaggggacttggtgtatagttaatatgcttggctaaggtaataaagacacasagctagattataaagggaaaagacacacacagagaatagaggaatccatgtgcaggtgtcactatgctctgtcccttccatgagtggtcacacagcacattgtttcccccagcaaggacagtgcagcaacgtgtgcagtgcttctgcccagdgaagcccattaaagatccagcgccc

SEQ ID NO: 28751 - DNA, 87 bp, Homo sapiens
gttggacatttgggttggttccaagtctttgttgttgtgaattgtgccccagtaaacatacgtgtgcatgtgtctttatagtagcgt

SEQ ID NO: 28752 - DNA, 367 bp, Homo sapiens
  misc_feature 97: w=a or t
cagaaaagtcaagtcccagtatttgcaatatcaaataactctaaaaccgatgtgtgattctaccttccttactatttttactgggcaaatgccctawtttttttaattattattatttttaacttttgggacacacaaaaatcagcaattctcatgaagcgtttgttagtgtggcagacttgtctaattcctgaaactcattcatccccttgagccagccaatggggaggaataggataatgcaaacacatgttttgttttctcattttcaaataatttaccatgttaaaataaacttttctttgttttttatttgtagagtcagctaagtacccatatttaaatgccgtctttattatttttttga

SEQ ID NO: 28753 - DNA, 143 bp, Homo sapiens
actcactcggccaaggaaactcccagggcccgcccaggacccccaagccgccgcggacgcagcccaggatggcggcccaggtgactctggaggacgcgctgtccaacgtggacctcctggaggagctgcccctgcccgcccat

SEQ ID NO: 28754 - DNA, 301 bp, Homo sapiens
  misc_feature 96: s=g or c
  misc_feature 295: r=a or g
  misc_feature 296: r=a or g
gagttacagatgttcaaattaatttgcttggaatttatttatttatttatttatttttcgagacggagtctcgctctgtcgcccaggctggagtgsagtggtgtgatctcggctcactgcaaaccgcctcccgggttcacgccattctcctgcctcagcctcctgagtagctgggactacaggcgcccgccaccacgcccggctaattttttatttggatttttagtagagacggggtttccccgtgttagccaggatggtctcgatctcctgacctcgtgatccccctgcctcrrcctga

SEQ ID NO: 28755 - DNA, 232 bp, Homo sapiens
ctttgcgattctgataagtgaaaatggaatcccagtatagtttttagtgtacattttacctgttttaagtaagactgagcatatctccacatgtttgaagagtcatttctatttccgtttctgtgaacatcctttgcccatttttttcctgttggttactgatctttttcttaatgatttgctgagatatatacatagggataattgctcttttttggtcctatgaggcgct

SEQ ID NO: 28756 - DNA, 434 bp, Homo sapiens
  misc_feature 366: v=a or c or g
  misc_feature 385: n=a, g, c or t
  misc_feature 394: k=g or t
  misc_feature 395: d=a or g or t
  misc_feature 397: n=a, g, c or t
tttcttctatgtcttgtttatttcacttagcataatgtcctctaggttcactcatgctgtcacaacttggcaggattttcttcttttttaaggcttgaaaatattccattttgtgtgtatatgtgtatgtatgtatacatacacacacacatacacaagcacacatacactataatttcttaatccattcaactattgatcgatacttaaattgattccaaatcttggctattgtgaataatgctgcaatgaacatgggagtacagatatctcttcaacatactgagttcaaatcttttgggtaaatacccagatgtgggattgctggatcatatgataattctatttttaattttttgagtgacvtccatgctatcattcgtantggctatakdantttacattcctactaatagtgtacaagaattcctttt

SEQ ID NO: 28757 - DNA, 228 bp, Homo sapiens
tctcttagggcctggtgggaaggggatggtttctcttctctttgggtctctgtctttctgagctccactcctaccccgagggtttgtctcttacacttgcactctctcagagtcaatctcttgcttgttctcttatttggcatctccttcctttctctttttctatctagagctcactcttctgggatagtctctgtccttctgtgctgtatgtgcgtgtgcctgccg

SEQ ID NO: 28758 - DNA, 129 bp, Homo sapiens
attctctagtagatgacaacatgaagggagaaaccgagaatcttggtctatttaattcagcttgcattcataataatatgaatgtttcagtataattttcaatgcaaaaagataatgtaaaaaggggta

SEQ ID NO: 28759 - DNA, 429 bp, Homo sapiens
ttaataacttcataaaatagaatgtttgccagataagaattttttgttccttagcctctttattattactgtttttaattgctattaagtttgcttatagtatcttgaacaaaaatagtcacaggattttaattcatctgtaactaaataattctcattaaagtctagccttttgagaaagcagatgtgctttggatacatcttccctgaaattatgagctacgtcttccagcagtttgctctgatcacagctaaaagctaccttgcacagagaatatgagtgcctgtcatgtctagacagactcctgttctcacagtgccgctggattgagcaagtagagatctgacagagatgactagcctggataggaaagactggggaggaaaatggggttagaggctagaatttcatgggaggattgggttgcg

SEQ ID NO: 28760 - DNA, 190 bp, Homo sapiens
catcataggatcaattctacctctgtgtagaaagaaactacagagagtttttaaaataattcaaggttgtaaattctttggagtcctgttggacactttcagtaagaaacagcaagagaaataggggaagacagaggccaggagctggtttaattgttaaggtccttgttttgtatgactgtgagctaca

SEQ ID NO: 28761 - DNA, 136 bp, Homo sapiens
aaatgacctggtaattggcatcccctggcagaaatagcacagaactgttcccagaggtcttgttggccagggaaggctgtggctttgtagccttgttggagaacaaagggaaaggcgacactgttttccacctccc

SEQ ID NO: 28762 - DNA, 185 bp, Homo sapiens
tataatcctttgggtatgtatccagtaatgggatggctgggtcaaatggtatttctagttctagatccctgaggaatcgccacactgtcttccacaatggttgaaccagtttacagtcctaccaacagtgtaaaagtgttcctatttctccacatcctctccagcacctgttgtttcctgacttc

SEQ ID NO: 28763 - DNA, 309 bp, Homo sapiens
ccatagaaaaaaatggcttttaaagttattctttgcttcttagatatagttactccacatgtaatttgggagttggtattttaagaagttctttgtagacccagctagcacaaattgtaaagtatttgtaaagtatatacaaagtctaatgccaaggtacaggtgaggattcatgtcggtgacaaagatggaaattcagagattcttaattcccaactgccttttatggctgtaacatgggttgttggaagagtgtctgcatgtcatctcagtatgtgttataagcaagcattctgaaaggatttgttt

SEQ ID NO: 28764 - DNA, 229 bp, Homo sapiens
  misc_feature 3: y=c or t
  misc_feature 98: k=g or t
  misc_feature 130: r=a or g
  misc_feature 159: w=a or t
  misc_feature 160: m=a or c
  misc_feature 195: k=g or t
  misc_feature 196: k=g or t
tgytttctaaagttgtctgataatgaaaattccttgaggaagaggcacattttaaaagtatgatttcctgacctccaggaaggatcccgggaatatckatttttaacaagctgtctgcaattcttatgaracaagtttcagaaacactggagtagaggwmagaagtgcttcaagtatagtttctttgtgttattkktaatatcaatttgagatataatttacataccct

SEQ ID NO: 28765 - DNA, 191 bp, Homo sapiens
aattgctgtaataagatttttccttaggatctagggtgaccgatatcttggctaggcaaaacttagaggaaggtagaccaggtatggtggcttatgcttgtaatcccagcactttgggaggctaaggcaagaggatcacctgaggccaggagttcaagaccagcctggcgaacatgatgaaaccccatgct

SEQ ID NO: 28766 - DNA, 157 bp, Homo sapiens
tagctggtctcccttcctttatctttgtccctcagcctccctggtctcttcttaacacagcagccagaggtaactgcctgtgtgttagttccctgttcgctcagaggaacacccagaacacttacaacggttgcaaagccctgtgtggtctggcccc

SEQ ID NO: 28767 - DNA, 387 bp, Homo sapiens
aactgaaatacgttgttaaactcctcacttttctacagccttctcttaatgtagaggaaataaattaaaactgaaatttggggctttttatttctacaatacttttttttattgcttgcattcaaataatttaaagccgtgcatggtggctcacacctgtaatcctaacactttgggaggccaaagaggaggatcgcttgaatccgggagttagagaccagcttgggcagccctgtctctacagaaaatacaaagactatcgggctgtggtggcgcatacctgaggtcccagctactcgggtggctggggtgggaggagatcgcttgagcccgggaggtcgaggctgcagtgatccctggtcatgccactgtactccagactgagac

SEQ ID NO: 28768 - DNA, 328 bp, Homo sapiens
catcctctaaatataaatccaaatacctcagctaagtaattctattttattatttttactgttatgtatgtttttaatcatatttcttagaaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgcc

SEQ ID NO: 28769 - DNA, 263 bp, Homo sapiens
ccttaccacattccctcctatttcagaggcaggtctctgggcatatacatatatattttgtgttcttagttcctcccttcctagtgactctttgtaaagatattcaggttttctccatcctaagataaaaattcctttaagcttatctcttcttcagactaactctctgtgctttttttttctttaccaccaaactacctcaacagcctttcttctacttctttagtcatcgtgagccactatagccaaggtttgtgcccaca

SEQ ID NO: 28770 - DNA, 169 bp, Homo sapiens
caccatgcctggcctaaaatgtatatttttaatgaatcagatttcttacagaatttgatgtgagataaatgctttatttcttgtgtgcatattttagtgaaataattgcttgcaaaagtgccaattcttaaaagatatgggttaacccatttgcttgttcaccaccacc

SEQ ID NO: 28771 - DNA, 462 bp, Homo sapiens
  misc_feature 107: y=c or t
  misc_feature 109: s=g or c
  misc_feature 377: k=g or t
  misc_feature 379: m=a or c
  misc_feature 380: r=a or g
ctctgtcgcccaggctggggtgcagtggcgcgatcttggctcactgcgggctccgcctcccgggttcccgccgttctcctgcctcggcctcccgagtggctgggacygsagggcgcccgccatcacgcctggctaattttttgtgtttttggtagagacggggtttcactgtgttggccaggatggtctcgatctcctgacctcatggtccatccacctcggcctcccaaagtgctgggattgcaggcgtcagcaccgtgaccagcctgaaacaggagcaagttctaaactcaggctctagagtcagaaaaggtagagtcaggttctggatccaaaatggggcaagtcatgatcaggttctggaaccagaacaggckcmrgcctaggggctgagcagggtatcccctggcctgggagcagaggacttctggctgactgctgccgcaacgttctcaagctggt

SEQ ID NO: 28772 - DNA, 256 bp, Homo sapiens
  misc_feature 116: k=g or t
atccattcacccattgaaggatatttggttatttacagtttgggatgattataaatagaagtgctataaatattcatgtactagtttgtgtttgaacctaatttttcattttttckgtgttaaataactaggagtagaattgctaggtcatatggtaaatctttgtttgtttgtttgtttgtttatttatgagacacagtttagttcttgttgtccaggctggagtgcaatggtgcaatctcagctcaccaccacc

SEQ ID NO: 28773 - DNA, 379 bp, Homo sapiens
  misc_feature 7: m=a or c
  misc_feature 257: r=a or g
  misc_feature 300: r=a or g
  misc_feature 319: r=a or g
  misc_feature 338: n=a, g, c or t
  misc_feature 339: n=a, g, c or t
tttttamtgtaagcatttatatctataaattcccccctgcgcattgcttacattgcatcctctaagttttggtatgtcctgtgtttgttttcatttgtttctgttacctaatttttcttctttgagtgtgttgtttaatttccataaatttgtgaatttccagttttcttttgttattgatttctaacttgatttttttgtggtcagagaagaaactttgatatctgtctttttaaagttattaagacttgtctgarcatggtggctcatgcctgtaatcccagcactttgggaggccgrggtgggcggatcacttgargtcaggagtttgagaccannctggccaacatggtgaaccctgtctctaccaaaaaataca

SEQ ID NO: 28774 - DNA, 213 bp, Homo sapiens
ctgccttattcacccacccatccctttatcattctaaccccatctggcattccatccctccatttatccatcttcccacttacccatcttctccatccagcactccgttcatcagtccgtctctccctccatatttccatctgtccattcatccactcattttgccatccatacatattcacccagccatctcccaatccatcgacataccct

SEQ ID NO: 28775 - DNA, 228 bp, Homo sapiens
cagttacaatgatagaggtaacttcacatactaaaagaaattaggttaccatgtgaaacattcttcttggcttgtgctaatgttatcagatccaaacagcatctgaaagaaaattttccaagtagatgttgttctcttgttttctgaaatacatatcatatgttaaagtgagagtttttatacatgttgaaagaagttgaatgacataacaaatagttactgtggccc

SEQ ID NO: 28776 - DNA, 128 bp, Homo sapiens
  misc_feature 86: h=a or c or t
ctctcctgacatgttttggctctttgttctccttttccttctgttctttgcagacttcttttcctctgactatcctttcaatttthctgtttcccagggttctgtccttagcctttgattcgtagccc

SEQ ID NO: 28777 - DNA, 203 bp, Homo sapiens
  misc_feature 182: r=a or g
tgttaactctgcacaagataaaactgtcctaaattttattctgaagtttttcagaattacgtttgtagttttgtatttttatctttatatgttgtttagtggcatttcttctattcagtgtcttcatcccatcctagagttgacagtttagggaagcttctactattagacatgttaaagaratgattatttgaagtggggcc

SEQ ID NO: 28778 - DNA, 106 bp, Homo sapiens
tttttaaagctcatcagctatcgttagtgcattttatgtgcagcccagaacaattcttcttcttccactgtggcccagggaagccaaaagattggacacccctgcc

SEQ ID NO: 28779 - DNA, 111 bp, Homo sapiens
tccatgttgcccagcaggaggctgaaatgttcaaacgctacaatggaacatttccattacctggaatacaccaaagtcaagatgccctatgtacctgtccaaaactacccc

SEQ ID NO: 28780 - DNA, 176 bp, Homo sapiens
  misc_feature 114: b=c or g or t
  misc_feature 116: m=a or c
ctgggcgtgcaccagcacgcccagctaatttttgtacttttagtaaagatggggtttcaccttgtcggccaggctggtgaccaggtcacgtctaactcttgacctcaggtgaabtmactcgccttggcctcccaaagtgctgggattacaggagtgagccaccacgtccagcccat

SEQ ID NO: 28781 - DNA, 240 bp, Homo sapiens
tttcagacaaggtgtggctctgttgcccaggctggagtgcagtggcgcaatctcagctcactgtaacctctgcttcccaggctcaagtcgtgggatttcgccatgttgtccagctggtctcgaactcatgagctcaagccatctacctgcctcagcctcccaaagtgctggggctataggtgtgagccaccagcaggtatcacattcttgagaacaattgataatttgtatcaggaggat

SEQ ID NO: 28782 - DNA, 114 bp, Homo sapiens
tcttgtggttaattcacaccactctgccattcgcgacataaaaaacaggagtctattagatttaagcatctggttttcagcagttgtgcattgtgggtgaccttttgtgggcat

SEQ ID NO: 28783 - DNA, 254 bp, Homo sapiens
  misc_feature 3: n=a, g, c or t
  misc_feature 112: w=a or t
  misc_feature 128: v=a or c or g
atnattatagtttgttcttgtccttatcagaaagaaagtaagtccctccgtctcatccttccttcacttattcattcattttacttggccttagtatattggactatatgawaatataggtgcttgcvcgctttgagcttacaactcagtgatggagaaagtacatcatttacctagcacagtatttggcttatgatagctgcttaatacataaaagtaaatagtaagtaattacaagttgtaataagtgcccc

SEQ ID NO: 28784 - DNA, 105 bp, Homo sapiens
ttttaaagctcatcagctatcgttagtgcattttatgtgcagcccagaacaattcttcttcttccactgtggcccagggaagccaaaagattggacacccctgcc

SEQ ID NO: 28785 - DNA, 469 bp, Homo sapiens
  misc_feature 120: n=a, g, c or t
  misc_feature 125: r=a or g
  misc_feature 130: r=a or g
  misc_feature 133: m=a or c
  misc_feature 401: w=a or t
  misc_feature 404: m=a or c
  misc_feature 434: k=g or t
ttttaaacttccttgttttcagttgtcttatccaggaaggaaggctgagctcctggtgaacatgtaaatatctttacttctctatttaagagattgtaatcattattttgttataattgncatartgttrtamgttactttgacttgccagctaaactaatatttctgtgggtttatttattgagtttcagtgcataaaaggtgactaaagtgtcaccgtggaaagctacctgcatacgccagttgttcctttcaggtattcagtcgtggtctcttgttctggaaacccaacatctcctaattaaaatcgtcgtatgttaattgctctgcttaactacagagaaattattcattgcaataatttggtctgaaaatgaatgtttatatatattgtgtctttwaamaatgtgcaatgcatagctacattatatackataataagtcaagaaacagagttaggaataatcta

SEQ ID NO: 28786 - DNA, 77 bp, Homo sapiens
  misc_feature 47: n=a, g, c or t
actggctgctggcttcttgtggcaaactgtccctacaaccctgggcnagaccctgcacagcccctgtaacttcacac

SEQ ID NO: 28787 - DNA, 184 bp, Homo sapiens
  misc_feature 118: w=a or t
gttgcgtggaagataaggcggcgcgggaagtggacacaggctgcgagccttgggcagaatggatacctgaggaaaggtatggtttctctccagctcagatctaactggactctcggcwcctgctggctggacatggaggatttggaggaagatgtaaggtttattgtggatgagaccttggact

SEQ ID NO: 28788 - DNA, 94 bp, Homo sapiens
  misc_feature 77: n=a, g, c or t
ttgaaagggtttttctttcttttttaaaaaagaaaaacaaactattgattgtagataatgaaaagctagggtttgcnctcttcatgtctactct

SEQ ID NO: 28789 - DNA, 90 bp, Homo sapiens
  misc_feature 8: n=a, g, c or t
cccaaganagaggttaagaaagaaacaccgccaaaggaagtcaagaaggaagttaagaaggaagagaagaaggaagtgaaaaaggaagta

SEQ ID NO: 28790 - DNA, 124 bp, Homo sapiens
  misc_feature 9: m=a or c
  misc_feature 20: r=a or g
  misc_feature 50: r=a or g
  misc_feature 62: r=a or g
  misc_feature 78: y=c or t
  misc_feature 93: r=a or g
  misc_feature 94: k=g or t
  misc_feature 95: k=g or t
cttaatgtmatttttttaaraaaagcagtaggattaagtgtgtgtgtgtratttaatttgargatttccagtattttytcatgttttaattarkkgttttgagacgaggtctcactgtctcacc

SEQ ID NO: 28791 - DNA, 200 bp, Homo sapiens
tgtcaagcagagtatcatggttaaaatactctatattttctgctcaccagaggttgggacaagtggggatggagatgaggcgctttctcaactcaagcatcagtctgtgctcagcagaggtcgggggaaagtcatagtgaagagagcacaaactgagagatctgggaccaagcatggctattattaatatctcagggctc

SEQ ID NO: 28792 - DNA, 317 bp, Homo sapiens
taaagcccttacatatcgaggcatctggtgttcatgaaatagtctgttgtgctgttcaactttttcactcttttcttacctgacttagacaattaactcctagggctgggttttccctccacattgcgattccttcagggtcagattgtcttagtttctctctcttctttgtattgatactttatttttttggtgcttctcatttcttcaaatgtaatggaatgaggggactcagactttttctggtttgataatctagtgtataaatgacctggtcttttgatggttcatgaaatctttaactccgtcacctcctc

SEQ ID NO: 28793 - DNA, 349 bp, Homo sapiens
  misc_feature 48: n=a, g, c or t
  misc_feature 126: d=a or g or t
  misc_feature 132: r=a or g
  misc_feature 216: w=a or t
  misc_feature 259: k=g or t
  misc_feature 280: w=a or t
  misc_feature 294: s=g or c
  misc_feature 319: k=g or t
  misc_feature 326: d=a or g or t
  misc_feature 327: w=a or t
  misc_feature 328: k=g or t
cattcctcatatttagactgtatatttatgtaggtgtgagtgattgcntggtgcttgcttgtgccaaggtgctaggcaccctccaaccctgccaacttttgtggcctcccaaagcattccttggtdaccaargaggcttcaaacctgaccctcacttctcagtggacccgagtttcccttccatgccattattttcagtggggaagttttagaggwgagctgttggccacaatatcaattttaagtgttcatagcagtkatgtctcctgcattcttggcwcctggatttaccascaagagtccccaaaatattaatgckcttcccdwkttctaccctcaaacttatagt

SEQ ID NO: 28794 - DNA, 246 bp, Homo sapiens
  misc_feature 125: w=a or t
  misc_feature 130: k=g or t
  misc_feature 132: d=a or g or t
  misc_feature 187: r=a or g
  misc_feature 203: k=g or t
catatttatagcatggtttcccttttattctgctgagtacttttttataatttaactttctggtttatttttttaaaaacatttattgaaatataatttacacaccaagctgttgacccaccttwaaatkgdacaactcaaatggtttttagcataatcataaccatcaccatgaccactttaaaarcaacaaaaagccccakaactattatcttagcagtcaactctgtttgtcttaaccctccc

SEQ ID NO: 28795 - DNA, 176 bp, Homo sapiens
acagttcttcatccatacttagccacatatccagtacccaaaagccacatgtagctagtggctgtcatactggacagtgccaatatagaacctttctatcactgcagaaagttctattggctagcacctgctctagagcataggaattactttttttgttcacaagctccactggc

SEQ ID NO: 28796 - DNA, 211 bp, Homo sapiens
  misc_feature 62: m=a or c
  misc_feature 123: s=g or c
caaaaatttagctggccatggtggtatgtacctgtagtcccagcgacttgggaggctggggmaggagaaacacttgaacccaggaggtggaggttgcagtgagccgagattgagcccctgcastccagcctgggtgacagagcgagattgtctcaaaaagaaaacaaaaaggctatttccatctttctctgcacattgagaggacctgact

SEQ ID NO: 28797 - DNA, 178 bp, Homo sapiens
ttttttctaggtgaggttgctggattaatataatagcatattttcaactacccacaaatgcctggaagggactaatcattcattaaaaaacctgtccatatcgaatggtaatacacacacacatggaataaactcacctacctttaatctcattatgatatgttaaatccctgcccct

SEQ ID NO: 28798 - DNA, 313 bp, Homo sapiens
  misc_feature 48: d=a or g or t
  misc_feature 49: k=g or t
  misc_feature 214: s=g or c
cctagaaatgtgtataacactcagaattgggcattgatccttaaagcdkcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcasagctcctcttcccaatagggctctttctgctttccctctccttggccctagatttgtaatccatgaaaaagcacaaggtcctggctccttgcggtcact

SEQ ID NO: 28799 - DNA, 167 bp, Homo sapiens
atcaaatcatgctgtgcagttttgtctatatttgaccctgttagattctgctttaaggaatgtcaaaggaaatgtctgaatacagagaaaagacataaacaaaatcacaagttaagctgcttaggctggaattaatgaaatgtcaaaaatgctttacttaaacccgt

SEQ ID NO: 28800 - DNA, 148 bp, Homo sapiens
cgcttcttgcatgttcggtgttagtcatccagctcaggcttgtgttgcagctgacaatctaggaaagacggccttagagagtggtgcaggccccacactgacggactgccttagaaacccgacttcctctagactttgaaccgccaat

SEQ ID NO: 28801 - DNA, 230 bp, Homo sapiens
tctatttgaaagaagccagattaaaaaaatatatgctatatgattccatttgtataaaatcctagaaaatgcaaactaatctgtaggcatagattgcctctgttatactgcgaccatctacaagtacaggtgccctgtgggaattagggctcaggaaagtggcacaatgttgatcctctggctactgctattgctctgagtaaaaaactgtctttgatctccgacccccc

SEQ ID NO: 28802 - DNA, 312 bp, Homo sapiens
  misc_feature 303: n=a, g, c or t
ataacaatgatgttctggttactgtgatgctgaaacagatttcaagccagataatagctcaccatgttggggtaaaatgttggtatgttgcacacaggtgcaagaactttgttttttagagagaccaacttcttaaatgtgtaacagtcacattgtgaagggactgcatttgtctggatttcacctgcagctgggcccacagcctgcctgaggtcagaaaatttttcatgacccattttttaccctgaattgacaagtttagaaaacaggttaatggactacttcatcctcctggaccttganaagccggca

SEQ ID NO: 28803 - DNA, 93 bp, Homo sapiens
aagggtactgaagatgcactgttaaaaaaccaaagacgggcgcaaagattgcttgaagaaatccatgccatgaaggaattgaaacctgacatc

SEQ ID NO: 28804 - DNA, 256 bp, Homo sapiens
caaaaactctttgtttaattaagtcccagctatttatctttgtttttattgcatttgcttttgggttcttggtcatgaaatccttgcataagccaatgcccagaagggattttccaatgttatcatcgagaatttttatagtttcaggtctcacatttaagtccttgatccatcttgagttgatttttctataaggtgagatatgaggatccagtttcattctcttacatgtggcttgccaattatcccagcattg

SEQ ID NO: 28805 - DNA, 56 bp, Homo sapiens
  misc_feature 27: r=a or g
  misc_feature 28: w=a or t
  misc_feature 51: r=a or g
acaatatgcacttaaatttatgatctrwttacgagacctcactgtattttracaga

SEQ ID NO: 28806 - DNA, 115 bp, Homo sapiens
attcctgtcttcagtttttgcccctattccgttctttgctgagacttgaatttaatgcaaaatcttctcacttggtcccttcttaacttcttcattttcctctctgtgctgcgac

SEQ ID NO: 28807 - DNA, 282 bp, Homo sapiens
  misc_feature 221: m=a or c
  misc_feature 239: w=a or t
  misc_feature 253: r=a or g
gggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggmaggaaatagttttcctgwttccttttctcgargtggatgtcctcaggcttccttcacacct

SEQ ID NO: 28808 - DNA, 115 bp, Homo sapiens
  misc_feature 81: r=a or g
  misc_feature 91: k=g or t
  misc_feature 93: k=g or t
  misc_feature 94: k=g or t
  misc_feature 98: k=g or t
  misc_feature 103: r=a or g
atcctactaaacaaaaagacagagtgatggatgctacaatatctccttaaatgttttgatgatttttcataaatctaatgrgttacctackckktctkacacrtacacccacaac

SEQ ID NO: 28809 - DNA, 449 bp, Homo sapiens
  misc_feature 105: k=g or t
  misc_feature 111: k=g or t
  misc_feature 114: k=g or t
  misc_feature 131: m=a or c
  misc_feature 319: h=a or c or t
  misc_feature 320: r=a or g
  misc_feature 350: d=a or g or t
  misc_feature 354: k=g or t
  misc_feature 427: n=a, g, c or t
  misc_feature 430: r=a or g
  misc_feature 431: n=a, g, c or t
  misc_feature 435: r=a or g
  misc_feature 447: m=a or c
agttcacaaaataagatcctttggaacaattatgcaccatacatgcatattggatttatatactggatccaggatgtgactgattgggaaaaaaatggttgggckagacakgtkcaatgaaggagccaggmagttatttatataacacacggtaaacatccatctggctcaagggccaactgcagcatgtgcagcattggcagtggtgccttagaggtgtcagaactatttcacacaaaccagtttaggactacacaagattagtaccatccagcctacagaatggtactacaagttatagctacctacaggatataghrcctacagaatatactgtaggattttacaadcgaktcctatttctaaccttaggaattgatgtttttcccaatccatcttaacatcactgctttaatcacagatcagntarnaggrcaatatgcacamca

SEQ ID NO: 28810 - DNA, 224 bp, Homo sapiens
  misc_feature 94: k=g or t
  misc_feature 110: m=a or c
caatcaactcaaaatccttcaaaggctttccactttctttagtggcattcagaccccctctagtttgacccctacctccaacttgaacctctgktactcttccgtatgamcattttcctctagccctggactactagtaccgaagtcactagtcacataggactcatttgaaatatgactagtctcaattgagatgtaatgtaagtgtaaaatacacagcagaa

SEQ ID NO: 28811 - DNA, 163 bp, Homo sapiens
gtcagaatattgaaatcatttgtttcttatatttgaagtggatattaaatttctagttttaagttagacatagctttatagttaaccagacatgtgaaataaaattgggatattttgggtgaagaaaggaatactgattgtgttatttattttggacatgacc

SEQ ID NO: 28812 - DNA, 182 bp, Homo sapiens
  misc_feature 104: m=a or c
aatattatttacatgcatttacattaatattatttacatgcatgattatttattatgagggaaattataaatgagtatgtgatatgcagatggtaagaaaagamaaatacaaccaatgacacctgggtttttgtcctgagtaactggctaagaatgatgtcataaactgagatggagaagac

SEQ ID NO: 28813 - DNA, 213 bp, Homo sapiens
  misc_feature 102: d=a or g or t
taaaaagtgttaaggctgtaagcattatcatggaagtagtaaaattactaacgtgtgttagattcttgtatattgaagatgcatgctgtaatttaattggadtaatcctcaaagtaataaaacactaattgaaggaagaaaaattaaaaatatctgaataatcaaaaagaaaaattaaactttagtgacaaatagaaaagtaattagatggta

SEQ ID NO: 28814 - DNA, 303 bp, Homo sapiens
  misc_feature 99: m=a or c
  misc_feature 107: k=g or t
  misc_feature 109: y=c or t
  misc_feature 110: n=a, g, c or t
  misc_feature 111: b=c or g or t
  misc_feature 119: k=g or t
  misc_feature 122: w=a or t
  misc_feature 124: k=g or t
taatgtcttgactcttcagagttcgtacctcaaaagaacaatgagaacatttgctttgctttctgctgaatccctaatctcaacaatctatacctggamtgtccagktynbcctcctgkgcwakcttctcttctatccaagtagaatgtatgccaggagctccttccctctagcaatttctactaaaatgtccaagtagaatgtttccttttacaatcaaattactgtatttattaatttgctagaatccagtaaatcattttggtagctctggctgtgctatcaataaaaagatgaagcaca

SEQ ID NO: 28815 - DNA, 150 bp, Homo sapiens
attgtttcctgggacatattctttggcttctcaccagtcagatcagctcattcattcttaagtgctagcagctagcacaaaagcgctgagcctctgaaacaaagattttgcaagttttttttaaagtcataacatatttgaaggggatcc

SEQ ID NO: 28816 - DNA, 74 bp, Homo sapiens
ctgagatgtttttctcattttgcacatattgcattttcataattacagtggaagaagtaaattggcttttttca

SEQ ID NO: 28817 - DNA, 186 bp, Homo sapiens
  misc_feature 95: k=g or t
tgcaacctctgcctctcgggttcaagtgattctcctgcctcatccttctaagtagctgagattacaggcatgcaccaccatgcccagctaatgtktttgtatttttagtagagacagggtttcaccatgttggtcaggctggtctcaaactcctagcctcaggtgatccacccacctcagcctctc

SEQ ID NO: 28818 - DNA, 124 bp, Homo sapiens
  misc_feature 94: r=a or g
  misc_feature 100: d=a or g or t
attcccatccttcacctcctgccagcttaagttgcatcacgcctcagtggagattgcgatcgagggaccccagcagatgggcatcaatactcgrtttggdttgtagaggattgcagggaactgt

SEQ ID NO: 28819 - DNA, 217 bp, Homo sapiens
  misc_feature 10: s=g or c
  misc_feature 94: r=a or g
  misc_feature 97: r=a or g
  misc_feature 217: n=a, g, c or t
ttatcaaaasagtttagagatctttctagcagtctacccatggaaagttaggatctagaaaagccttctcaataagggaagaaacaacaaagaracracaaaccaggaaactccccaacttatctctttaaattccagcctcttttctaagtggtggtttttacatactgtcctctggtaggtgggtaccctggccttgtgtattaagcagcgcggn

SEQ ID NO: 28820 - DNA, 337 bp, Homo sapiens
  misc_feature 87: m=a or c
  misc_feature 94: s=g or c
  misc_feature 112: r=a or g
  misc_feature 116: s=g or c
  misc_feature 117: r=a or g
  misc_feature 118: m=a or c
  misc_feature 125: m=a or c
  misc_feature 163: v=a or c or g
  misc_feature 164: r=a or g
  misc_feature 175: r=a or g
  misc_feature 237: v=a or c or g
  misc_feature 238: v=a or c or g
  misc_feature 279: r=a or g
  misc_feature 280: r=a or g
  misc_feature 312: s=g or c
  misc_feature 315: r=a or g
  misc_feature 316: v=a or c or g
aacccgcggagaaggctgccatggcaccgtgcatcatctcctcgcccatgctcagcgccgggcctgaggacctggagccgccgctcmaaaggasgtgcctccgaattagaartcasrmtaagtamaaggaacgttcactcacagggtacgctcatggagagavrgcgcagagcaraccatgtcacgccatccaatgacaccagctggtcagctcaccaccccctctggctaaaactvvagcaaataaagccgcttcctgtcattaagcatctcagaggrrgcagccctccctcgatggcctctagcccagasaarvccgcgcatcttggacccaccc

SEQ ID NO: 28821 - DNA, 142 bp, Homo sapiens
  misc_feature 82: r=a or g
  misc_feature 91: r=a or g
  misc_feature 95: w=a or t
  misc_feature 106: r=a or g
  misc_feature 107: b=c or g or t
  misc_feature 112: k=g or t
  misc_feature 118: k=g or t
cacggggcactaggagaatagactgctgctttgtcttaagctgagatcaaccaggcagcaatgccagtgattggaacaggaragacaacaragawagtcaaccgcrbaatgkccttgkcatcccagtctgtactgaagcacc

SEQ ID NO: 28822 - DNA, 108 bp, Homo sapiens
  misc_feature 93: r=a or g
ttctttttaatgttaatcaaggggaagtgatttaaatatgcataaatgtagcagtcagggtgatttagttgcttttttcatgaaagaaaaagrctcaaaagacaagac

SEQ ID NO: 28823 - DNA, 220 bp, Homo sapiens
gacttctttaagaatatgaacagcagctgtgcacttttgtgagctttacattataaaccataacagcctgttcagctctatacaagtgatggggcagcttgattcttaacaaatgaagccaaactcagctgtgaaactgttaacagatctagtaatgacataggccccatgtatggaacatttcataacacaacaggggaaaacaggggcaacggccgcc

SEQ ID NO: 28824 - DNA, 288 bp, Homo sapiens
  misc_feature 163: b=c or g or t
  misc_feature 244: k=g or t
  misc_feature 260: k=g or t
  misc_feature 288: n=a, g, c or t
cacagcaaaattgagaaggtggcagagatttcccatttacatttttcccccatgcatgcacggcctcccctattatcagcgttcccccaccagagcggtatttattacaattgatatgcttatttgtctacttaagaaaatcatttatatttctttgaaagcbcataccgatacagtacttgatagcgttaactttttaaaatattaatagtttattaggaatatcctgaaatgattgagtackctttgaattaaatgtkactctattttaaaagtaatacagacttn

SEQ ID NO: 28825 - DNA, 180 bp, Homo sapiens
tggttcttatgggggcaaaaatgcaaaattaaagtggtttgtgactccacggcttaaacccttcccaagaaaattttattcttaagatttaatctctcaggttttcttgggtatcacacaagcattactgacattgagttcatggaaaatacagaaaatatatacaaaattaatgccacc

SEQ ID NO: 28826 - DNA, 131 bp, Homo sapiens
tataagcaatgaacggaagatacctgctgtgacactgatatttgtttaaaacattaggagttttttcctcatgttaaggtatccttttatttctggtataaactatgatacattttttaaaaaccttgcac

SEQ ID NO: 28827 - DNA, 75 bp, Homo sapiens
ctaaaagtgaaactatgcattaccttttttaatggttcctttatgttgcatattagtttactaaagcttgatttt

SEQ ID NO: 28828 - DNA, 129 bp, Homo sapiens
  misc_feature 101: r=a or g
  misc_feature 108: w=a or t
gcggtggcgaaggcggctttagtggcagcatgaagcgcaccccgactgccgaggaacgagagcgcgaactaagaaactgaggcttcttgaagagcttgaargacactwggctcccttatctgaccgata

SEQ ID NO: 28829 - DNA, 209 bp, Homo sapiens
  misc_feature 99: k=g or t
  misc_feature 103: w=a or t
  misc_feature 105: y=c or t
  misc_feature 113: k=g or t
  misc_feature 132: k=g or t
  misc_feature 138: k=g or t
caacttttcatattataaaatattcctttctaacgttatttaatttgttctcataggaaagatactatatacataaaaacacaggaaattatctcttakaaawcytttttttkaatcttaatctttcattgkttatckttatctttcattgttaatgggatgcatttaggttaaatgactcagttagaaaggtactatgagcagcggtg

SEQ ID NO: 28830 - DNA, 321 bp, Homo sapiens
  misc_feature 98: s=g or c
tctaatcctacagtctcagagatgctgttgtatcctgccccccaaccccatgatagtgatagtggtttttgccttgaaggaattgctttgtatttagsttttccccctcttagatttctagttccttttcagtattggattggatttgagatttgattaacctagtactcaggttcagatgctcgcctctttgcaattttaacactcattcgacaataaagtcagtaaaaaacacaaatttggttatgtcactctctttttactttagtgtctctccactgcactcagaataaagtacaattttattatttgtgacctggc

SEQ ID NO: 28831 - DNA, 253 bp, Homo sapiens
  misc_feature 16: d=a or g or t
  misc_feature 36: k=g or t
  misc_feature 37: m=a or c
  misc_feature 38: m=a or c
agttggtgttaacgcdgcagtttaagtgttcggatkmmaagggaaacagacaaacctcacgaaaggaaggaagcaagcaagcaaggaaggaactgcaggaggaaaagaaacaggcagaacagcgagaagaataaagggaaagggggggaaacaccaaatctatgattggacctgggcttctttttcgccaatgcaaaaaggaatatgcagcacatttttgccttcttctgcaccggtttcctaggcgcggagt

SEQ ID NO: 28832 - DNA, 153 bp, Homo sapiens
  misc_feature 102: r=a or g
gagggagtggtaaggggaaaagattactgagtcccagaaaaggaagtgggagacagttcttgcatgctggggaaatgagactgcgagtatgaggcttgctgraatttgagggagaacaaagtaagacgccaggtaagagaacgtggggtgcat

SEQ ID NO: 28833 - DNA, 227 bp, Homo sapiens
  misc_feature 102: m=a or c
  misc_feature 103: y=c or t
agtaaggaaaaaatggattattcaacaaatagtatgggatagcataacaatttagaagaaatataaagttagatctttcacaaaaattaattctagctagamyaagcagttagtcttctactttttggttactcccttttagaaattggaagctatgaagctatataccctgtccatttgaaaatgcacataagcaaagaactttacaaataggttataaagagagc

SEQ ID NO: 28834 - DNA, 121 bp, Homo sapiens
ctctttctctgctccccccatctctgtcgcagccgcggctgtggctcagagctgcatggggagacgccgctgcaggtccggtttctcggtgtctggtcggtgccatcattttcctgccccc

SEQ ID NO: 28835 - DNA, 132 bp, Homo sapiens
  misc_feature 120: r=a or g
ttatgaacaatggtgctatgaacagttgcgtacaagtttttgtgtgaacatatgttttcaattctctcattatatacctaggagtagaattactgggtcatatggtactgtatatttttraggaactgccat

SEQ ID NO: 28836 - DNA, 120 bp, Homo sapiens
  misc_feature 2: m=a or c
  misc_feature 63: m=a or c
tmatggagggtcttgaatacctggctaaggagtttaaagtgtatccaagaagacgtgggagcmactgatggttcatgaggaagagaagggcaggaccagcactgattgaaaggagggacc

SEQ ID NO: 28837 - DNA, 190 bp, Homo sapiens
  misc_feature 116: m=a or c
aaaaagaagaaaagatatataggtggctcacgcctgtaatcccaacactttgggaggccaaggcgggcggatcatgaggtcaggagttcaagaccagcatgaccaactggtgaaamcccatctatactaaaaatagaaaaattagccgggtgtggtggcacacgcctgtaatcccagctactcaggaggc

SEQ ID NO: 28838 - DNA, 123 bp, Homo sapiens
agcgatgaaaagcgttccacacgccacgagcccgcgggatcctcggagagtatggaacccttcccctccgctctcagccggaggcagctgcgtccagccgggctcggtttctgaacaccgact

SEQ ID NO: 28839 - DNA, 262 bp, Homo sapiens
  misc_feature 109: k=g or t
  misc_feature 130: r=a or g
aattggaagaacgagagggggagagatgtaagaaaagaaaggaaaagtgaagtaggcatatgaaagaaaaggcacttcttggacaagcactgaaatataatgagacagkttacccattaaatataataarcagtaaacgttgaggttcatcaataaaagcacagatacctgaatagaggagtgacctgaatagaattcgttcagccgaacgaatgagaatggatgattttcactatcctgtgcactcaaggcccaaaagaga

SEQ ID NO: 28840 - DNA, 98 bp, Homo sapiens
ttaagttttttcttgtaaattttctttacttgtgagtatcatcttgtcctttaatcctgtaccctaaaataagaaatacatttttgacagaggctcga

SEQ ID NO: 28841 - DNA, 74 bp, Homo sapiens
tatttttagtttgtcatggtatcttttatggcaccagaatatgttctctcttggtgaattttctatgtgagctt

SEQ ID NO: 28842 - DNA, 158 bp, Homo sapiens
  misc_feature 102: k=g or t
  misc_feature 103: r=a or g
  misc_feature 106: s=g or c
  misc_feature 108: v=a or c or g
gtggagatggggtttcagcatgttggccaggctggtctcgaactcctgacctcaggtaacgtgcctgcctcggcctcccaaagggctgggattataggcatkragscvacattgcgcctggccctaatgtgtttgtttcttcatctgtgtaaggcgcc

SEQ ID NO: 28843 - DNA, 311 bp, Homo sapiens
cgttgaagaaacagtatacaagaaccctgtctctcaaatgatcagacaaaggtgttttgccagagagataaaatttttgctcaaaaccaggaaaaggattgtaatggctacagtttcagttacttccattttctagatggctttaattttgaaagtattttagtctgttatgtttgtttctatctgaacagttatgtgcctgtaaagtctcctctaatatttaaaggattatttttatgcaaagtattctgtttcagcaagtgcaaattttattctaagtttcagagctctatatttaatttaggtcaaat

SEQ ID NO: 28844 - DNA, 214 bp, Homo sapiens
  misc_feature 55: s=g or c
  misc_feature 102: d=a or g or t
atgacagagaacaatgtgttactaattattttggttgtatgccattagtaaattsatagaaaaattaaggggattaacataacttcatttcattgccttatdattaacatcttataatacaatagtttaagactaagggaaacagatggagctgtttattgagacaactggtgaggaattatcatgtgttcattcccattttagagcgtgaaac

SEQ ID NO: 28845 - DNA, 176 bp, Homo sapiens
taaatccaaagtaacctgaaaaaacattagagtaaaaatcattgaaattgaaaagagaaaatcgataaaacccaaaactggttccttgaaaaggtcagtaaaattgataaacctctagctagcttaagaacaaacagaagacaaatattgctaataccaaaaatgaaagaggccat

SEQ ID NO: 28846 - DNA, 219 bp, Homo sapiens
actaagcagtggaggataaagacagtgtactgggcagtagcagcttgggttccgccttagttctgccattgccagtaagagctgcctcaggccaggtcataaaattgctttttcttctgtggctatatgttaaaaacaaggcttttgagtatggttcctctgtacatcctccagcttgaaaatgatccaaaaattaattgtatctcagaaaaaaaaaaa

SEQ ID NO: 28847 - DNA, 113 bp, Homo sapiens
caagggtttgtagtaatgtattcagtgccacttcttgccatcactttgcaattattgaaatgggaatactgagctcagaaagcaaatatgatgctttcatgggagatggggcc

SEQ ID NO: 28848 - DNA, 181 bp, Homo sapiens
aatatgtttttttaaacctcataaaaatctagcacactcttctcttgagcagttagcagacctaaagcaagcctgaattggctatgcagtacattgtattctgtttgggggaatttgttttagccattttctttaattaccagttttccagaacactcttagctatgttgacatgaggcat

SEQ ID NO: 28849 - DNA, 133 bp, Homo sapiens
  misc_feature 122: k=g or t
tatcatacagattggacacctcattctagatccaagatcttttcctcaacactgggagctgtcctttcagcaccacaaaattactgcttgaagttgcattgcagtttttttgtttttttttkgtttgtttgtt

SEQ ID NO: 28850 - DNA, 184 bp, Homo sapiens
  misc_feature 56: s=g or c
  misc_feature 96: m=a or c
  misc_feature 99: m=a or c
tcaaccattgtggaagtcagtgtggcgattcctcagggatctagaactagaaatascatttgacccagcaatcccattactgggtatatacccaamggmttacaaatcatgctgctataaagacacatgtacacgtatgttcattgcagcactgttcacaatagcaaagacttggaaccaaccc

SEQ ID NO: 28851 - DNA, 107 bp, Homo sapiens
  misc_feature 16: w=a or t
  misc_feature 17: k=g or t
  misc_feature 82: v=a or c or g
  misc_feature 107: n=a, g, c or t
cagaaaaaagaggccwkgaagaaagaggaaagagaagagatcgctcaggggtgagaccatgcccttcatcttttcttttccvtaatctcctctgcttgtatccaccn

SEQ ID NO: 28852 - DNA, 160 bp, Homo sapiens
  misc_feature 95: m=a or c
agctagagaaattaagccatcgtgttggtgagtgttcctaggctaatgataatctgtataattcacatcctgaaactaaggaatacagggttgamaaaaatattaatatgtttgtcagaaggaaaaataatgcatttatcttccccccccaccccccgcc

SEQ ID NO: 28853 - DNA, 144 bp, Homo sapiens
agtaaatgattttgtttttaatgacacttggttaaaacagaagctctctgttatcagatatatacttcataatatggatggttgacgcttcctgatgattaaaatcaatatacacattccaggttggaacagaagaaatgcaca

SEQ ID NO: 28854 - DNA, 203 bp, Homo sapiens
cagaattttctaagaggatgagttgaatctatagcagcattgtcagtacagaccagtggttctcaaactttaaaatgcctcagcatcacttgggagcttattgaaatgcagatcccagagtcagtaaatctgcctgtgaagtatgatagtctgcatttgtaatgagcattcaagtgattctgatgcaggtgagctgagggcac

SEQ ID NO: 28855 - DNA, 231 bp, Homo sapiens
  misc_feature 98: k=g or t
atgaaaagcagtttgttattatgcaggaaaatcagtttcatcattttagttacactaaacacttttggcagcttaatatgacctttttaaattttttkttattttttttatttttatttctttaagatggagtcttgctctgttgcccgggctggagtacaatggcatgatctcagctcactgcaacctccacctcctgggttcaagcatttctcctgcctcagcctccct

SEQ ID NO: 28856 - DNA, 158 bp, Homo sapiens
ctgtttttttgtgattatttcacagataatgagaccttaataacaaataggcgtaaaaaaattttcacattgaaatgatagaaacatttgatgtaataaaacttggttggcttgatattttaaggaattgaaacctagcaatcttattggagagacaa

SEQ ID NO: 28857 - DNA, 90 bp, Homo sapiens
aaatacaagaaattagccggacgtgttggtgggcgcctgtagtcccagctactcgggaggctgaggcaggagaatggcgtgagccgggag

SEQ ID NO: 28858 - DNA, 381 bp, Homo sapiens
  misc_feature 358: m=a or c
  misc_feature 359: n=a, g, c or t
aaaataatctcctttgactccatgtcccacacctagggtacactgatgcaagggttgggctcccaaggccttaggcagctccacccctttggctttgcagggatcaaccctggaggctgctctcatgggcccatgttgaatgcctgtggcttttctatgcctgttctggagtctggaggacggtggccctcttctgccactatgcagtgccctagtggaggcttgatgtgagggctccagccccgtatttcccctctgcactgccctagtagaagttttccatgagatctgtgcccctggagcaggtttctgtctggacttatgccaggctggtataagtttctttcagaggatgccmncatcctctgaaattgagtcaga

SEQ ID NO: 28859 - DNA, 100 bp, Homo sapiens
ctggaaagtgttgatctgggttttctggcattcttttaagttaaaaagttaacatcgggacatgggtttgatcttttgttgtacctgatgacagtgccct

SEQ ID NO: 28860 - DNA, 424 bp, Homo sapiens
  misc_feature 292: d=a or g or t
aatggttttttgattctatgcactaattttctttgtccaaaacatttactctaccatatgtctgggaatgtttatcctttctacagtaatggtgaaaggatcatatctagctaaaagcaagaacacccgttctcctgaatgcagtgagtaattgggaatcacaaggaacattctggcacccaactgtgcccatgttagttttcatgagttttccccactctgaagctgtaacccagaaggcacatccattcacatttttaccgcactgtggattcatagtgtggggccctgdtattccaataccctccttaaggacatgtgaagcatttggcccagttggctcccagggaacattttaatttaatgtagtgaagaaagaccattctagatcagagctacaagttcactttctgtctctgagaat

SEQ ID NO: 28861 - DNA, 144 bp, Homo sapiens
ccttggatccctgccaacttgagaataatgtttctcaaaatgcttatgtttctcctgttgaatatctaattcctctcttcttaactctgaaaaatcaatgccatcctggctgtctatacagtactttggccagttccctaatca

SEQ ID NO: 28862 - DNA, 218 bp, Homo sapiens
agatatggtgaccacaggtcctggattttcaagtctaattccaatttcaaaaattcttgtctatatttaccaagtttgtatactgaaaaatttgcttacaacataggtaatgttaatgaaaccagttcagtccattgattttggtttcagtctacaaaattgaatttttttccttccaatgaatttttcagttgtttttatataatatgaacacaact

SEQ ID NO: 28863 - DNA, 156 bp, Homo sapiens
ctaaacttgagtttccttagtgatttcaaaatgaagtataagaatatcagatccagttagcaaaagcctaggacttgtttctccaaacattgtactaacattcaacttgttttaaaattatgactcaagaattttaaaaaattattctggacatca

SEQ ID NO: 28864 - DNA, 131 bp, Homo sapiens
tgttttgattgctattgttgtacatgagaaattcagcattaaagaacactgaagcggtaaggtcactgtggaagaggaagcgtttatactgtaaaagaaggttagatttgcacagtctactgggtaggtat

SEQ ID NO: 28865 - DNA, 281 bp, Homo sapiens
  misc_feature 271: n=a, g, c or t
cataccatcggatcttgtgagactcattcactatcatgagaacagtgcaggaaaggcccaaccccaaaattcaatcacctcccactggattcctcccacgacacgtgggaattgtgggagttacaattcaagatgaaatttgggtggcgacacagccaaaccatatcattctgaccctggccacttccaaatctcatggcctcacatttcaaaacccatcatgccttcccaccagtcccccaaagccttaactcatttcagcattaactcnaaagtccaca

SEQ ID NO: 28866 - DNA, 140 bp, Homo sapiens
gaatatttaggtataatactttgttccatgttccattgttttcttttgacccaaccttcaaacccatgacttctgaagcagaggaagaaatagaatacagtggaaaaaagtcttctttgaagaaaaaaaaaaaaaaaaaa

SEQ ID NO: 28867 - DNA, 127 bp, Homo sapiens
  misc_feature 32: n=a, g, c or t
  misc_feature 57: w=a or t
tgaatttttggaaagtgcatgagcagagcggnggagagagaatctgaactttcagcwgtaaaccggttaaaaccaaaatgctcagcccaggacctttccatctcagactggctggccagggaacgcc

SEQ ID NO: 28868 - DNA, 476 bp, Homo sapiens
  misc_feature 111: n=a, g, c or t
  misc_feature 112: w=a or t
  misc_feature 176: n=a, g, c or t
  misc_feature 177: n=a, g, c or t
  misc_feature 349: d=a or g or t
  misc_feature 350: n=a, g, c or t
  misc_feature 351: n=a, g, c or t
  misc_feature 367: b=c or g or t
  misc_feature 368: n=a, g, c or t
  misc_feature 429: m=a or c
agccctgaggaattccgggagtggagccgacttggaaactcaaggccaatctcaggttgagacatgggagctcaggagggggaattgcactgaagatttgtcccatcgtgnwgcaagagcactggaacttacactccaccatcaggccctgtcacaggagaacaaagaaggaaggnngaggagatcatgctccggccagcagggaatctccatttttttcagcctcataccttggaaagtacaaaggagtgagagctgggactaccagccagagggttcatggaggtagtgggaggggaagatgggttctgcatggagccactccagggacttttcttctgtctcacadnntgacaatcacctctabntgttctcagtcccattctcatcaatgacctcgtctcctgattttgtacaatatctaggtgmcttctcttctttccatcttcaaacgcttgatcattgatgtccctttc

SEQ ID NO: 28869 - DNA, 132 bp, Homo sapiens
  misc_feature 24: k=g or t
  misc_feature 66: k=g or t
  misc_feature 105: d=a or g or t
  misc_feature 106: k=g or t
  misc_feature 127: k=g or t
cacaccaattaaatggattttgtkgagaatttaatcattcaatttggtcaaccagaatgacttcckgtggaactctgttttatgacagataatagttttccaacdkgattgagtctctgtataccckgggtg

SEQ ID NO: 28870 - DNA, 171 bp, Homo sapiens
  misc_feature 23: k=g or t
  misc_feature 78: k=g or t
aaaaagacgaaaatctgaaaggkgctgggaacagatacgagttggaaaacgtccgcagcgagctcagattttagagckttcttcaaacgaatggggactacacaaatgtttggaagtcttacaggacttccgaagacttcatttactaaaggcaatgcactcagaggattg

SEQ ID NO: 28871 - DNA, 370 bp, Homo sapiens
aaacagaacaaagcatgaaaagaccacaattagtgctggctatgcttagagaggagcagtctcttggtaaactcaggcagtgatgatgaacagaaaatggccgactgatactgtaatagaggcatagaactaaggacactccgtgagctggcataaatacaggggagtctttaagactgaaaaaagttcatgggtatgacacttaatatgactcaacattactgcagaattttaaagcaaacatgaaagcttgagaataaacactagtccctctacttcaagaaaaagcagaacctgtactagaacatgaagaacttagagatcaaaagacagccagaactatgatgaaatattttgaaagcagtgggtc

SEQ ID NO: 28872 - DNA, 369 bp, Homo sapiens
  misc_feature 17: m=a or c
  misc_feature 26: n=a, g, c or t
  misc_feature 28: k=g or t
  misc_feature 76: b=c or g or t
  misc_feature 80: s=g or c
  misc_feature 82: r=a or g
  misc_feature 98: w=a or t
  misc_feature 103: d=a or g or t
  misc_feature 109: d=a or g or t
  misc_feature 212: s=g or c
  misc_feature 355: r=a or g
gagtggtggcccaagamctgctccangkgggctgttccctgtcggctcctggaacaggacgggtaagccgactaabagcscraacggggacccatgawaagadaagaadaaacaagatccgggaatagtttgttactgttatttacatccagactctggttttccggccctttacagctgctggtgaagagtattcaagctttgaatactgstctgaactgaccttgaggcacattgagaggaaaaatcactggagaaaatcgcggtttgtgtagtgctttgagatcctctaacgcgaaacaagagaattgtgaagtgaccttgtttcatagatctctctacgtccacaattggratactaagggactt

SEQ ID NO: 28873 - DNA, 71 bp, Homo sapiens
aagacacagaagttcaaggccaagctgtggctgtgtgaggagcatcccctgtccctgtgtgagcaggtggc

SEQ ID NO: 28874 - DNA, 141 bp, Homo sapiens
  misc_feature 10: d=a or g or t
  misc_feature 17: k=g or t
  misc_feature 22: s=g or c
  misc_feature 33: k=g or t
  misc_feature 99: b=c or g or t
  misc_feature 101: n=a, g, c or t
aggagatccdgaaacckggacsctgtgcaagckgcagcgccaggaggaggcagcggaggaagcagagcgcgggatgggcgcccagcggcatctgtgatbcngcgcacctccgccccacgggcgcgcgcacaaacacggttc

SEQ ID NO: 28875 - DNA, 333 bp, Homo sapiens
tctagacaacctgttagaaaagtagacataactgggagatcatgaggccctattaggatagaggagcaagcagaattgagaaaccttagctgactcatgatagaataaatgtgatatgatttcacctatcccagtttttaaaaatcaaatgtacatatggtaaactttctttcattggagtcatgttaccattttctttggattactgagcctgcagctaaaatcctgctctaatccattaaccttttgagttgctgtgcctttacgcaacaaaaattctactgatttctaaccacaaatgttaggttcaatgattacagttagtgatacaga

SEQ ID NO: 28876 - DNA, 56 bp, Homo sapiens
  misc_feature 7: d=a or g or t
tgatgtdaaaacctcaaagcaaaaaaagtgagggagatagtgaggggagggcacgc

SEQ ID NO: 28877 - DNA, 95 bp, Homo sapiens
tacttctagatctttcaaaatgtaataaggttgggtactaggcttaattcttggttgacgaaataatccgtacaacaaatccatgtgacatgagt

SEQ ID NO: 28878 - DNA, 118 bp, Homo sapiens
  misc_feature 87: k=g or t
  misc_feature 107: r=a or g
taggaggatgaacttggattttgaatatttgaaacatctctgagtaaaagattcgatcagataacttgaaacaacatgtagtggttktctcaattagaagataaccragtgaagactt

SEQ ID NO: 28879 - DNA, 67 bp, Homo sapiens
  misc_feature 25: s=g or c
  misc_feature 27: s=g or c
ccattgaacaacaactctgtatttscsttataactcagcgcctggtaaccacattctctctctctct

SEQ ID NO: 28880 - DNA, 148 bp, Homo sapiens
  misc_feature 103: k=g or t
  misc_feature 109: k=g or t
agaaggagcaagaaagaggaaaagaagaggattatttattcgacctactttggatgtctctctcgcttttcctttttcctttttttggcaattattttcttckgatttktattttttctatttcgctgtgatttcgtcgccggcgacc

SEQ ID NO: 28881 - DNA, 238 bp, Homo sapiens
  misc_feature 41: k=g or t
  misc_feature 78: k=g or t
  misc_feature 95: s=g or c
aaatttatttattccagcagaagccatgaaaaagttatgckctggactcattcaagccaggactaaaatcctatctgkcttcccattcatgagcsatgtgatagcaggccagtgacttcatcttctgagttcattttcttacctgtgtaacaaggaacatgatgcctgccttacagagtcatttggggattaaagcagttaacattcacaacacatttggtgcttactatgtccttat

SEQ ID NO: 28882 - DNA, 111 bp, Homo sapiens
  misc_feature 54: k=g or t
  misc_feature 56: s=g or c
  misc_feature 60: s=g or c
  misc_feature 72: s=g or c
  misc_feature 94: s=g or c
  misc_feature 99: k=g or t
tatgtatatatatttatacaacttatgtatacatatatatatgtatacacacakasacasacacacaccacsaacaaccaccactacaccacasatgcktataacaggcac

SEQ ID NO: 28883 - DNA, 353 bp, Homo sapiens
aacttgaaacccacaatctaatgaggaatgtactggaaaaataatctgaagagttgacaaattgtgtactagattgaacacatggaatgcaatgcaatgagactttctgcactaaaacttatcctcatatgtacaacaatgatgtgtgtattatataacagtgatgtgtacatttctgacaccccatacataatatacacagtttgtataaatgcatacatttaaaaatatatatgtacaatacagctaacataaaactgtagtacgcctgaaggatattactagtgcctaatattgagtatgagtcactgcgtgttcgcatcaacttggaagtgcagtaattgttataaaat

SEQ ID NO: 28884 - DNA, 62 bp, Homo sapiens
  misc_feature 14: s=g or c
agagattttgagcstcatatttctttgatacttgaaatagagggagctagaacacttaatgt

SEQ ID NO: 28885 - DNA, 432 bp, Homo sapiens
  misc_feature 126: w=a or t
  misc_feature 127: m=a or c
caaaatagttgtaggggaaatcaaggtgaaggatctgtccgacagtcaagacggatccacagtaatctttcggtctccttaaactaccaccctcgctgccacccaccccaagctgctgccgcctcwmcttccttgaaatttctcagcgggagtctcctcactgccactaaaacccacccagcccactaactgaggagctagtgttaatccagagaaccccccgcaatgtgcttccgagattcagactgcttcattgggaagtatgatttgttcctttctggaattgggctccgtggtggcggcggcacttcaagcaaagacagtttcttgcaagctccagtagctccgcgtgtctcatttgccaggaagatgggttcccacgtagcaaatcgtacattgtgccctgtagctccttagctagttagctcacaa

SEQ ID NO: 28886 - DNA, 144 bp, Homo sapiens
gaacaagagagagaaggggaggagccgggctcctttaaacaactggctgtcttgtgaactaacagagccagggctcactcagagattaccacagagagggcaccaagccattcacgagggatctgccgccatgatccagcacct

SEQ ID NO: 28887 - DNA, 403 bp, Homo sapiens
  misc_feature 264: y=c or t
  misc_feature 266: n=a, g, c or t
  misc_feature 267: s=g or c
  misc_feature 292: k=g or t
  misc_feature 312: k=g or t
atagccagcatgaacgacagcatctgcatcggccacggagctaaaacaggctcttagaaatgtgcttgacatttcccgtggcagcttcacagcctccttggaaagccttggtccacctctctgctgctgacaagctctgatttgggtaagatgctggcaggtgccagcaaaggacaataggcttttaattaaggtctgtagagccatagctcaggaaacacacctcctgaagagtttttttgtttttgtttttttgtttttttyansaaaaacacttgcgtttcttcttgckaccctacaaacagtaactgkgtgctccatcgaggcaactgtggtcgttaatcttccgcagcacaggaattgctagtaacataaagatgaagaaaaggaggctcagagagtt

SEQ ID NO: 28888 - DNA, 101 bp, Homo sapiens
  misc_feature 44: d=a or g or t
  misc_feature 50: k=g or t
  misc_feature 56: k=g or t
  misc_feature 72: k=g or t
attctttagagaatggagaaattgctagaaaccattgatcagcdtcacckggagtktgccaagagggctgckcctttcaacaattggatggagggcggcgt

SEQ ID NO: 28889 - DNA, 336 bp, Homo sapiens
  misc_feature 76: v=a or c or g
  misc_feature 77: n=a, g, c or t
agtgttaaaaaggaaggcaaaccttctgagacaaaatgaagggcagaggaaaccagtagcagttctcaagagaccvngccagctaagcagaaaaaataacattccagctaattttaccaggagtggaaataaattaaatcatcagaaagatactcgtcaggcaacttttcttttcagaagaggcctgaaggtgcaggcccagttgaatacagaacaactgctagacgatgtagtagcaaagagaactcgtcaatggcggacttccaccacaaatggagggattttgactgtatctattgacaatcctggagcagtgcaatgcccagtaactcaggt

SEQ ID NO: 28890 - DNA, 264 bp, Homo sapiens
  misc_feature 76: n=a, g, c or t
  misc_feature 77: d=a or g or t
ttagaaatcaattttgtctgactccttccctttaatgactgccatccaggattactctctagggaggaaagtgtgndatttagccccagtcatagagccacccaaaatgggaaagcattgaagaaaacaaattgccataagagtctcctgtccctgccttggatcatttcatgctaatccaaggcagtttatgctaaaaaatgttaaatttatcaggaattcgattaggttttaatttgtctattttactacaaatgggccgat

SEQ ID NO: 28891 - DNA, 184 bp, Homo sapiens
attttactgccttaaaacttgctttaacttactcaaaggtatttcttctagtctccctttcctggtgatgatgaagaggaagtttttgacagtattgtaaatgatgaagtaaggtatccaaggttcttatctacagaagccatttctataatgagaaggctgttaagaagaaatcctgaacggc

SEQ ID NO: 28892 - DNA, 374 bp, Homo sapiens
  misc_feature 225: r=a or g
  misc_feature 252: n=a, g, c or t
  misc_feature 325: n=a, g, c or t
  misc_feature 326: m=a or c
agaaaagggagagatttaaaaagtaagaaggtggctgggattacaggtgtgaaccactatgcctggccccaaaataaaaatttatttatttttgtttttgtttttcccaaaataaaaatttaaatcaagacaaaaatgtaacgagtggcgttatttgtacatttttgcagatctctttaatgtttgtcttaatagaagtcagctagattctcatatatgcttctrtgttcagtatgttgcagtgttttctangttgaagtacccgaagaaaatccaacctcacacagacaagtagttgggaaagggattattttaatcgcttttnmgcttgaaagcttaaatgttttctgttacaacaaatactgagttgtttt

SEQ ID NO: 28893 - DNA, 92 bp, Homo sapiens
  misc_feature 41: s=g or c
  misc_feature 69: n=a, g, c or t
aaggtagaatgacaggccacgtttggcccgttggaaatgcscaccaccctctgggaagatttactggcngtttatggaaggcctgtgtatat

SEQ ID NO: 28894 - DNA, 288 bp, Homo sapiens
  misc_feature 76: n=a, g, c or t
  misc_feature 132: n=a, g, c or t
taaacatgacttccctttaaaggatctagatattgttcaatttaaaatatggcaccataaaaaagtcatgtagtantagagcatatgcttttttagaaccaggttaaaagctgtttgttatctaatagagtnaaagttactgaggtcaacagatagacaggtctggcataatatatgcccagtcataatagtctaattatattcttttgacaacagacagcattcatcagagcactaattcgaatgagagttttggctatcaagatgtgttgattctaaatattatta

SEQ ID NO: 28895 - DNA, 218 bp, Homo sapiens
  misc_feature 131: k=g or t
  misc_feature 139: s=g or c
tttcaatttttattttagattcagagggtgcatgtgcaggtttgctacatgggtatgttgcctgatgctaatatttgaagtatgaatgatcctgtcacccaggtagtgagcatagtatctaataagtagtkttttagcscctgccttcctcccttcctcccccttccggtagtccccagcgtccatttttgccatatttacatccatgagtacccagc

SEQ ID NO: 28896 - DNA, 204 bp, Homo sapiens
aaaatttgctgattagttttggctcacaaacttacctcttatgctgaacttgcctgtgattttctcacatctacaatatcagttcagctattaagcacttcaggattgccaggattgtcatctctgagacatgcctaggaatttatcagaagaagaaactagaagaaagtgtgtgtgtgtgtgtgtgtgtgtgtgtgtgtgtgt

SEQ ID NO: 28897 - DNA, 122 bp, Homo sapiens
tcaagaaggaggaaaaaccaaaaaaggaagaggtgaaaaaagaagtcaaaaaagagatcaagaaagaagagaaaaaagaacccaagaaagaggttaagaaagaaacaccgccaaaggaactc

SEQ ID NO: 28898 - DNA, 111 bp, Homo sapiens
ttaacatatgtatatatatatatatgttaaaaggattccctatttaatgaaacttttaccacaatcaaaatatgaacatatttatcacccccaaaagttttcccctgcaac

SEQ ID NO: 28899 - DNA, 196 bp, Homo sapiens
tttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtggggtg

SEQ ID NO: 28900 - DNA, 163 bp, Homo sapiens
aaaattgtcttaagcaacagccccaaatgctggctgcccccagccaagcattggggccgccatcctgcctggcactggctgatgggcacctctgttggttccatcagccagagctctgccaaaggccccgcagtccctctcccaggaggaccctagaggcaat

SEQ ID NO: 28901 - DNA, 143 bp, Homo sapiens
tgaatttgattgagagatatggaaatagtcaactaaatactctgcttggagactaagaggtggtggtggtaacattggaccatctttgacactgttggtttgccagtttccctctgaccttttccagttttgttcatggactc

SEQ ID NO: 28902 - DNA, 119 bp, Homo sapiens
  misc_feature 53: k=g or t
  misc_feature 70: k=g or t
tgagttctagtttgattgcactgtggtctgagagatagtttgttataatttckgttcttttacatttgckgaggagagctttacttccaagtatgtggtcaattttggaataggtgtgt

SEQ ID NO: 28903 - DNA, 226 bp, Homo sapiens
caatagagtatatttggaagaaagggtcagggggctccttgcttctaatggacaagggccctgagctttagagcccttcacattttattgggtaaaagagggagaagggtgggggtgattgtcggtcagcggcttgatttacagcaggcttgcaagactgcattctttgaacaataggctctagatgtcccagtagataatctcagtgagcacagtgccagggagc

SEQ ID NO: 28904 - DNA, 161 bp, Homo sapiens
tttgggataagctttcaacaattattaaggcttaatacataagattataggatcagtcaagcaaaagggaaggtataacctttagataggactgggaagtgctgggtgaatgtcttctacccttaacggtggtagaaatttgaactataaaataacaccgt

SEQ ID NO: 28905 - DNA, 276 bp, Homo sapiens
atgagaatggatgattttcactatcctgtgcactcaaggcccaaaagagaaagcaagagaggagagaatatggaaacgtatgacaggatgtatataagcaatacaaacatattgaatgaataaataaagacataaatatgtgggagagtggaccacgcaaggacaaaaagaggagagaaggcagcaagaattatgactaattcaaaactgggttcctgagatagttaaataaatcctgcaccaaatccccagggggagaaattaacaaacaaaagc

SEQ ID NO: 28906 - DNA, 223 bp, Homo sapiens
aaaagaggttcctcgctggctgtggtagcatggtgtagtcccagctactcaagaggctgaggcaggaagatcacttaaagccaggagtttaaggctgtagtgcgttatgattgagcctgtgaacagccaccgtactccaacctgggcaacatagcaagatctcacgtccaaaaaaattaatttaatttattttcaataagaggctcctgaagagacgtcccaa

SEQ ID NO: 28907 - DNA, 119 bp, Homo sapiens
atttaagaaattcaacacaacattgtattattgatgcaaacccacttgatactagtaaatgctaaacacctaataatatttattttcaattattaaatattattaggtgtttagcattt

SEQ ID NO: 28908 - DNA, 287 bp, Homo sapiens
  misc_feature 176: k=g or t
  misc_feature 284: n=a, g, c or t
  misc_feature 285: n=a, g, c or t
aaaaccattcgactcgtggcgtctgcatcaagtctgaaagcagacgcgcaactttcgcagaatccaccttaaaatctctgccttaaactgcaccagcccccaaaaaatccaaggggggaaagcaggcggggggagagcagattcccccctccccctctcctctcccatccctcctkcttcctcctccctttgagttaacaaggccccgctcactatatctctttatattaaatatatatatatattagagaagagcgagggagagggagaaccacctccacccnnca

SEQ ID NO: 28909 - DNA, 239 bp, Homo sapiens
  misc_feature 122: w=a or t
  misc_feature 123: m=a or c
aataccacttttttcttaaaattaaaaagaaatgaaagttgccacaatcttcaaccctgcaagataagaacttttaatatccctttaaaacttttttctataccagagacacatatctatawmtatccactgatgtatctatatcaatacctaaaattatatataataattttacttcatgcagatcttcattgaaaagatagaatactgtgtccttggcttaggtactatgggtgacg

SEQ ID NO: 28910 - DNA, 258 bp, Homo sapiens
ctgccttcctttggattgcgtgttttgttggcttagtttttgctctcattgagagaaataatattgctttgccatagtaattgagtttaactactgacactttccatagtctaaaattaattgcttttaagaagaaatattagttgaggtttccaacgttagaccccctagagtttggcccacaaattgttttggtaggttataagatgggcctgctgcccaatactctcaatttcagctgccaccaaagaggaccta

SEQ ID NO: 28911 - DNA, 207 bp, Homo sapiens
tcaggttttcctccttcccgggtgctctgaagtttcaccatgaatcaccttgcaggggctctttttattttttattgatgcccagccagttgttgttgttgtctctttctctctttttgtttttttggagacagagtctcgttttgtggcccaggctggagtgcagttgtgtcattgcggctcactgcagcctgacctcccaggctc

SEQ ID NO: 28912 - DNA, 364 bp, Homo sapiens
  misc_feature 29: w=a or t
  misc_feature 216: k=g or t
  misc_feature 285: n=a, g, c or t
  misc_feature 286: n=a, g, c or t
tttagattctgttttgataagaggtatgwtctcagtcatcatttgtaggagacacgaagaaaacaaaagggaaaacattattgtaataggtagcactgaaagcagcagaaataaaatatagcgagccctgaatcctaaaagtttggctctaccaggccaggtactctgatggtaggaacagtgtgccaaatgaggaggtcttgccaataatattckgataatgtctaccatttattgttcttatacactaaaggacaacttacccaagaggcacagttaccaacnnaagaggcatacttgccatatccccagtaagtggtggagttgggattaattaggacccctatctgtctggcaacacatc

SEQ ID NO: 28913 - DNA, 61 bp, Homo sapiens
  misc_feature 17: w=a or t
  misc_feature 18: w=a or t
aaaaaaaaaaaaaaaawwaaaaaaaaaaaaaaaaaaaaaaaaaaaaaaaaaaaaaaaaaaa

SEQ ID NO: 28914 - DNA, 247 bp, Homo sapiens
tgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcac

SEQ ID NO: 28915 - DNA, 431 bp, Homo sapiens
  misc_feature 288: h=a or c or t
  misc_feature 289: n=a, g, c or t
  misc_feature 290: w=a or t
  misc_feature 333: v=a or c or g
  misc_feature 339: h=a or c or t
tatttatagagagagagagagagagccttaaaagcattgaagatctgacaagctagtaagaaactaccaagccagagaggtaaataagcaggaaggagctttagccctgaggacactatcaatcctgaaacactgacactgtccttggacagcctctgtggaagaaatggaaaacggcacccaggaactaagcaagctggggagtgccaagagagcccgcctccaaaaggctggtccctttcattctgctctctcagaatgaaaatgagttgcatgggagaaccctghnwattccctggtttgtctaggatcctcaaagacttcactttgctvtaagghggccccaggctggtgtggtagtgggtgtcatctggcagaaacaaggaagttacttgcattctgttccacaaatagaggaattcctacaagta

SEQ ID NO: 28916 - DNA, 82 bp, Homo sapiens
ttttattttttgagaaggaatctcgctcttttgcccaggctggagtgcaatggtgcgatctcggctcactgcaacctccgcc

SEQ ID NO: 28917 - DNA, 276 bp, Homo sapiens
ccatcagagaagattggtttgtttctttggtttgggcagataacttctaaattacgttgtaaaaacttaaggtaaaaacccttttctcctttaaaatatagattgattatatgtaaatgtgattttatgtactaatcagtcaccaaatatactagacagagaatgaatggagtcactttagcttttcaaaggagtttttatagccagttgcatgcgttggagctgtcgctattgctctgtgcctagatggatactctgcccagaactgcgaattgt

SEQ ID NO: 28918 - DNA, 190 bp, Homo sapiens
taaagccattgtatttcttttattaagagataatatttttatgtacagatacctttgtattaaattagtacccctaattagaatagacagatcaattgtacccccttttttcctggaacctacgttatttatggttttaccatttaaaccattgtcactatttggcagttctgtttaatagaggggcgat

SEQ ID NO: 28919 - DNA, 352 bp, Homo sapiens
tcttctagggtttttatggttttaggtctaacatgtaagtctttaatccatcttgaattaatttttgtgtaaggtgtaaggaagggatccagtttcagctttctacgtatggctagccagttttcccagcaccatttattaaatagggaatcctttccccattgcttgtttttgtcaggtttctcaaagatcagatagttatagatatgcggcattatttctgagggctctgttctgttccattgatctatatctctgttttggtaccagtaccatgctgtttcggttactgtagccttgtagtatagtttgaagtcaggtagcgtgatgcctccagctttgttcttttggc

SEQ ID NO: 28920 - DNA, 454 bp, Homo sapiens
caaattaagtgaccattaaaaacacagcaatcattcatactgctttcataggtgttatgatagtctctgattaatcaatctagtatgaattattttacaagtgttgtcctgtttcatatctttgaagtagtgaaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaatggcaacaccacgtctaaagcagtttcacagcatggtcccctacaatgttataccaaggctctgatgtatttcttttagtagtttctaagtgtaaaatttattctaaatgtttttatggctattatctatttcatcagttattgaatta

SEQ ID NO: 28921 - DNA, 91 bp, Homo sapiens
  misc_feature 87: k=g or t
aactttactcctcgaaagggtgctcacagatgtcatgtactgaatagctcccttttaaatgatcatttattttcatcaaagcctgtkctct

SEQ ID NO: 28922 - DNA, 197 bp, Homo sapiens
tgattgattttgttgctttcttgatttttttttttcaaaatgggtttactaaaatgtagatgacttaactgcctcctccttcgtctgaaaaatgccaatattcaatcatcatgcagcattataacaagccttataagtcctaaagcattaagttgcacttttttgaggaggggtagtgcagtatttctctggcctat

SEQ ID NO: 28923 - DNA, 240 bp, Homo sapiens
cttacataaaaatatggagaattagcatattcacatatctattttgtgatgtttatcatacggaagttttaaaatatagtaaattcagtctttccatttttttttgtttatttaagaaccattccctagctagggtcatgaatacattcttatgaattattaatcccatatggatagctagtttccctagcacctttaaaaaatagtttattattttcctcctgatgtataaggccacca

SEQ ID NO: 28924 - DNA, 124 bp, Homo sapiens
cagtggtgcaagacttaaaaaatccttcacatttatttagaagtttctgttatcagcagaatgatttcatgtttttatgatttttatttggaaccatcatcagttcctttttttttttttttaa

SEQ ID NO: 28925 - DNA, 140 bp, Homo sapiens
ataatgagtgtaaaagtgttcctgtttcttcacatcctctccagcatctgttgtttcctgactttttaatgattgccattctaattggtgtgagatggtatctcattgtggttttgatttgcatttatctgacgaccagt

SEQ ID NO: 28926 - DNA, 71 bp, Homo sapiens
  misc_feature 1: k=g or t
ktggagatggggtttcagcatgttggccaggctggtctcgaactcctgacctcaggtaacgtgcctgcctc

SEQ ID NO: 28927 - DNA, 230 bp, Homo sapiens
ctacaggaaggaaaagtgtgacagctttgaaaaagaaagagggtaaaatattttaaccacccttggtgtcatttgtggcagcctatagcattagagcctttgagaacagatctttccagattctgcttaagtccagggattctgtgaccgcagaaatgactggcatctccatctgctcgtgcatctgtttgtttcttccttcattgattcactcattccccccgccctgc

SEQ ID NO: 28928 - DNA, 205 bp, Homo sapiens
tattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccacgt

SEQ ID NO: 28929 - DNA, 218 bp, Homo sapiens
caaattaagattatgcttattttgtacagaaaacaatgtttaaacacaagcagatctgttgtatgtaataagtaacacagagttttaaaacaaattaattatttagctttattgaagtttgtttttttccttccgaacctggagtatcatattataaacagcagtttcacaccagaatagcagtgccctttctttttgtacatactgattggacctac

SEQ ID NO: 28930 - DNA, 191 bp, Homo sapiens
tttgaatctttgtaaaaattgatattctgtataacagagtgcctctctgttacttttggcctatgttgttagaaataagatgctatcttgcatagttagaattaagcgtttgtccatctctagataacattgaaaagtttgagtgttacaggctctaaagtgcaatggagaacaattgcttaggaggagcc

SEQ ID NO: 28931 - DNA, 227 bp, Homo sapiens
tatgggaaagatgggcatctctattatatattcaaagacatttgatatgctataggaaaattaattaattaattaattaatttttttgagacagagtctcgctctgtcacccaggttggagtgcagtggcgatctcagctcactgcaacctccatctcctgagttcaagcgattctccttcctcagcctcccgagtagctgggattgcacccaccaccacacctgga

SEQ ID NO: 28932 - DNA, 81 bp, Homo sapiens
ccacactgccctcaaacagctgaagggtactgtgtgcgatcaggagaaaactgctggtgtacagcttctgcaaacagccct

SEQ ID NO: 28933 - DNA, 248 bp, Homo sapiens
  misc_feature 80: r=a or g
  misc_feature 104: r=a or g
  misc_feature 105: r=a or g
atttttagggagagacacttatgaaatggggctggtggaaaggggccccgcagaactacaatgtatgataatcgagtatraatttcatcaatggagagtagatrrataaaggcacttgatagcctgctgctatttgtttgtaagaaattaaaactagcgcgtggtgagctgggttatctctcgaaaactcatgtagatgcctgattgagtcataaggacaaaagggtgttttgcctttgcctgtggaa

SEQ ID NO: 28934 - DNA, 98 bp, Homo sapiens
  misc_feature 8: r=a or g
  misc_feature 82: k=g or t
  misc_feature 97: k=g or t
  misc_feature 98: k=g or t
tatttcaratttcagccaaaaataatcacttgagctcttagtaggtgacagttggattaaggacattgggactgtatctggktcaaatcagggcgtkk

SEQ ID NO: 28935 - DNA, 145 bp, Homo sapiens
attttttctcgacaataaagatattccgtgtcttcacccctgaactaagacacagggagtatttcagaggccagcgtaggagtcatcgacaacgaaaagccgagaacccagggccagcagtggagcctcagcagaccaggggccc

SEQ ID NO: 28936 - DNA, 179 bp, Homo sapiens
tgttcaattgttcaatacgtatttaccgaatacccaccatgactaatgcattgtgctacgcactgtgggtggtgaagaaataaaatagttcctacccttgggactcttctgacccacagggaggagagagaaccacagtacagctcggcatgtgtttgaagtcagaagaatggggccat

SEQ ID NO: 28937 - DNA, 205 bp, Homo sapiens
cattttccttctgcgttaggagagactggggtagcattagtgtactgagcacccgctccaaatttcgactgcccagagcttgaagactcatttccagaagataactcacgccagctacgatttcttctaccataatttggatatttacgcctacatgtcctttgtctagactgtgataccaaaaccactgaatccgacggaagac

SEQ ID NO: 28938 - DNA, 381 bp, Homo sapiens
  misc_feature 296: h=a or c or t
tttgtaatttctttttcttttttgagacacagtctcgctttgtcacccaggctggagtgcagtggcatgatcttggctcactgcaacctctgcctcctgtgttcaagcaattctcctgcctcagcctcccaagtagctgggattacaggaatacacccccacactcagctaatttttgtatttttggtagagatgggggtttcgctatgttggctaggctggtctcgaactcctgacttcaagtgatccgcccactttggcctcccaaagtggtgggattacaggcataagccachgtgcccagcccatagtatgattacaaataatatgtaattacaaaagcttatgaaattattaaaaattcttaaacttctagagtta

SEQ ID NO: 28939 - DNA, 121 bp, Homo sapiens
  misc_feature 42: s=g or c
  misc_feature 85: w=a or t
caaaatctcccaaaaaattaggtctgtgtagttttaaggaasaagttctagaatgacattctactctatttctttatataaaaawttgcactggtttcacgtatacatgttctgtgacccc

SEQ ID NO: 28940 - DNA, 113 bp, Homo sapiens
  misc_feature 82: k=g or t
  misc_feature 86: w=a or t
  misc_feature 87: m=a or c
  misc_feature 89: k=g or t
ttcttttttgttcagaccgatacccaagtaatgagattactggatcaaatggtaatactattttcagttttttggaaaatckctawmckgttttaatagtttgcacccccact

SEQ ID NO: 28941 - DNA, 316 bp, Homo sapiens
  misc_feature 167: h=a or c or t
  misc_feature 168: h=a or c or t
  misc_feature 275: h=a or c or t
  misc_feature 276: b=c or g or t
  misc_feature 277: v=a or c or g
catgaacatacagaaggcaacaatagacactggagactaccagagtgggaagggaaggaggagggcatggttgaaaaagtaactattgggtgctatgctcactacctgggcgacaggatcgatcacatcccaaccctcagcatcatgcaaatactgaggtaacaaahhtgcatacataacctttgaatctacaataaatattaaaattatttttaaaaagaaaagatgaattaaaaagataataataaaaattgctgaatatttggaattgaathbvccacacctcaatatttacaacatataaccaagtgttaca

SEQ ID NO: 28942 - DNA, 236 bp, Homo sapiens
ttgtcagatatctttgttttagaaagtgactgctaatgttgggctagtactagagagaattttctgttatgtacattttatttagatttgacaagctttgggtcagtaatttcgttacgggtaggcactaatttttcaaagctttgggataagtaggggcagcaagagaaactagaagttgttttatggtccccttagatttcttcatctctgattgttagttattaatggccaaa

SEQ ID NO: 28943 - DNA, 181 bp, Homo sapiens
caaattccccccaatctcacttagctgtcactcactttttttcctccttctctcatcttcactccctctccctgtgatatcaatgcaggggttaaaaaacccggaaaactgtgagagcaacaaggcacagttatttctcccagacaggccctgtgtcactttcataaatcaaacccagacc

SEQ ID NO: 28944 - DNA, 167 bp, Homo sapiens
aaaaaaggcaagggttgcaatcctagtctgtgataaaacagactttaaaccaacaaagataaaaaaagactcaagaagggcattacataatggtaaagggatcaatgcaacaagaagagctaactatcttaaatatataggcacccaatacaggagcacccagcttt

SEQ ID NO: 28945 - DNA, 126 bp, Homo sapiens
ttcttagattccaaaagtatagtactaattgtaaagcaaaagttgataaaattaagaacttttattcatcaaagtataccattaagagggtgacaaggcaagctgcctgtaaccaataggggtcca

SEQ ID NO: 28946 - DNA, 154 bp, Homo sapiens
atctgtaacaaagctgcacctcgtgggcggagttgtgctctgtggctgcgaaagtccagcttcggcgactaggtgtgagtgagccagtatcccaggaggagcaagtggcacgtcttcggacctaggctgcccctgccgtcatgtcgcaaggggg

SEQ ID NO: 28947 - DNA, 141 bp, Homo sapiens
aataagtcctgaataaactgcttctagatgtattaaacacccagcaacatttggcctgtcatttactggaattacaattgcttcacagtctcgcttttttctgtgctctcagaacaatgccttgttgtacttccagccctc

SEQ ID NO: 28948 - DNA, 133 bp, Homo sapiens
gaatcaggggttagtcacccttgaaacagtttgcagttctataccatgcccaaatggctcaagccaatggccaaagctaagaacttctggatgtctcccccgctagcagattgtactccctgctttcccactc

SEQ ID NO: 28949 - DNA, 165 bp, Homo sapiens
aaatattcaatgaagcagcaaatctgctcacatttttattaacatatatttttgaagaaacaaagcaagtctacaggcataaaacaatgttatgtctatatgtcatgtatatgcaggtattgaatcaggactaaaatatctctgatattctatgacaccaccact

SEQ ID NO: 28950 - DNA, 199 bp, Homo sapiens
gaccataacagtccgtggaggtaagtaggggagctgttagtaatcccattttatagatagcataactaaggcccagagaagtttttttttaactcttcttttacagaaaagtttaagtgatattcacaaattccaatttgtgggagatccagtaaaaatccatgcagtgtgactgaagagcttgaaaaaggaggagatt

SEQ ID NO: 28951 - DNA, 471 bp, Homo sapiens
  misc_feature 352: m=a or c
  misc_feature 457: y=c or t
ctatatatcaagagtttagaaatattctcctctattatgctaatcatgtatgaattaattttatgcatttaagtctctaatgcatttaaaatttacttcagtattttatgagaaaatgtcatgttttctccagaatatttagcaaaactccaactatctactccacatatatcttgaaaatctcagagacaccccaaactcagatcttcttctcctttccttctttaaatatctgctagctcatcaaatggcattaccatcactcccagtcattctggccagaaactgggtaaccattttgatatcatctgatatggctaagctttgtgttcccacccaaatctcatcttgmattggaatccccataatccccacatgtcaagggagaggccaggtggaggtaattggatcgtgggggcagtttccttcatgctgttctcatgatagtgagtgagtyctcatgagatctga

SEQ ID NO: 28952 - DNA, 201 bp, Homo sapiens
aaaagcagaggtttgataagcccctgtatgctgcggcctgtcctcttggaatcctgagaccattgtactgtgaagaagcccaggataaaaggccacatggagagggaggcctagtcctgccagctgtcccagtgaagtcactcccagcgacccgacagctgactgttgctgcatgagtgaccccagcaaaataactgccaa

SEQ ID NO: 28953 - DNA, 233 bp, Homo sapiens
aaacacaacttctgagctcaaagacatcatttaaaataaaaatagagattattttgttactgactaggataactacatatgtttattttttctgtcaaacacatagcaatcaggaaatattgaaattattttcattaaacctcacataatttttgcaatacagtattgaacttgcttatattaattagctgattacaagtccatttcttacaaaatatattaggccaaagccc

SEQ ID NO: 28954 - DNA, 301 bp, Homo sapiens
acacctggatgtgctcactcaaccaagaatatagagaaagagcttctgccctgagactcagaaaaatattctcctgtgctttggttcagtatagatttctaaaccctgatcattgcttaagagatattcactgagggtcctacgtctctgcaatttgtgtatgaataacagaataatttccctcttttgtttcgcctttcctgttcctgaatctaaataaagatggctttttagtattaaaagtggaagaaaattacaggtaattatctttgacggtaaaaacgctgtaatcagcgggccg

SEQ ID NO: 28955 - DNA, 77 bp, Homo sapiens
  misc_feature 39: y=c or t
atttaggagtgaatgtgttcctcttgcaatattatcagyacctgcatgacttggtaaattcattttataaaaatagt

SEQ ID NO: 28956 - DNA, 363 bp, Homo sapiens
aaataacctctattactatcattttaatctttgaacagtgacaaaatatcccacctgctttgtgacttttctgaaaagaatacatggtcacagggtattctctattggaataccattcacaccttcaaacttatcaccatccagttaaatttgaggaatggtaattgatgaccttaagtgagtcaagtcacaattacctgaagaactaaaaatgctactggaaggactagactctaagttggtacctaactaattcttattgcctgaatgtggttgtagagtagacccttcattaggaagtgaataggggaagtatgaaaaattaaatgtgtacaaaatccaaagcttcctgataggtctttt

SEQ ID NO: 28957 - DNA, 441 bp, Homo sapiens
gggattcaaggaggcccatcatgtcagaatgctgtgggttggcaggaggcatcacaatgaaattttccatgttcccaaatttgatattcacagtactacatataatttctcagggaagatagggttggacacgatggaaatattttggtgaaccattcgttcccttgggtttctttctcatttggggagtgtggtttacaatgattggagcaaaagtttcctgaatctttttcttgtttccattttattgcatggtaaaacacaatttatccactttcttgtcaatgagtatctagttagattcctgttttttggctaattcaaataaaactatgaatgtttttgtaccggtcttttggtgggcagttgctttcctttctcttgggtacatacctaggaaggagggaagttgctgggccacagcatggccagttttctaaa

SEQ ID NO: 28958 - DNA, 118 bp, Homo sapiens
tggtctgacacgaagttgcttgacgggaatactcattgatttacggtatagggtatgaattgtggtgtccagcatatggcattttatggctacttggcatcagttcatctggaagcgg

SEQ ID NO: 28959 - DNA, 202 bp, Homo sapiens
  misc_feature 156: m=a or c
ttgggtgtatgcccagtaatagtattgctgggtcaaatggtatttctgcttctaggtctttgaggaatctccacactctcttccacaatgcttgaaataatttacaatcccaccaacagtgtaaaagtgttcccttttctccacaacctcaccagmatctgtttttatttcttttttactttttattaatagacattgtaat

SEQ ID NO: 28960 - DNA, 161 bp, Homo sapiens
ttttacataggggagcactgaggcccagagaggcaaagtgatttgtcagggggtcacacagctgactcgggagccaagctcccaacacctatgcatcactgcctctgtggggttccctcggcctctccatgggccccttcctcctcccatcgcccacccac

SEQ ID NO: 28961 - DNA, 449 bp, Homo sapiens
  misc_feature 122: n=a, g, c or t
  misc_feature 388: k=g or t
  misc_feature 389: n=a, g, c or t
atgtttcttcatttgctatatgctcttaggaccatttccagaaatttttaattataatattcaccaatttcattgagtggtaggtctgtggagctcctcacactgtcatgctagaagcaaanctccaggcagattgtttttaaagttttatcaagttacaagatgataactaatttaagaaaggaattcgagctgtacattgtcttagattcttagaaacattaaaaaaggctcttttttttatttcttatctccccaccaccaaaataaacaccctgctatacatttcagatttcctattaatggcatctctgcccttccatttgttcagtccaggtatcctagatttatccttgactcctcacttacctcacatttgacagcaaaknctactaccttgaaagtatgtctagaatctgacctcttctccttgcctcctccattgctca

SEQ ID NO: 28962 - DNA, 439 bp, Homo sapiens
  misc_feature 319: n=a, g, c or t
  misc_feature 369: r=a or g
  misc_feature 373: n=a, g, c or t
  misc_feature 412: d=a or g or t
tagataagtgtattttaattttttcccctcgtatacttttatttacctggggaaggagcttttagggttggggggtggtttgctatctctttagctagcagaatagtgtgcctttgatcctcacacatcctgtattatggacacagtagccatgcttcacggggaggtcagagctggctaccagcagtcttgccctttactgagcttagtgtcatctttggatgctgtcatatgctgctttgagtgaaccagagaaacagccatttgcagcatgagaaagccccaaaagctctgggatttacctccactttagtaatantgaatattttttagcattagaatgtgttatgtcatttgaattaattttgrctangctttggcttgggagaggaattattttaaatagacattdgtactttttgaacttgatagctaaaga

SEQ ID NO: 28963 - DNA, 111 bp, Homo sapiens
tactctgtcagccacactggagtacagtgacgccatctcagctcactgcaacctctgcactccggcctgggcgacagagggagactccatctcaaaaaaaaaaaaggaaaa

SEQ ID NO: 28964 - DNA, 216 bp, Homo sapiens
tatatttgataatttgaaagacaaaacctatggtggttggcaacttgttttgcatgtagcgaccatttgctcttctcttttggagtcatagctaagatgcaagagagaaagatgcccttggctagtgttttgggtgtaaggattgggttctgctacctctagcttcttgattacatgacagcaacacaaggagcccacagttccagaagagccgga

SEQ ID NO: 28965 - DNA, 164 bp, Homo sapiens
agactactgacttggaccagcaggggaatggctgtgacaataaataagattgggaaaacaagaagataagggcctcgctctgttacccaggctggagtgctgtggtgtgtttgtgactcaccgtagccttgaactcctgggctcaagcaatcctcccacctact

SEQ ID NO: 28966 - DNA, 391 bp, Homo sapiens
  misc_feature 227: n=a, g, c or t
  misc_feature 228: v=a or c or g
  misc_feature 325: v=a or c or g
  misc_feature 327: s=g or c
tttccctttctttgatgtctcagtgtgtgtcccaaacacctgcatctcatggactgtttgtgcccatgcccagttcctggcatgccaggccctgggcttcaggtgcacaactgactctctttttcactccctaggggaaccccctcggaaggggaagggttgggtgctgacgggcaggagcacaaagaagacacattcgatgtgttccgacagaggatgatgcaganvtacagacacaagcgggccaacaaatagttccagggtcacccccgagaggacaacaggcatctggaagtgctctctcgccactctgggtgctttactvgsctctggcttgtttccatcactggaaatcacttagagaattgtagtgtttttggtccttgataaa

SEQ ID NO: 28967 - DNA, 115 bp, Homo sapiens
cccatcattctttggtgtttatatagtttaactttctcctttattttacttttagcctgtccatgttattatatttaaagtgcatttcttgaagtcattgcatagtagggccgta

SEQ ID NO: 28968 - DNA, 188 bp, Homo sapiens
tcctctaagatctagaacacggcaaggatgcccacttccacattgttattcaacatagcagtggaagtcctatctagagcaatcagacaatagaaataaaggagatccaaattggaaaggaagaagtcaaattatccttgtttgcagatgatatcctatatttggaaaaccctaaagactccatacac

SEQ ID NO: 28969 - DNA, 159 bp, Homo sapiens
ttcaaaggtcaacacagactagcaaccactaagctaatgcctaatcaggaaacagtcctttgactagatgaagatctaggatgaaactccgtttcacaaatcatatacctaatctgttccagcttacacaggcactcctggcctcactaacaagagcgc

SEQ ID NO: 28970 - DNA, 421 bp, Homo sapiens
  misc_feature 201: w=a or t
  misc_feature 202: m=a or c
  misc_feature 350: v=a or c or g
aaattaccacaaacttaagacttaataacacagatttcttttagagttctgtgggtaagaagtctgaaatggatttcactactctaaattcaaggttgtctgtagggctacatttctttccaaaggttctctaggggagaatttatttccttggatttctcagcttttagaggttgcccatgttccttgactagtagatcwmtccctccacttttcgtttgagtcagtatctctgtcacccaggctggaatgcagtggcaccatccttagcacacagcagcctcaaattcctgggccctaggcaactgaccctcccacctcggcctctccagtggctgggactatgggavgttgccatcacacccagccaattgtaaaatgtttatccttttgtagagacaagattgtattgtgttgtcca

SEQ ID NO: 28971 - DNA, 111 bp, Homo sapiens
tgtggtctctgcacttaggcattgagagtctagttggtatacacgttgctatggaatttgaataaaagggagaatgctcaaatgctttttacctttattttcccccatcag

SEQ ID NO: 28972 - DNA, 416 bp, Homo sapiens
  misc_feature 349: w=a or t
  misc_feature 361: k=g or t
taagtttttagtgattataaaatggccatttgctcagcctgtctgatcctgactacaatgatgacaggaaaccatgtggcaccatgacattgagctgatcttcaggacgtgatgacaagtatattgtctgtgctaaaatggatttggtagattgcataacttgagccatgaggcctgtcgttctgcatactgatggttttggtaggtttggagatgagtatatctgttagcaatggaaaataattctttttttatttttattttttatttttatttttgagacagagtatcgccctgtcgcccaggctggagtaaagtggtgcgatctcggctcactgcaagctccgcwtcctgggatcakgccattctcctgcctcagcctcccaagtagctgggaatacaggcgcccaccatcc

SEQ ID NO: 28973 - DNA, 333 bp, Homo sapiens
  misc_feature 295: n=a, g, c or t
cttgactttctgggccagatttaatgaaacccaactagaaaatatatttaaatccagtgaactttcttgcttggggattattatccttgtctagattccccacagatgcaagaaggtctgtctatactttgtgttctgttttagtacttttgatagtagttacatttccccctcacttattcccacagttcagctgctatgcaaactgagaaggaccaaaggtattcttagataaaataagtagtagtatttacagcacttttgaatctgggagaaagtgaagtacagacagatnggtaaacaaagaactgtgaatcttagatggccccaccg

SEQ ID NO: 28974 - DNA, 326 bp, Homo sapiens
ttaagtcatatgtgattggtacttcacatactattagagaagccaatttagtgaattttacagagcacagaacatcacatacttaaatataatatggccatattacatgatgacatttaattattcagtttcttgataaccaaactatattagaatttaattaaaatatattattgagaagctaaagtttgaatatatctgtggcaatgattttcatatgttaatatttcttagtctgtgctggcaggtgactgagtacttgctgtcatatcatgcttatgtgacttgttatatgtgctttgcatgatggagttgcacatggccta

SEQ ID NO: 28975 - DNA, 403 bp, Homo sapiens
  misc_feature 56: r=a or g
  misc_feature 254: w=a or t
  misc_feature 255: n=a, g, c or t
  misc_feature 271: n=a, g, c or t
  misc_feature 332: h=a or c or t
  misc_feature 358: v=a or c or g
acagcacagagaaaagagaaatcaagcaaattatctgcattcttttaaaattattrttttttttcttttgaggtgaacacttcaaagtttatttacatgttctgttttctcttttaagaatccaagtttcccaaattaaatgtttctaatattactatatatgcctaaaaaaagaaaaaaaaagggcttttaaaatcagggcaagggagaagagataaaaagtcatcaaattagtcctcttagctccaaatgawntgaaattaagaacaanattgttggtttccaataggagtttcgttccattttccagcacatacagtcagctcagtcthagcgtagaccctcagaactgttagcvcaacatatagtgaccattgttcaccatgttaaagagcatcacttt

SEQ ID NO: 28976 - DNA, 119 bp, Homo sapiens
atcatcggtgacatcaagacgaccatcgtcagcacacccacggggtcctgtggatgactcctggctgcaggtgcagagcgtcccggtcggacgcaggtcgcccaagtccagccccacat

SEQ ID NO: 28977 - DNA, 89 bp, Homo sapiens
  misc_feature 23: s=g or c
tcttcgagggctatgtaaatggsacacctggtcaaaccaatcccttgggctctatgtaaatcaaataccacctcttcaaaccccctcgc

SEQ ID NO: 28978 - DNA, 124 bp, Homo sapiens
taagcagtagtttttttgttgtttatttttaatgaaacagctgtgttaaggcgctgcttcagatgcaagttcacctggaaatactggtcagcgggcagcacgtcaaggtcacttaagcccacga

SEQ ID NO: 28979 - DNA, 228 bp, Homo sapiens
tattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggc

SEQ ID NO: 28980 - DNA, 245 bp, Homo sapiens
gggtttacttcttttaaactaggaggtgatttaagatgtaaattttagacagtcaagccatctggtgagagagtaccagaggagatcaatcagttctctaggcgaggagctagggcctgtcctgggctgtcaccctgaggttggcagtggtgggccaggatacgtatgagaaacaaagcggaagtaaactggtcagaaagtgacttagagacgaaggcgtgtgtattcctttgtgtgggtggccc

SEQ ID NO: 28981 - DNA, 193 bp, Homo sapiens
tgattataattttagttctttctaggtaacatttatctcctatgtatatatttaattagaaatcattctgtataactcagtcaaacattaactcttgaaaatacctgagtgataaatttttataggcaacaatgacagtaggattatcagctgaaaaagagagactattttgaaaaggaagggaatggaacgt

SEQ ID NO: 28982 - DNA, 357 bp, Homo sapiens
agttctgtttctcagaattgcttttgcaaaatggtgttttggattataattgtgctatttaatttttctaattaaaatttctaaatagagcctattaaatattggatgcttatgatagaacatttgaaaatatagaaaaccaaatgacctacaaaacctctaccttccagtaccatcattccgagctgattactgttaacattttaatggtttttgtccgctaggtctccttgatgagtttcacctgaggaaaaggactccttcaggtgtgtgaacttgagccaccaggtccaaccccattggcaggtgctggtacagacgactgaaatcagaggaagatcagaaatcttcaaaacc

SEQ ID NO: 28983 - DNA, 228 bp, Homo sapiens
cttctttgtctcctagcaacggcggggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggcccaa

SEQ ID NO: 28984 - DNA, 134 bp, Homo sapiens
actgttaacactatcacagttatttttcattttaatggtgacgccagctttagccatccacggcacttactgcaagttggtgcatctaaggatgggaactgtgtggccacacagatgaggatgccactgtttcc

SEQ ID NO: 28985 - DNA, 206 bp, Homo sapiens
  misc_feature 76: r=a or g
cattatatgatatcgacatgacttaattgctggtgaagttagccttgatcacctggttaaggtagtgtcttccagrcccctccactacttttctagtgactattttttgaagttactatttttccctttccatactttattctctggaaatgagtcactgagttcagcccatatggtttttttctgaaccctcccccactgccccc

SEQ ID NO: 28986 - DNA, 177 bp, Homo sapiens
cgaaaaaacaactattttgctaaattggaggtcccccaaacagtttctttctcatggaccatttgtagaccatgactgaaagttttgttaacttgactattaataattccttacctttctgtatgtgtatctttcctctaacttggttcattgcatctcaaatgtatgtgtggcgga

SEQ ID NO: 28987 - DNA, 372 bp, Homo sapiens
  misc_feature 23: k=g or t
  misc_feature 86: k=g or t
  misc_feature 201: d=a or g or t
  misc_feature 221: s=g or c
  misc_feature 222: m=a or c
  misc_feature 223: n=a, g, c or t
  misc_feature 350: n=a, g, c or t
ccttttttttcttgacatgttgkttatttccttttctccccttaccataatggatgctctgtgaaaacaagggctttgttttatcktgttttatttactgctacatctgccatcaccgagaacagtatgtgtagcaggcttacaagaaatacttgtggccgggcgcggtggctcacgcctgtaatcccagcactttgggadgccgaggcgggcggatcacsmngtcaggagatcgagaccatcccggctaaaacggtgaaaccccgtctctactaaaaatacaaaaaattagccgggcgtagtggcgggcacctgtagtcccagctacttgggaggctgaggcaggagantggcgtgaacccgggaggcgga

SEQ ID NO: 28988 - DNA, 387 bp, Homo sapiens
  misc_feature 316: s=g or c
ccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggttttcaattggaattgagcatctctgtatgtggggatgtgggsccttatcaagggataaaaatccaaacactctaacatgcctccttgactgtaaagtaatgacactggttcac

SEQ ID NO: 28989 - DNA, 199 bp, Homo sapiens
acaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcacctacc

SEQ ID NO: 28990 - DNA, 175 bp, Homo sapiens
tatgtatactttaatttttatttttactttttttgagacggagtctcactgtgttgctcaggctggagtgtagtagaatgatcacgactcactgcaaccttgacttcccaggctctgatgcttctcccacctcagcctgctgagtagcttggactacaggcatgcaccaccccaa

SEQ ID NO: 28991 - DNA, 133 bp, Homo sapiens
taaagaagcaaaggaatattttgctgatatggaaaggcatcgcatcttgtttagatatgctggtcctgaagatgatgctgccattaccttggtaattaagttaattttttaaaagcttttgttagccatcccc

SEQ ID NO: 28992 - DNA, 379 bp, Homo sapiens
  misc_feature 331: h=a or c or t
  misc_feature 332: h=a or c or t
  misc_feature 360: b=c or g or t
tgtgccctgttgtcacatctgcccaggtgttcaggtattactctttggtaccctgtatgatggaacaataagcactgttttggaattgtctgtttacttgtctatcttctagattagattgttaccaactcaaaatccctagcacctgacatgatgcccaacagaagctagatgttctggtcagtaaatgccttttgaatgaacgagaataagcaaatgttggcccgggcacggtggctcacgcctgtaatctcagcactttgggaggccgaggcaggtggatcacctgaggtcaggagttcaagaccagcctggccaacctggtgaaachhgtctctactaaaaaatacaaaaattagbcaggtgtgcagggcgcagt

SEQ ID NO: 28993 - DNA, 307 bp, Homo sapiens
  misc_feature 95: w=a or t
  misc_feature 151: r=a or g
  misc_feature 296: v=a or c or g
  misc_feature 297: k=g or t
cctttttaagatctctggttgggggtatctggatatggattaggagggacaaggagcctttttcttggctaatgttttccaatacttttttggawtggtgccagcccctccaggcatcccacccccaaatcatcatctttagtactaacarggtgtctggtcttagaagcctcccttcagatcccagctgaccctggtgactgcctggccttgatgttggctgcagccttctgatagaaccacatggattccacccacagctggccaggcttgttacatgggtcagggaatacaavkggccccccga

SEQ ID NO: 28994 - DNA, 198 bp, Homo sapiens
agttgtgcgattatctttccatgcagacttgtcctctttctgaggctgtccagcgcctgggggcagtaggacgggtccgggaactaagccccatctcaaacacgtcggagtggctttctttgggggccaaggcccgagcctgaggcgggactccatgaggcctctggggcgcgagcggtttgactagggggggcctcc

SEQ ID NO: 28995 - DNA, 203 bp, Homo sapiens
ttattggtgaattactgaaaatagacccactgtcccaaagtattttacacagtatttaatgttgtacatcacattggaaggacactttgaaaactaatatttagtgttccttaaaattttctaatttctctttactcacctaacactttatattcatcataagtgattaggaaacaacaattccacttaacagatgaggaccg

SEQ ID NO: 28996 - DNA, 122 bp, Homo sapiens
  misc_feature 109: d=a or g or t
ccatctttaccaatctcaggcacaactggtcttcaacaaaaaattttgctaactctcctttattgaatatttccaaagcagcttacatttcttttttcttttttctttdttttttttttttt

SEQ ID NO: 28997 - DNA, 122 bp, Homo sapiens
tttacaaatgggggatgaaagcagagcatataactgacttgccttcattgatagaactagaggtgagtggagccatgatttgattccatccattctgattcagggcttgcactttgaccaac

SEQ ID NO: 28998 - DNA, 144 bp, Homo sapiens
gcatttaaaatctattttctctgaagcctgctgcagggaggcttcatttgtgtgataaaacctagatctcctggaccccgtatcttaactcagatactcccttctattgattccaggtctttagatgaactctttcaaccaatt

SEQ ID NO: 28999 - DNA, 124 bp, Homo sapiens
  misc_feature 15: s=g or c
  misc_feature 17: m=a or c
  misc_feature 18: w=a or t
  misc_feature 82: s=g or c
  misc_feature 84: w=a or t
  misc_feature 116: s=g or c
aactgaaagcgctgsamwaccaggagaaaatagtctttcaaaaggtagggcaccatcaacaccttcgcgacaggattaagastwtctagattcccaaaggtccaggctgataggtsggaggagc

SEQ ID NO: 29000 - DNA, 210 bp, Homo sapiens
cacgttaaagtaaaaagtaggacagagaatactagaggctgcaaagggtagagggaagggagggatagggagatatttattaaaggatataaaattatagctagataggaagaaaaaactcaagtagtctataccactataggatgactatagttaacaatatatagtttcaaatagctaaaaagaaggtattgactgatcctaaccaca

SEQ ID NO: 29001 - DNA, 363 bp, Homo sapiens
cttcaacttgtattttaagttcaggggcacatgtgcaggatatgcaggtttgttacatgggtaaacatgtgcaatggtgatttgctgcacccatcaacccatcacctaggtattaagcccagcatctattagctgttcttcttgatgttatccctcccctgacacctcaccggcaggacccagtgtgtgtttccccctcatgggtctcatcattcagctcccacttaacaagtgaaaacatgtggtgtttgtttttctgctcctgcattagtttgctgaggataatggctccatccatgtctctgcaaaggacgtgatcttgttcctttttatggctgtatagtatttcatggcatatgtgta

SEQ ID NO: 29002 - DNA, 241 bp, Homo sapiens
  misc_feature 159: r=a or g
ttctaatctatgatattataattttatgaagctgtctttttagcttaaaatggatgaatatttgagatttgtggtgataatatataacattttatgaattgaaccagtggcttataatttttttttcgtgggtttggtatctttttagaagaaaattgraatttacctatcattctgatattaatcatattgatataatcagatactcctttgtaaaaaggataaactttcttaagctcca

SEQ ID NO: 29003 - DNA, 90 bp, Homo sapiens
  misc_feature 2: y=c or t
  misc_feature 31: w=a or t
  misc_feature 45: w=a or t
  misc_feature 52: y=c or t
  misc_feature 76: y=c or t
aygggcagagagcgcgcgcggcgcagcagcwccagattcactgcwctccccygcagctccccgcgcccccgccgcygtcgctgcctcggt

SEQ ID NO: 29004 - DNA, 159 bp, Homo sapiens
  misc_feature 128: h=a or c or t
  misc_feature 131: w=a or t
atatgtggatattttttaagtggacttgtatgctgataattctagaccaaagtaaatatggcagaatatttatacatgaaaaaataattttgcaaatattttctataattgtattcatttaaaaatghtgwtagcttgtgttagtttcagggagggatg

SEQ ID NO: 29005 - DNA, 115 bp, Homo sapiens
ctaaaattttacttttttcttttgcttttttaaaatatggctactagaaaactttaggttacatatacagttcatctttgtggcttacattgtttatttttgtacaccgctgcta

SEQ ID NO: 29006 - DNA, 445 bp, Homo sapiens
  misc_feature 122: k=g or t
  misc_feature 129: m=a or c
  misc_feature 368: h=a or c or t
  misc_feature 390: w=a or t
  misc_feature 391: r=a or g
aacgtttctgaaatttggatgagtcatgcaattgatgtgctcatttaataaggttagtgtttatttttgtcctgaaaaaccattaagcaattaataatgcatctcacaatcagtgtcatcakaatatcmatgaaatatggtaagagcaaggccaaaggaagggttttcttactgggtggtgatcacaacgataaagaatcaggacaaaaagactgaagagatgtggtgataatgggatatgagctgagttggaaaagaactagccccaagatattagtcagcactttggaggggtgatgaatttgccatggtttaaagtacttctttgagtttacagcacccgactctgtgttctcagaccttatgthgtttgagaattgggctgatggwragtgtcaggagaatgatgtcagtcattctaaaatagtctcccaggtgctgatgc

SEQ ID NO: 29007 - DNA, 212 bp, Homo sapiens
  misc_feature 60: r=a or g
  misc_feature 63: r=a or g
  misc_feature 116: k=g or t
  misc_feature 123: r=a or g
  misc_feature 124: w=a or t
  misc_feature 128: y=c or t
  misc_feature 130: v=a or c or g
  misc_feature 145: s=g or c
  misc_feature 154: m=a or c
  misc_feature 161: r=a or g
cttgtcctaagcattcctctttctttattattattattattattattattattattattrttrttatactttaagttttagggtacatgtgcacaatgtgcaggttagttacatakgtatacrwgtgycvatgctggtgcgctgsacccactamctcatcrtctagcattaggtatgttgcccaatgctatccctcccccctacccccacgc

SEQ ID NO: 29008 - DNA, 365 bp, Homo sapiens
  misc_feature 113: r=a or g
  misc_feature 123: w=a or t
  misc_feature 331: n=a, g, c or t
  misc_feature 336: k=g or t
  misc_feature 343: w=a or t
cacttgaagaaactgttgctaaccaagctcttgactctgtttcccttaatgatacaagtctctgtaccagcgctttatgttaattaccaaaactctcctgcatcagagcatgrtatctataawaggagatactgcaataaaatgattaggctgtaaaatttggagacacaatttttcattacaatgcaatttgcatgtgcacatgtgcgcacataactttatatgttagttcttttttccaaactcccaactcttaaaagtattgtagtctgttggtgcctcaactgttggtaactttttttttttaaatttacaactttccacaacttgnttttkgtacttwaaggtttctcaattagaatatt

SEQ ID NO: 29009 - DNA, 241 bp, Homo sapiens
gtctgattgtgtggtcagttttagattatgtgctgtgtgcagttgaaaagaatgtatactttgttgttttggggtggagagttctgtagatgtctgttaggcctatttggtcaaatgttaaattcaggccctaaatatatctgctagtttcttgcctcaatgatttgtctaatactgtcagtaaggtgttgaagtcttccactattattgtgtggttagctaagtctcttcataggtctcc

SEQ ID NO: 29010 - DNA, 322 bp, Homo sapiens
gcagtgagtacattgttctgttgttccaccatctatgggatttattttctgtaggaagttagtaaccgaaataacctgtctacctcttcaagaacaaaaatttctccacctttttattcatcttctcaattattttaaagaatccagtatgttggttactttagaatacacactgagattgtcagctagcaaatatccatagcctgcatttaactacgggaaaaatagataaaaacattaagggtttgacctgcttggtgagcacgaagctcccactaggtgtttctcaccctctaaattaaaggcagggctccagtagaga

SEQ ID NO: 29011 - DNA, 307 bp, Homo sapiens
  misc_feature 118: r=a or g
cacagttggaatctaatcttgttggtttcccaacatctaggtttttgtttgtttgtttgtttttgtgatggggtcttgttctgttgaccaggctggagtacagtagtgtgatcatggrtcactgcagcctctacctcctgggctcaagtgatcctcccatctcggcctcctgagtagctgggactacaggcatgcaccaccacacctggctaatttttaaattttttatacagacagggtttcaccatgttgcccaggctggtctcgaactcctggactcaaactgatcctcctttctcggccaccg

SEQ ID NO: 29012 - DNA, 132 bp, Homo sapiens
  misc_feature 101: k=g or t
  misc_feature 104: n=a, g, c or t
aaaattctgtcaaacaactcaacgtccaaaaacatgattccggtgatttgtcacttaggtcacctagtttaaaaggagagtttgacacgacttcccctttkggnacacccacaccagccctttccccatccg

SEQ ID NO: 29013 - DNA, 265 bp, Homo sapiens
  misc_feature 41: w=a or t
  misc_feature 88: r=a or g
  misc_feature 100: y=c or t
  misc_feature 113: w=a or t
  misc_feature 140: m=a or c
  misc_feature 150: m=a or c
  misc_feature 173: h=a or c or t
  misc_feature 201: y=c or t
  misc_feature 202: y=c or t
  misc_feature 215: k=g or t
  misc_feature 216: y=c or t
  misc_feature 223: s=g or c
  misc_feature 224: s=g or c
  misc_feature 263: y=c or t
tacttgatttgcgatatgtattctgtccagcagtgatagawtaacaaggactgggtttaccttgctattttaagcaacaatatatgaratagcaatttgyaggcattgggtawcaggcaaagcaagactgtggtcactgmaagctgggamacaaacctactgagctctatgghtgccccaatttattatctggaggtagtyytcaggctgcagakyagggatssggaagtcaaacagagcatggtgtcttagaattgggaggyta

SEQ ID NO: 29014 - DNA, 394 bp, Homo sapiens
  misc_feature 239: d=a or g or t
tatagagagctgggcacagtgcctggtgactgtaattctaacaactcaggaggctgaggcaggaggatctcttgagtccaggagttcgaggatgcagtgagtcatgatcatgacactgcattccagtctgggaaacacagcaagaccccacttccaaaaaaacaaagttatatcaaagtacttaaaaagtactaataacaatgacccgctcactgacatgaaattgatttttaaccctdctcttgtcacagattcatctaagaagagtataggaaaaatagtcacactgaaataggaattgatttctttaattcaatcatagaagcatttgaaaataaaatgtatccagaaaaacacatggcatgatgaatttagcataaatgctgaagtgcta

SEQ ID NO: 29015 - DNA, 132 bp, Homo sapiens
  misc_feature 50: n=a, g, c or t
  misc_feature 51: n=a, g, c or t
  misc_feature 52: n=a, g, c or t
atgtattgagaactactctggggaagttgatttagcagtcttctcaagtnnngcacctgaatctgtcccacagatcattacaatattttagtcttcattacttctttcagtaggtttttactctctgcccac

SEQ ID NO: 29016 - DNA, 95 bp, Homo sapiens
  misc_feature 93: y=c or t
aaaaaccaaacactgcatgttctcactcatagggggaagttgaacaataaaagcacatgcacacaggaaggggatcatcacacaccgggggcytt

SEQ ID NO: 29017 - DNA, 183 bp, Homo sapiens
  misc_feature 52: n=a, g, c or t
  misc_feature 53: n=a, g, c or t
  misc_feature 95: w=a or t
  misc_feature 172: m=a or c
taaaatcagtggagaaagttaacttactcacaaaatggtattgtgatatctnnccagctgtttgggttggaatcttagcttattcattgtgtttwaatatattatggcttgattaagctataataaaaaatgaaaccagggtaacacacacacaggcacacgcgcgcgcacmcacacacacag

SEQ ID NO: 29018 - DNA, 86 bp, Homo sapiens
gtatactgcaattatctatatagtctcctgttgacgacatttgacatgtttccagtttaggcttaacctagttttttttttttttt

SEQ ID NO: 29019 - DNA, 412 bp, Homo sapiens
  misc_feature 89: r=a or g
  misc_feature 412: k=g or t
tgaaacctcctccttttttccaatgtttttgtgtattttcctctatcttatagtcaaaatatcttgtaataatgagatgagaatgggcrataaataaattgtgtttacatctaaggcagttagatgtttgacttgtcaccttggttgtttgtgccttgctctcttaccctgaactacctgtatcacctcatctctcctacatcttagccacactaaacctctcaaaactctttgtacctttctaagagcaagtaagtgctctgctttgcatggcttgaggacagtgacagtaccttattcttttttgtgttctaccttccactttttttagataccacttttcatagatatcttattttttttaatagtgcttgtcttttgtattacttatttacttgtctgccacccatgk

SEQ ID NO: 29020 - DNA, 105 bp, Homo sapiens
tctctaggatgacaccttgcctgaggcagactttgaagatgttctgaaaatgagggaaagagggatatttagcatgagatgaggcatcttcagacctgtgggcac

SEQ ID NO: 29021 - DNA, 287 bp, Homo sapiens
  misc_feature 95: w=a or t
  misc_feature 103: r=a or g
  misc_feature 137: d=a or g or t
  misc_feature 138: n=a, g, c or t
  misc_feature 200: h=a or c or t
ttgacattgttattgttaattaactaccattatcaccgcctgctttctagtgtctagatactttctggaatctagtgttatcttcagtcaaatgwtcattggrtgtgccctgtcatgagtgtgatattgcaaaaacdntctacattaaccactgcaaaagagcgatgtaaatttggctcactctaggagagcccatctchaccaaatgttgagatggaaaatggggaaacgacgttgtagtcagtttcctctagatcatgtcaaacattcaaagactgattatttat

SEQ ID NO: 29022 - DNA, 250 bp, Homo sapiens
  misc_feature 1: y=c or t
  misc_feature 2: n=a, g, c or t
  misc_feature 3: h=a or c or t
  misc_feature 4: n=a, g, c or t
  misc_feature 31: v=a or c or g
  misc_feature 32: n=a, g, c or t
  misc_feature 33: w=a or t
  misc_feature 98: n=a, g, c or t
  misc_feature 99: n=a, g, c or t
ynhnttttctgcttgaagttttcaacctcavnwtgcagataaaacgaaaagaatctgaatgggggttggggggcattgcactgttggaatcctaaacnngatgatatagaatttcctaatggtatgaattaaaaatatcagaagctgtagttgtataaatcacttttaaaactgcatttggcttatctgatgtttacctgtctaaaaagtgagaagactaattgactttgcttgatgtttaccaggaatg

SEQ ID NO: 29023 - DNA, 150 bp, Homo sapiens
gtgttcactattttctaagcattgttaaggacttgagattcagaagtaaatgaaacagataaaaagttctaccctcatggaatttatattctagtagaggaggaaataagtaaggaaaacttgcagaattttagattgtgataaaggcca

SEQ ID NO: 29024 - DNA, 206 bp, Homo sapiens
tgaatgcattccacagatggtgtgtagggctactgcatgcccagcaccgttctaggcggggagcaaagcggtaagtgagacacaaatcccaagccacgtggagaaagtgaccagccagtagatgcctgccatgtttttagagaggcgttctggttgtggaagcctctggaaaccttctcttgctcttcccccccaccccccgaccc

SEQ ID NO: 29025 - DNA, 157 bp, Homo sapiens
aagcttaggataaaaatgctcacgcttaatgtttctttctgtcttcatttttttaatgaaggctcccacgtcacatggcacttatattcaataaattttatgttttccctttgttaatttgtctcttttcagtctaatttacaaggccccggcaacc

SEQ ID NO: 29026 - DNA, 173 bp, Homo sapiens
tacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgcccaccgc

SEQ ID NO: 29027 - DNA, 55 bp, Homo sapiens
  misc_feature 40: r=a or g
ccttaaatgaccccagtccttgccttttcttacacatgaratgtctgatgggatt

SEQ ID NO: 29028 - DNA, 104 bp, Homo sapiens
atatactttattaaagacctagaggcagaggctctagaaggagcaggggtccccagccaccgggagattcccagctcccttctcgtgcttggattcgcgcacac

SEQ ID NO: 29029 - DNA, 170 bp, Homo sapiens
  misc_feature 51: v=a or c or g
  misc_feature 52: n=a, g, c or t
  misc_feature 53: n=a, g, c or t
  misc_feature 72: r=a or g
  misc_feature 89: s=g or c
  misc_feature 146: r=a or g
  misc_feature 147: m=a or c
  misc_feature 152: r=a or g
  misc_feature 153: r=a or g
  misc_feature 170: s=g or c
tttttacaccgcttcctcctcggaaaaagaagaattttttcttgaactggvnntgcaactaaagtccgttcrgagatccaaaaatctgsaatacagaggttatttgtaacccggcgtctccaggctggtgagcaagctgaggagarmaagarrgatggggaacggcaccs

SEQ ID NO: 29030 - DNA, 124 bp, Homo sapiens
  misc_feature 124: w=a or t
aaataattttttcttcttattgtgaaacaacaatcatagctataataagataatgatgtttcattcttttctctcaggactttaatttttggaagtgaataaaacttgttttagaagacgagaw

SEQ ID NO: 29031 - DNA, 214 bp, Homo sapiens
  misc_feature 129: m=a or c
  misc_feature 130: m=a or c
tctgagttcaaactagtgcctgtgttgttacggaaagcagcagtgtaccagtgtcactctggagtacagcgggagaaacacaaaatagtataactgagaacattaacattcagacacactcccttctgmmttccggcttaaagctgtggatgatccacgtttttgtttttttaatgttaaatgtgtaactcagtattactgaaaaggtacccac

SEQ ID NO: 29032 - DNA, 162 bp, Homo sapiens
tggttccacatctttgcaattgtgagttgtgctgctccagatatcatctttaactcctttgccttctccacatacatttccaagtcctgttcattctacctccaaaatgtatcttgtatccattcatctctctccatcttcaatctatttcaatgccccaac

SEQ ID NO: 29033 - DNA, 194 bp, Homo sapiens
  misc_feature 60: w=a or t
  misc_feature 80: y=c or t
  misc_feature 83: w=a or t
  misc_feature 88: y=c or t
  misc_feature 91: k=g or t
  misc_feature 100: w=a or t
  misc_feature 110: y=c or t
  misc_feature 130: k=g or t
  misc_feature 143: k=g or t
  misc_feature 144: d=a or g or t
  misc_feature 172: k=g or t
ttgttgtcgaaatcttttacttccttggttaaatttatttctaagtacatttttgtagcwattctaaaaggaattgcttyctwaattyctkgtttcagcwagtttactaycaatatatagaaatgctackgatttttatatgkdgatttatatcctgcaactttattaattkcatgtatcaccccaagaagctg

SEQ ID NO: 29034 - DNA, 274 bp, Homo sapiens
  misc_feature 271: m=a or c
cctgttttctgtatattgttgtgtcatttcttggctttttaatattttgactacaatgccctaatgcgaagaagtatggacatataaatattacaagagaaattagttaatagtaaagggttaaaaggtaagtaaaatgtccatgaaaataaaattttctttgaacagtttaaaaatggaatcacaaaaatctaactgcacttgaaatgaaactggaaattttatactaattaaatcctttatttaccttttcatattttatcaatggaamccc

SEQ ID NO: 29035 - DNA, 202 bp, Homo sapiens
  misc_feature 97: r=a or g
  misc_feature 98: n=a, g, c or t
agaaaaaaaaagagattctagtacaaagttactgtttaacaaaagcaacataaactctgggaaagatttcattttgccatgttatatttactgtttrntctgtgtactagtacatatctttaaattaccaaaaaacaagaaacaaaacataaaaaccccaaaactatcacttggaattagcaatatcacccaactggcaccc

SEQ ID NO: 29036 - DNA, 144 bp, Homo sapiens
tacttatggtgagttagatcttggcaaaattaaaaactttaataaaactttatcattttgacgtatgaaagggagactaccaaagggatatatgtagagaggggaaactatgctctgtcctctcttcatgaagcctggccgcat

SEQ ID NO: 29037 - DNA, 215 bp, Homo sapiens
  misc_feature 96: m=a or c
  misc_feature 97: h=a or c or t
cagatatcagtatgagaatggcatattcctttaaattgtttgccatttgcagatctttgtgaccatgccctgcacatatcgcatgatgagctatgmhccactggagcagcccacactggcttgatggatcacccccaggaggggaaaatggtggcaatgccttttatatattatgtttttactgaaattaactgaaaaaatatgaaaccaaaaga

SEQ ID NO: 29038 - DNA, 166 bp, Homo sapiens
  misc_feature 16: s=g or c
  misc_feature 21: m=a or c
  misc_feature 22: m=a or c
  misc_feature 30: n=a, g, c or t
  misc_feature 31: v=a or c or g
  misc_feature 97: s=g or c
  misc_feature 107: n=a, g, c or t
  misc_feature 148: w=a or t
agagccgaaagcggastcgammctgactgnvaacttcagtggcgcggagactcgccagtttcaaccccggaaacttttctttgcaggaggagaagasaaggggtgcnagcgcccccacttttgctctttttcctcccctcctcctccwctccaattcgcctccccc

SEQ ID NO: 29039 - DNA, 203 bp, Homo sapiens
gatagtattttttgccaataaaccaaaaatacacattgtattcaaataccagaggaaaaaattaaatagcaagattttagccttaataatgtcattaatttcaaaagagtagaaatctaaccagtcatattttctaggcaactaaaatgacaatataaattaagagtaatattgtaatcaacaagtaacatctagccacaaca

SEQ ID NO: 29040 - DNA, 294 bp, Homo sapiens
  misc_feature 240: r=a or g
ttttctatttttaatagaggtgaggtttcactgtgttgaccaggttggtcttgaactcctggcctcaagcgatctgcctgcattggcctcctaaagtggtgagtttacaggtgtgagccactgtccccggtcgcccccacgttgcaataacatcagcctgtcaggttgtttgtaattcaggtagcaaattgatttttgggagcactctgggtctgttctgtaaagtaactttatttttgrgcaaggatccttaatctctggcctggagatggtccatgtccctctcccccaccc

SEQ ID NO: 29041 - DNA, 137 bp, Homo sapiens
aggagtatccacctcgatgaccacgggctgagccccgcgccgccaccatgtccgtggccttcgcgtctgcccggccaagaggcaaaggggaggttacgcagcaaaccatccagaagatgctggacgagaaccaccac

SEQ ID NO: 29042 - DNA, 106 bp, Homo sapiens
tcttttaaggtaccaagtgggctatataaaataatggcttcctggataactgtgtatgtattttctcagggcttaagggagcaagtgttcagtatcacccataaac

SEQ ID NO: 29043 - DNA, 147 bp, Homo sapiens
ccaaacccagcccagctacagggtcagcggggcccgcctaagcctggccttgtacgcaccacaacacccaacatgaatcccgccatcaattatcaaccgcagtcaagttcttctgttccatgtcagcgtacaacatcctctgccatc

SEQ ID NO: 29044 - DNA, 155 bp, Homo sapiens
catatgttgaaccatccttgcattccaggaataaatcccatttgatcgtggtgtacaattctttaactgtgctgctgatttcagtttgctagtattctgttgtggatttttgcatgaatgtttatactattttcattttaagcctcagcctcccc

SEQ ID NO: 29045 - DNA, 78 bp, Homo sapiens
tccaaccagagtagcatatacatgtgtctgacttttcccctagcctgttgaacattcaatgaaaattcacagaatgtt

SEQ ID NO: 29046 - DNA, 104 bp, Homo sapiens
  misc_feature 61: b=c or g or t
  misc_feature 84: k=g or t
agccggaagctagcatggcggccgccggggctgcggctacacacctgaggaggtggcccgbggcaagcgcgccgccctcttctkcgctgcggtggccatcgtgc

SEQ ID NO: 29047 - DNA, 273 bp, Homo sapiens
tgttgtcgcaaatattttctctagtattcatcttgtaatgaaactgttctgaaattggtgtgataatctttttatattttcttttcttttaataatgtcaacttttagtttagattcggggggcacacgtgtagatttgttacatgggtatatcgtgtgatgctgtggtttggggtacagtagtgagcatagtaccccgtagttcattttgcaacccttgcccccacttccctctttcctctaggagccaccagtgtctattgttcccccccc

SEQ ID NO: 29048 - DNA, 157 bp, Homo sapiens
ccctcttatattcctggtagttaatcaaaatgtcaaagtaggaattttaaataattttaaaatagacattctattttaactaaaacatataaatgtacatttactcacttctattttagtagaacaattaaagcttttctttaagcaaaggtccacc

SEQ ID NO: 29049 - DNA, 271 bp, Homo sapiens
  misc_feature 2: s=g or c
  misc_feature 3: n=a, g, c or t
  misc_feature 98: n=a, g, c or t
  misc_feature 127: h=a or c or t
  misc_feature 128: s=g or c
  misc_feature 130: n=a, g, c or t
asncctgagcagttgctccggcggcgctcggggagggagccagcagcctagggcctaggcccgggccaccatggcgctgcctccaggcccagccgccntccggcacacactgctgctcctgccagchstnctgagctcaggtacacccctgttcagtcgttgaccaagtccttctgggttccaaagccccctctctcccctgtctgcacttctgtttgggtacccactccaggccccaagccctggagtccctgtccccttcacccagcca

SEQ ID NO: 29050 - DNA, 390 bp, Homo sapiens
  misc_feature 93: k=g or t
  misc_feature 95: k=g or t
  misc_feature 288: r=a or g
  misc_feature 339: r=a or g
ttctgcatggctgggaaagcctcaggagacttacagtcatggcacaaggcaaaggggaagcaagtgttttcttcacaaggcagcaggagagakakagaagggggagctgccagacacttttaaaaccatcagctctcatgagaactccctcactgtcatgagaacagcatggaggaagccgccctcatgatccaatcacctcccaccaggtccctccctgggggttacaatttgagatgagatttgggtagggacatagagccaaaccatatcatggcctcttacagraaacaattgcgaacctctgtcctagatccacattttcgttttcactacatrccagttcctagtatgataataaacataataaattgttaataaatattctca

SEQ ID NO: 29051 - DNA, 126 bp, Homo sapiens
gtctctcggaactctccgtcctccaagccaagtccgacgctcccacatcgtcgagtttcttcaccggcttgaaatcacctgcccccgagcaatttcagagccgggaggattttcgaactgcctggc

SEQ ID NO: 29052 - DNA, 114 bp, Homo sapiens
tggaatttttggatttatatttgttccttgagtcttcagggcagtgtctccatgagggttttcctgttgaggggcaccacatacaatagtgtgaagtaggtatgaggggcagtc

SEQ ID NO: 29053 - DNA, 172 bp, Homo sapiens
agaagcgcgctctacctaatcaagaccccacccctctttccctttactgacaattgacagcgacctcttgcaatggcccttccgcctccaccaggagactctgcccgttggtagtaaaagaaccaattagactgggaaaaaaagaagcaacgccccaggtttcaccccgact

SEQ ID NO: 29054 - DNA, 84 bp, Homo sapiens
ctgtcgcccaggctggagtgcagtggtacagtctcggctcactgcaacctacgcctcctgggttcaagcgattctcctgcccct

SEQ ID NO: 29055 - DNA, 347 bp, Homo sapiens
  misc_feature 269: h=a or c or t
  misc_feature 283: w=a or t
  misc_feature 284: r=a or g
ggataaaagcaaatttcataagtctgttgagattaaatttaaacaaaatttaattgggcatacaaaactccagaggatttctaaaatacttgaacagttagaaattattaataaatagtaattcctcttactggagacaattaggcattaagtatgtaaatattaaattacctttaaatttaatttgtcagtaacagaataaacgcagactcaatcttggttggcttattttctttctttaaatcaaaaatgtttcctgtatgttggahgcacagatacagawrgcaaagaatttcagaagttcttataaaagaacttttaacttaaatcattatctcttggggcgt

SEQ ID NO: 29056 - DNA, 425 bp, Homo sapiens
  misc_feature 389: k=g or t
  misc_feature 390: m=a or c
tatcttttgaaatctgcgttttgatgatgctgaagctttggattatacatttgcttatttcgataaggtgcacctaagtctcttcatctcatcagtattcttttgctatcaaaggcagttgatcagttttgttcctcaatatttttttttgcaaatatctaccgaagttttttcaaattttatgtaaaatgcaagtcattgtagagatgccagtctatgcctttatgcttgccagtctcaattaagacttgattgagctgcagtactttaaaaaggattagaagagctattgaatgacttaatttattagaagtttttaagtgacagcatttctaattattcaagtgcatttatttttcatgaaaaaaggtagaatgatttgttctgakmaaaagtaaatagtgttgatgcattagaaattgtgt

SEQ ID NO: 29057 - DNA, 186 bp, Homo sapiens
atatgtatactcttaaacacatactctctctctctctaaataaaggaaaaaagtccttgttatatcataatctctaacattgacttttaatacattcagagtagtacttagaagactgccatgacaggccgggcatggtggctcacacctgtaatcccccagcactttgggaggcggaggcagaac

SEQ ID NO: 29058 - DNA, 320 bp, Homo sapiens
ttatcttacttttttggagacgggtgtcttgctgtgttgcccaggctagtctcgaatgcttgagctcaaatgatcttcccaccttggccttccatagtgctgggattacaggcatgagccaccacgtcgggccacctaaaacctgtattttaaaacactcccccagtggtgtcgcacagacagcacttaatcctcccagcaatgatgtatggcagtatgtgccagttgttgccaattatagaagctcgctgagccttggatgctgctaacgtcgcatgatgcacaggacaactgccctgtccccacccccactctcccac

SEQ ID NO: 29059 - DNA, 314 bp, Homo sapiens
  misc_feature 208: y=c or t
ttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgaytctcttaggctttgcaggtatactctcatatcatttacaaataatggtaattttaccttctcctttccagcttttaacctcttttcttccttccctgtttaattgc

SEQ ID NO: 29060 - DNA, 139 bp, Homo sapiens
atagaatttattaaattcacaaatacttctgttttgcttattcaaaaagtttgtgggcttttaagtggctttgcttctttgactgcagcaggtagtgcagtactagaaaacaaaaaccattaaatttggggagggggcc

SEQ ID NO: 29061 - DNA, 98 bp, Homo sapiens
tacaccaagactgtgtcttgacattctgatggacccaggtaaagttgttaaaagaacgaataaaactttattaaaataatttagacacctgtgtacca

SEQ ID NO: 29062 - DNA, 233 bp, Homo sapiens
aacgatggacacatttaaatcgattgatagtttttgtttttaaatgacatcacagtggtggtatcgaaagttgtaaaaggagccttgtagagatttcttatgaactatcagggaaaataaccccagtctcatagagagtggcaaggcatcaactgtcacaactccaaagatgccaaaagtagacaagattcagtggatcagagcaagacagatttttattcacagcacagcgg

SEQ ID NO: 29063 - DNA, 344 bp, Homo sapiens
  misc_feature 264: n=a, g, c or t
tatacctatatacagtatatgtttctatctttatgtacattactgtttgaaactttgattcctgaagagcaaggattcagatagacagggattcatcaaaaaataaaacaacctattgactccagagtttaattaatgagagttaataggcaagattaccttagttcttttttttaatcttttttaacaaaagcatggccttgctatcacagtttaaaactgtacaatttaaaactttcttaacaaatctcatcttagagttcnttgaaaaggcagtcacatctgcattctttctatggacatgccgtattttatttaacttacattcatttgatagacattta

SEQ ID NO: 29064 - DNA, 191 bp, Homo sapiens
gaatctgtgcaatagcagtgatggctttgggaaccccaggcacagcgtgatcaatgtttttgttggaagagctcagaaaaaccaaggggaccggtccaattaccaggataaatccctatcaagaaacatctctttgaagaaagcaaagaagcctcccctgccaccctcccggacagactccctccgcagct

SEQ ID NO: 29065 - DNA, 202 bp, Homo sapiens
  misc_feature 128: m=a or c
  misc_feature 129: v=a or c or g
  misc_feature 130: n=a, g, c or t
tttttgacagtgtcttgctctatcacccaggctggagtggaatggtgcaaacaaagttcactgcaccctcaacctcctgggctcgggtgatcctcctgcctcagcctcctgagtagctggaaccacamvnatgcgccaccatgccttgctagttttttaaatgtttgtagagaaaaagtctaaccatgttgcccaggcgccc

SEQ ID NO: 29066 - DNA, 190 bp, Homo sapiens
  misc_feature 128: n=a, g, c or t
  misc_feature 129: n=a, g, c or t
caaaaaaaattcagatgttgatacctttttaggaaatgtgcataccactcatcaaatggaatgctgaaagtttgaggtgcttgtatataatcggataaacaaaactgatcaacccaatgtgattttanngcccccaaagaagcttctgttttgggtctgatcctcttgatggagaaactgcagcagcagt

SEQ ID NO: 29067 - DNA, 208 bp, Homo sapiens
tatgaatatgcaaaagacaggataagccaaaggacccatgaagaagaggaaggattgctttacttgatactaagactttttgtaacacactaataaattaagtcagtgctgtattaccacagaaacagacaaatagaccaatggatcagaatagggaacccagatacagatacatgattaatatggacaggttatttataacaaaggg

SEQ ID NO: 29068 - DNA, 223 bp, Homo sapiens
aggggaccccctccatggcttcccaccgggttgttccaggcctcagcttcgccgaaaggcctcaccacctccgacctccgcctgccctggggatgctcccagccctgctgcggcagaacgcgacatgctaaccggaatccctaggccgcctgtctcctacccatacttagaggccccgctcagacggtccttaaaacgtctgaaaggccgttcccgccaggat

SEQ ID NO: 29069 - DNA, 341 bp, Homo sapiens
  misc_feature 35: s=g or c
  misc_feature 36: n=a, g, c or t
  misc_feature 37: n=a, g, c or t
  misc_feature 57: y=c or t
  misc_feature 60: d=a or g or t
  misc_feature 61: r=a or g
  misc_feature 93: k=g or t
  misc_feature 96: b=c or g or t
  misc_feature 97: d=a or g or t
  misc_feature 103: r=a or g
  misc_feature 108: r=a or g
  misc_feature 115: r=a or g
  misc_feature 122: b=c or g or t
  misc_feature 129: n=a, g, c or t
  misc_feature 130: n=a, g, c or t
  misc_feature 131: n=a, g, c or t
  misc_feature 132: b=c or g or t
  misc_feature 142: k=g or t
  misc_feature 181: m=a or c
  misc_feature 185: b=c or g or t
  misc_feature 190: r=a or g
  misc_feature 314: r=a or g
  misc_feature 317: w=a or t
atatagaagttccatcacaacagagtagcatatasnnttgctgtactgggttttgcyggdraatgtagaattattcctctcctgccttcatckctbdctttgratggragactgracacttbatctgcnnnbaagctgaackatggacaaaatccttgcaaagaggtctgatgccaatgcmagtbacttragagcagctcgagctggacaccttgaaaaggcctcgactacataaaaaatggagttgacatcaacatttgcaatcagaatgggttgaacgctctccaccttgcttccaaagaaggccatgtagrggwtgtttctgagctgctgcagagaga

SEQ ID NO: 29070 - DNA, 123 bp, Homo sapiens
  misc_feature 104: s=g or c
  misc_feature 106: y=c or t
ggatgtgagggcgatctggctgcgacatctgtcaccccattgatcgccagggttgattcggctgatctggctggctaggcgggtgtccccttcctcccttcacsgytccatgtgcgtccctcc

SEQ ID NO: 29071 - DNA, 123 bp, Homo sapiens
  misc_feature 98: r=a or g
tattattatttttttgagatggagtctcgctctgttgcccaggctggagtgcagtggtgcggtcttggctcactgcagcctctgcctcctgggtttargcggttctcctgcctcagcctccgc

SEQ ID NO: 29072 - DNA, 245 bp, Homo sapiens
atgccagaagcttatggtacaaaaggataacataaaagatgagactgaaaaggtaaacagtggcctgatcaaaaagcgacttgtgagccctattaaggagttgagattttatcatgaatgtgacgaggagcctttcaaatgggtatgcctgagaagtaattgaattaaaagtcaagacggataggaggacctggaaaacttagagtcagagaagccaagggaggcagatctgaccagaaggagga

SEQ ID NO: 29073 - DNA, 218 bp, Homo sapiens
attccatttcaatacagagaacattttgatttatattatgatgggttgtaaagaattttctttacctcaattctgaaagggattatttattttaataactgatgtttagttattttgagtgagaaatgagctttattttaagcttcagctaacatttaagagcttgccatgtgttagggattgtgccagacactcccatgcatattgtctcagggcag

SEQ ID NO: 29074 - DNA, 73 bp, Homo sapiens
gaagactaaaataccaaaccatgtcctttcctttcctctcaaatctgtctgtctgtctacacacaacatacga

SEQ ID NO: 29075 - DNA, 359 bp, Homo sapiens
atgggatttgcctacgctacgtggctgggctgcctcgctgtgcacacatacccccacatgcctgcagatgtgcacattaatggccaaaggtatagaatcagggttcctggtctagtttcttttgggagagaaaccatatctttgttccctggggacttggtacctcatttgctgaatgaatgaatgaggagagggggatgctcttgaatttggatgcaagcttttctaccatcggtcacaggcaaattactgttccatttggcaattattatttttctttcctgggcttataacacctgtacgcactggtgcctccttgtgtgacctcagggaacaccattcacattgtattcttttct

SEQ ID NO: 29076 - DNA, 105 bp, Homo sapiens
  misc_feature 83: s=g or c
actctggtgaatagacggctgtggggcagagaagcgtgaaggcctggctgccgggcaggtgaactctccacggggtctagggsccgcgaaagggttcggaaccga

SEQ ID NO: 29077 - DNA, 395 bp, Homo sapiens
ttttttagatgattctatataacttcgtctcacaaatagtgtaggtatctgggtttatatactaaaattaagggtggagaagatcttattttttttaaatcatggtcataatttttcttttttttccctaagtgatcaacatcaaatttttagaattaaaatacatttaactcagggaatttgtactacttggaaacacttaactgtaatgcaacatgccttgggaatgttatagtgtgaactacctttataacataggttaaaatacgcttgctagggtgtgttttcaaatgagaacataatatagctcagaatgaagtggtagttcctgtgattcataatacatatgtaggttttgcatatctcagtgcaatccatgatttatactcagaatc

SEQ ID NO: 29078 - DNA, 385 bp, Homo sapiens
tttatttatttattttactaaattgcctagttaattacttcaattttccaatctatcttaccattgaaggctaagactgtttgaatttttacatgtggttggtacaattgaggtctgtacctaaagtgtaagattttcagtgtaggattcatgtttgtttatccaccttcttgcttggtccttttgatctgtaacctagactgttcaaatctcacctttgaatcaatcaagtagattatggaaacacaaaaggaaaggaggagagagattggaatgaaaaaccaacaactgacgaatttggagaaatagtgcctagtggaaaggagaaggtactagaagaccataggttgatgctttggaaatagttaagtagggcttgagggga

SEQ ID NO: 29079 - DNA, 221 bp, Homo sapiens
tgaaaaactagtagaaaaaataacataatcatggacaggacttaaaacaagcgattctacagttattcagaaagtatttattgagctactagtatgtgcttcactctttttgaggcactgtgaagactaacaaaataaataagttccttgtattcatagatttaattatctcactatgactgcaagtgtataatgatttgtatttttatttatctgcctgc

SEQ ID NO: 29080 - DNA, 227 bp, Homo sapiens
aagggaaaagcctgtctgctgtttgaccatctggagcccattgaattggctgagcacctcacttttctggagcataaatcttttagaaggatctcattcactgattaccaaagctatgtcatccatggctgcctggagaataatccaaccttggaaagatcgattgctttatttaatggaatctctaagtgggtccagttgatggttcttagcaaaccaacccccat

SEQ ID NO: 29081 - DNA, 285 bp, Homo sapiens
tactgaaattaaaagcaagcattaataactggctgcctgtaaggtatctactttataaagatgtaaataggttggatggaaaaagtgtaaggatgcaaaaagtgtaagaatgtcaatggatacactatgctaataccgatgaaaatagcattcaaggccgggcgcggtggctcacgcctgtaatcccagcactttgggaggccgagacgggcggatcacgaggtcaggagatcgagactatcctgggtaacacggtgaaaccccatctctattaaaaatacaaaa

SEQ ID NO: 29082 - DNA, 146 bp, Homo sapiens
ttttccttttgaaaaaattgagtaaataaatgtcctattcatcaaatatcaagaaatattcattattgatttcaagatgtagtattaaaggaaaccacagaatcaaaatacccacttctgatacagtagtgatttttttttttttt

SEQ ID NO: 29083 - DNA, 388 bp, Homo sapiens
  misc_feature 265: m=a or c
  misc_feature 266: n=a, g, c or t
  misc_feature 357: y=c or t
ttactctgataatccctgtcacttaataggtatatttaggccagttacatttaaagtgattgttgctgtaaccagattaatatctacccatgtttccaactgttttctttctgttcattgcattggttattggtttcttttctccctctttttctgccttcgtcagttttgagtactttatataatcttatctcctctctcaaaattttgattatacttattttaaaaatttttagtggttgccctcagttttacagtatacgtmntcaactaacctaggttcttaagacaacactatactgcttcatttgtactataggtattttataagagtattcccaattcttccctcccatycctgtaatagtgctgtcatttatttcactta

SEQ ID NO: 29084 - DNA, 60 bp, Homo sapiens
  misc_feature 4: h=a or c or t
  misc_feature 53: w=a or t
ttghacaaagatccaaatcggataactatcaggtaacagaaattacatatgtwttaaata

SEQ ID NO: 29085 - DNA, 101 bp, Homo sapiens
aacattgttttaaagttggatttatatttttcttctatgtagttactataaaagtgtgctggatttgaccaatccttacccccactataaagagaacccat

SEQ ID NO: 29086 - DNA, 195 bp, Homo sapiens
  misc_feature 88: r=a or g
aaaaggaaataattagggtttatgtccagaacaaattttgaaacaccgtttaagcaacacattttcttttaaaaacaaagaacattgrgcaacacaaaggagaaaaacattttatttatttcaacttccctagagatcgtaattatgattttcgcaaggcaatttggtcagttctgttactttatccagaggaag

SEQ ID NO: 29087 - DNA, 268 bp, Homo sapiens
atttactctgtaggccaagaaagctactgacctctaatgcctatgttcatcagtcatagagccaacacttgcaggttcaacaataaacatcataaattattcctccagtggtgaggaagtaagacaccagcaccagagcatacacagtcatggtcgacgccatgtgcagtcatggtggcttcttcagcttcaggttgggacattcagggacattcaagcactaagaacaggacacgatacaaagtctccatgttggtgacagcaagag

SEQ ID NO: 29088 - DNA, 230 bp, Homo sapiens
  misc_feature 81: k=g or t
ataaggataaactcaagagtgaagtcaatgaatgagtcaaaaggaatagaaactatttcaaatggacagggaggctttagktataagcctggacagttagcctactttagtttgagaatgcaaattatttgtggaaagaagtcagtaggaatatttgataaaaggaaaacaaaactgattcttattttaattatttttctttgaattattagaaaagatcactagctgaa

SEQ ID NO: 29089 - DNA, 345 bp, Homo sapiens
  misc_feature 83: m=a or c
  misc_feature 344: b=c or g or t
gttgaaatccctctcccccaggagccctgctgctttgcttggtggtagggcaggagagcaaacaaacagtcatggtctaaaamcccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgacagggtcabc

SEQ ID NO: 29090 - DNA, 126 bp, Homo sapiens
aaaaatttaaatcaagaaaaggcaaaggacacgaacagatattttctcaaaagaagacactcaagtatatgaaaaaacactcatcctcactaatcagcaaataaataaatgcaagcaaaaacctct

SEQ ID NO: 29091 - DNA, 368 bp, Homo sapiens
  misc_feature 154: w=a or t
  misc_feature 155: k=g or t
  misc_feature 365: n=a, g, c or t
caaaaaattttcattacgtttgtaataaattttcgtataagtataacgacagctgtaagatacagggtgccaattatgcaacactttacactggtgcataatgaagctaaattcgcctttaaagcaccactaggacactcttattttccaggawkatactgaaactgaaacagtttaagtaaagggtttcatgtgataaaaccagtaggaaattggtccaggattagaatcacaggggtcttcatgtgtagctgtgttgtggtcagtaaaagacgttgttgctctgtttttggtggccccaagtctgtctcaggtgctgaaacatgcagcatatgtcctttctgcatgtggccgtacagtcaacncat

SEQ ID NO: 29092 - DNA, 172 bp, Homo sapiens
catataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccaccga

SEQ ID NO: 29093 - DNA, 227 bp, Homo sapiens
ttctgcacatatagggtttaataaaacatgtataataaaatatctcatattttaaatttccaccttattggtagctttcatgacaaagggctagggtgctggtggccatacaattaaggtttttggttagttagttagcagaactgactgactcctacctggtgggtgtttcttttgtttgtttgtttggttggttggttttttcccagatggctcaggaggaaggt

SEQ ID NO: 29094 - DNA, 187 bp, Homo sapiens
  misc_feature 27: h=a or c or t
  misc_feature 28: n=a, g, c or t
ttccacacaacaacagcgctaccaachnattatcgtgctaattttttggtgagtaattggcagggggaggggtaaccatgggttaccacagcctggtcttctaagagactaagcaatctggttactaaacacatctaaaaagtttagaaagtctgccaactgtcaatcagcaaataattgatcagtg

SEQ ID NO: 29095 - DNA, 81 bp, Homo sapiens
ctcctctgcttttaatcttctgtggatatttctccgatttcccccaaaagcccacagatcctgggggaagccaccccagcc

SEQ ID NO: 29096 - DNA, 67 bp, Homo sapiens
atttcacagagtgggggggatgtttccatggtgatacagcaaccttaccatgttgaacacactgaaa

SEQ ID NO: 29097 - DNA, 394 bp, Homo sapiens
  misc_feature 369: y=c or t
caatcttaacattttgttttaattgtttaataaagctgctgggcagtggtgcagcattcctacctagtgtcataaaagcaaaatacttacatagctttcttaaaatataggaatgacattacatttttaggagaaagtaagttgctttgcaccgcctacttaattcttttccatatattgtgatacaaacttttgaatatggaatcttactatttgaatagaaatgtgtatgtataatatacatacatacataagcatatatgtgtgtgtgtgtgtgtatatatatatatatgcatgctgtgaaacttgactacacaacataaatcactttttaaattccaggaacgggtagtctgacacggtgattayccttttgaggctgaatccgttatta

SEQ ID NO: 29098 - DNA, 63 bp, Homo sapiens
tcagtactaaacacccatttcattgctgattcctgtctaagaagccattcacgtcagcatggc

SEQ ID NO: 29099 - DNA, 140 bp, Homo sapiens
ttttgttagatgataagagaacttgcttggtcaggacagcagccagctttgtattgtaatgctatattatgtaaatgtgatgaaaatgtttttgtgaagtacttgtaactaaattcctacagccatttttcactcccaac

SEQ ID NO: 29100 - DNA, 95 bp, Homo sapiens
cataatcagtttggttttattcaggatccacaaagatgtcagatgactgttattgaaattgcttatcttaaaggtcacagacaagcattttatta

SEQ ID NO: 29101 - DNA, 198 bp, Homo sapiens
ctatttaaaaggatataaaagctttggatatgtatttttagtaacagaagcatctggttctgtgaataaaggaatgtatagatgtttggatggaaacaaaagcactagactgagtttcctcttataggtattaaaaatagcacttttaggaaactgattattgtaaatgtttaattttgtctcaaatatagttggctg

SEQ ID NO: 29102 - DNA, 314 bp, Homo sapiens
  misc_feature 77: m=a or c
  misc_feature 182: s=g or c
  misc_feature 199: k=g or t
  misc_feature 200: w=a or t
  misc_feature 247: s=g or c
  misc_feature 274: w=a or t
tgaaatttatggccgttgggttatactagcaaccacagaactgaaggccaggcaggaggtaacagatgcctttccgmtggtggccagggatggagtggagactgctgtggttgctgggccatgcacggaggcagactccagggtgagttttgggagctgtctgcttgccttagattccacastggtcattcgtgggcakwcaggcaggtgtccagaactggactggatgtgcttccagttctgtgascttcccctccactccactgggtcgggwgagtcagacccaaggatagctattcagtcagtgttcgcgc

SEQ ID NO: 29103 - DNA, 144 bp, Homo sapiens
ttgagatggaggctcactctgtcgcccaggctggagtggagtggtgcgatctcggctcactgcaagctccgtctcccaggttcatgccattctcctgcctcagcctcccgagtagctgggactacaggcgcccaccacccccgc

SEQ ID NO: 29104 - DNA, 150 bp, Homo sapiens
ttaaattatttattattattatttttagagacagggtttcactctgtcacccaggctaacctatagactaacttaagacaggaaaaacatacagaggagacaagagctggtcttgctcattaaaaggctcaagactagaggtggggccac

SEQ ID NO: 29105 - DNA, 123 bp, Homo sapiens
aggtgacatttaaaagcaactggggaaacatgctgtgttcacatctaacgggcagagaagaatagttccccagtcatagaatgtaacttttttctttcaatcttttacgtcaattaaggacca

SEQ ID NO: 29106 - DNA, 138 bp, Homo sapiens
aacaatacgcctgctgccgcagaggagttacgagccgggccgcgcgctgcctaaatacctaaaccaggtttagcgcctgctcatataaagctctcctaactcgtcttccggtgggaatttcttcacgtgggccggagc

SEQ ID NO: 29107 - DNA, 346 bp, Homo sapiens
ttgttgattgtgtatgttcttctctgtactcctgcaaaatcttaatttagggaaatctgttacattgaaatgactaagagcagctttctttctttttttgtatttcttacgaagctttaatgctatgcagtagtgcttgagaaagtgttttatgggctccttgggcccttctgtgtacctttcttggactgtgatggtattcattagcataccaaaaaccaccagaagtttaaaatgctgaaaaataagtgaactaatctgtttaactatatttaatttagcgtttctcagatttttcgtgtcaaagtgtttcgtttaaaaataaacttttattttagggcagccc

SEQ ID NO: 29108 - DNA, 278 bp, Homo sapiens
cttcgatggtgccacttgtcccatgaatcagcagggttccctagtggccggcagtgtctggaagcctcagcatactctagcacatgcaccaggaagtcagtcaacatacctggtgattaggagtgttctaatgacctaggcccagtgacaggtttccttaaatttccttgaaccaatgtcattctctgtcaaagtttgtctgcctaagaacctcctacttacctgcactccgtggtgcactttcttcatttcccctcagccttattcccccgccccct

SEQ ID NO: 29109 - DNA, 190 bp, Homo sapiens
tatagcctattgtaatctgtaaaacatttcttgtaaattacctaatttattttttcatttatgtacagtatcttatgtaaatttgaaaaatgtttgccatggcgcattctgtaaacattcccgtattcttttccttaatgcttatttgcatgaaggtaacttgggttttgcttgtttgtattggacaacc

SEQ ID NO: 29110 - DNA, 177 bp, Homo sapiens
  misc_feature 92: r=a or g
caagtttgtatttttaaatagtcattctggttacagctgagatgccagggaggaatgattgtgagattaggtaaataatgtttttggagtgragagaagtatagagacaggcacgacaatttgcccttacgcattattggtgagtgtggttgcttgaactggaatagtggcagtgga

SEQ ID NO: 29111 - DNA, 141 bp, Homo sapiens
  misc_feature 85: m=a or c
ttcttatatgagtctttttgtgaatagatttaatttatccagcttggggctcagagaatagtaccaaatctgacccccttcatamcattccaaatctttattccatgaatattggagtttctcagtccattccccatgcca

SEQ ID NO: 29112 - DNA, 404 bp, Homo sapiens
  misc_feature 15: k=g or t
  misc_feature 32: k=g or t
  misc_feature 71: r=a or g
  misc_feature 72: m=a or c
  misc_feature 73: m=a or c
  misc_feature 74: m=a or c
  misc_feature 83: b=c or g or t
  misc_feature 84: v=a or c or g
  misc_feature 92: d=a or g or t
  misc_feature 98: m=a or c
  misc_feature 111: k=g or t
  misc_feature 126: k=g or t
  misc_feature 134: k=g or t
  misc_feature 178: r=a or g
  misc_feature 202: n=a, g, c or t
  misc_feature 203: n=a, g, c or t
  misc_feature 204: n=a, g, c or t
  misc_feature 369: r=a or g
aggctcgtatcggakaacggtgtggccacgakagtctagaggaaaccaacccgcaactcactggagctgarmmmctggtaatbvaggccgadtctcgmgagaattggaackatttcagagccagakgagggtaktggcggcggcgaactttgcccggtagtttttactgactggggtrctggcgcgcgcctttttctcggcnnnaatccagttattgggatagtcttgacttctacctcagcccaacttctgtggtcgtaatattagtttagcttgggtttgccgtgaagtaagaagactgacttccgcaaacgtactgaacgactgggtgtaggtgccagggcatggacgtgaaagctggaaccgcgraatgagttagttgtgggccgctggcctcaaggagc

SEQ ID NO: 29113 - DNA, 299 bp, Homo sapiens
  misc_feature 83: k=g or t
cattatgagtggacaaggctggcattttggggataatataaatctgttttcttgaggtctgttctccattctgactccttttkgttctgatagcaagaacaatactttctgtgacaaaatcagtacattgttttctttagcaagatgcaatatttgaaatgaggattgatctagaggccaaaacctttgacctcttttttccataggtcataaacgtgacctgcagcaggcataccaagacactgcccttgcccaggcacaacctccagttatttggtccaacaggtgaatgccagaaa

SEQ ID NO: 29114 - DNA, 216 bp, Homo sapiens
  misc_feature 199: k=g or t
cacttacatctcattggagaacctctattgttttgtatcataaaactgcaacaattataggaccatcatggaacctgctcaatccattcggctgaaaattgtttgaaagtgtaacacttgactactgtggctttgggttgtcctcattgtttttcaaattaataccttgtcattgtttcagcaggtgttaagaaatgtkactagcatcccaggggc

SEQ ID NO: 29115 - DNA, 243 bp, Homo sapiens
  misc_feature 82: r=a or g
  misc_feature 85: r=a or g
taatgtatagtaaactgaacatttttaaagtatacagtttttgaagagttttggcatatgtattagaccatcactataatartaraaggtgaacatatcccttgttccaagaaatttccttttgccccctttgtaatccctccctcacacccctcaccatccccagtaactgctgatctgatttctgattttatacagtagtttccactacttaatatttttatgaatagattcatgcaacat

SEQ ID NO: 29116 - DNA, 170 bp, Homo sapiens
catggctctgacgaggcagtggagagttcctgacagcatagcatactgccttctgacagactgggttaagctaccaaaaatgacaaccagggattcaaaaaaaatttttggtcattaaatcgaatgtatattattactttttaattttctaagtatttatcacaggacgt

SEQ ID NO: 29117 - DNA, 95 bp, Homo sapiens
tgggaagatgattcagatgaagacatgtctaattttgatcgtttctctgaggtaagttcctttaaatggacctctccccattcgaagcacacgga

SEQ ID NO: 29118 - DNA, 131 bp, Homo sapiens
agtcagacaccgagtctcgccttctgagattggcgggtaacctagcaacgcagggaccgcggcggtaactgtggctagggaaacctggagcggtcagagcaggtgagtagccagttgggaaagggtcgctg

SEQ ID NO: 29119 - DNA, 218 bp, Homo sapiens
  misc_feature 108: r=a or g
  misc_feature 109: w=a or t
aaaaacaggggagctggaataaatgatgtttaaagttccatccaactctttggattgtggaggttgctgatgacaattcttcagcctccagaaagcttgaagtaatgrwttgactcctgcactttaaacttgaaagattcgtgtgaggatccagcaatgttttgtgaagcattgtaagaattggagagatagctgggctcacttcagaagaccctcat

SEQ ID NO: 29120 - DNA, 154 bp, Homo sapiens
ttcgaagaaaactcatagagatagaaattgaaaggaacattcgcaataatgacctagtcaaaattatagattggattccgaagacgtgtcatcatctcaacagttttttgggaaacacacagttcttctgacgttaccattggtccccgactgc

SEQ ID NO: 29121 - DNA, 296 bp, Homo sapiens
  misc_feature 109: r=a or g
  misc_feature 111: w=a or t
  misc_feature 158: m=a or c
  misc_feature 248: w=a or t
  misc_feature 249: w=a or t
taaaaatatcttttcaaaacattgaaaagctggcagtatttatttatagtgacttctttcttaatgtcagcagatagtacaatttctgtaagtgagaattttaaaattrawttgaaaactctcctgttagtaaattaaagcatttataatatttcatmattatcattcagtctgttgaaacccattaaaacattatattctacataatgctcatttctctggactatagttaacttattttttctttwwcccccttttcccttctgtcctgcctctcctgtcatctgcaccccccc

SEQ ID NO: 29122 - DNA, 104 bp, Homo sapiens
aggaatctaagagacaaattaaatgcacaggcaaattaaatgcatagaaatgaattggactgctcattttttgaggacaaaccttgaatctttttttttttttt

SEQ ID NO: 29123 - DNA, 126 bp, Homo sapiens
  misc_feature 102: d=a or g or t
  misc_feature 108: r=a or g
  misc_feature 116: d=a or g or t
aaaaaatgaagtgaagaaggaggagaatacttggattgggataaagtagaaagagtcactggattaaagttaactaaaaaactcataaactttaggagtggdtattgrgaaattgdagggtggcct

SEQ ID NO: 29124 - DNA, 211 bp, Homo sapiens
  misc_feature 91: r=a or g
  misc_feature 111: v=a or c or g
  misc_feature 176: r=a or g
aaaaaacttgcactggcttgtctcacttacgaaacatgtcggagctgtttgcctgggtggggctgggtaccgtacctgtcaatgcctgtgrttttcataatttagcacgtvcataaagaagtacattctgttcaggtgataactgagcctcaatcaagcagaaactttttgcttgraattaaaaaaaaatttctattagtgaaatttcttt

SEQ ID NO: 29125 - DNA, 123 bp, Homo sapiens
catttaatacaagaattttccatccacagccctttagcctatctactgtggtgttctaaaaggaagaaagaggctagtaaatcctggatactttgctcctacaccaatattcccagctgtacc

SEQ ID NO: 29126 - DNA, 191 bp, Homo sapiens
  misc_feature 102: w=a or t
  misc_feature 125: n=a, g, c or t
tttctgaacaggactcttccttttcggaagaatttttgaatcaccctttttcatttcttggcctcagcaggatacatgtgcaggacatgaagatttgttacwtaggtgtcactgttttgcttggnccaatcatgattggtgacttcagctattggctcggagcactggctgtctgactccatctgcagggc

SEQ ID NO: 29127 - DNA, 101 bp, Homo sapiens
  misc_feature 3: m=a or c
  misc_feature 35: s=g or c
gamaaaaaatgagcgaagaaggtatcctttagtascccctgggttctctgcttaattatattttcttgttgcctcttcctcctgtgagattgtcagccaat

SEQ ID NO: 29128 - DNA, 386 bp, Homo sapiens
  misc_feature 100: k=g or t
  misc_feature 319: n=a, g, c or t
  misc_feature 320: s=g or c
tcgatagagatgatggtgacacagcatcaggaatggactcaatgcccgtgaattgtacatcttaagtgattaatggttagttttacgttctgtgaatttkactttgaattttagaaatgcagccaggggaggtggggactgaagcccattctcccagcgcaagccactttgagcaccactgcgtatgacactgtgatggcagcctcatcattagtgttgttggtgttgttgctgttgactgtctaagcagggctgccatccaacttctcgtttctcctttggggccccagggtgtgtgtgcaggtccagcaaatccttnsttacagtggggtggtgccacgtggaaccgactgtgcagcatgggtgtcccctgtgtgataattcaa

SEQ ID NO: 29129 - DNA, 173 bp, Homo sapiens
  misc_feature 102: r=a or g
  misc_feature 103: r=a or g
tcacaagagctcggccaggcggccccgcggggtggtcgtggccatgacagcggctccagacggctccccttccacgcccttcccgccggagatgaggggaarratgtctgtgtcaagattcaaggccaaactgaagttgctggcgtctatcttccacgagaaccaggaggcga

SEQ ID NO: 29130 - DNA, 253 bp, Homo sapiens
  misc_feature 104: s=g or c
  misc_feature 242: s=g or c
  misc_feature 243: m=a or c
ttaaaaaattaagatggcagggcgtggtggctcacgcctgtaatcccagcacattgggaggctgaggtgggcagatcacctgaggtcgggagcttgagatcagscctggccaacatggtgaaaccttgtttctactaaaaatacaaaaattagccggtgtggtctcatgtgcctgtaatcccagctactggggaggctgaagcacaagaatcatttgaacccgggatgtggaggttgcagtsmgccgagagat

SEQ ID NO: 29131 - DNA, 237 bp, Homo sapiens
  misc_feature 89: w=a or t
cagaggaagaatgtgcctcaaaaaagacaaaacagagatgggtccaaggatgggataccagaaatgtgagaatcattaatgccaagttwaaagagaggatggcaagagggttattagcagtttcatgatgttgagagttcacaaactatgttcattgtatttaacaagaagaaattatcttggtgagagtaattgtagtagagtaatttaggtaaaatcaagtttccaggggccttt

SEQ ID NO: 29132 - DNA, 326 bp, Homo sapiens
  misc_feature 77: r=a or g
  misc_feature 89: r=a or g
ctaataggtcttgagctctcatggacattttaaactgaacaagaccaaattgaactcatcatatcaccccaaattgrctcttctctagraactttccttccttgtcatgagtcaagtgctcatgttggaactctaggagtagtccctgacccttcctgtctctaccactactcatctaatcaacactgctgtgtcaggggtcataagtggccacatttcctgaacaatagttttgtttcaccaaggcagtgcccgccagctttttgtatttattgctaacctccaaatgtactgaatagttactgtatatgatgtaatgggagtca

SEQ ID NO: 29133 - DNA, 212 bp, Homo sapiens
  misc_feature 1: r=a or g
rgaaatgaattttaaaaactgaatgaaaggtaaaagtatcattggaatatttggagctgactgtaaagactgtgacaccttccgattttttgtcccttatcatcaattcaggtattccctgaagcacaatcagttgaccaaactaagagcagtgccctcaggaaagaataaaatgaatagtttaatttatcaacatcatttacccaggtaac

SEQ ID NO: 29134 - DNA, 162 bp, Homo sapiens
tgaatgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttcct

SEQ ID NO: 29135 - DNA, 128 bp, Homo sapiens
catgcacttctctgttctctcctccccctgcccagtgagttagcacagcagtagcactgcccttgagcacagttctttccccaggccaaagatggttttgtgaagaagctgctcccctacaagtctca

SEQ ID NO: 29136 - DNA, 311 bp, Homo sapiens
  misc_feature 98: n=a, g, c or t
aatcttatctagactttgaataagattttctgtattagtcagtattgttttttgctacttcttttcctttcctttccttttttggaaataggggtctnactcctctgtcacccaggctggagtgcagtggtgcgatcagagctcactgcagcctgatcaggctcaagcaatcctctccctgctcagcctcctgagtagctggaactataggcttgcactgccatgcccagcttttttctattttttgtagagacagggttttgctgtgttgcccaggatggtcttgaactcctggactcaagtgatcctcc

SEQ ID NO: 29137 - DNA, 311 bp, Homo sapiens
accaataaaaccccggccacagtgcattatcaaggcaaataccaagaatagcttttaaattacccactagttcgcattttccaggcggctgatccctccaggggcatgaaacatggagcttttgattggacagacttttcccagttagagccctttaaggaagaaaacggtgggagggccgggcgcggtggctcgcgcctgtaatcccaccacttcgggaggccgaggcggttggatcacctgaggtcaggaattggaaaactagcctggccaacatggcgaaaccccgtctctaccaaaaatacaaaaat

SEQ ID NO: 29138 - DNA, 71 bp, Homo sapiens
  misc_feature 3: k=g or t
  misc_feature 7: k=g or t
  misc_feature 9: k=g or t
  misc_feature 17: y=c or t
  misc_feature 19: y=c or t
  misc_feature 20: k=g or t
  misc_feature 24: k=g or t
  misc_feature 52: w=a or t
ctkcackaktaacctgytyktatkagatcagcgaagacagtcatgcatcgcwtaatgatggggatgcattc

SEQ ID NO: 29139 - DNA, 198 bp, Homo sapiens
tatgccttttgaagaagtctgttacatatattataagtttgatgcttaatgcttcttattaaataacctttggcttttgatcatttataggctaagttacaagaactcattataatatagaacctacgctaaattcactttcaacataagaatcagtatgaaccagtgataccctggtaaatgtctaacaacaggctc

SEQ ID NO: 29140 - DNA, 134 bp, Homo sapiens
tgaaatggagcccttccctggaactaaccagtccttgatgttgtgtgactaagtaaagatgataaaccccatctgctgggggtgtcacttcacactcggcatgcattgtgaaagctttccatacccttggcacc

SEQ ID NO: 29141 - DNA, 136 bp, Homo sapiens
aatcatttacaatcatgtgctgcaaaatgaagtttgggtcaacagtagaccacatatatgatggtggttccgtaagcgtataatggagctatccctatataggtataccatttttatctttttttttttttttttt

SEQ ID NO: 29142 - DNA, 127 bp, Homo sapiens
aagggtcaggttgagtgcccttcttgtttggattttacccttaaggcaataaaattttaggccagtgcacaatatgatcagagttgtagtttaagaaaatgactcttgcaacaatgtacaatttttt

SEQ ID NO: 29143 - DNA, 216 bp, Homo sapiens
tacaatgttttgggagacatgcacatagaatgattaaacgaatcaggagatggtgagttccacagctgatgtatacacaaacaaataatgggtgcatgaaagagggtcaccttatctcttctgataaggttatgaaggtatcccagaagaaaaacatctgagctgagtcttaaaaatgcaagagaatattcccagatgaagaaaggggagcaggcc

SEQ ID NO: 29144 - DNA, 233 bp, Homo sapiens
atttttccagccaactgtgttcccatgtagaactgcggcccagtgtagccagtaccgaagatttctcagaaaaagccggagatctcaatgctggcttcttccctcagcctcgtccgaccccagcctgtgttcaatgaacattcggtaaaggaacacggaatgtcaagcgcattagagacaaccttgagacacattcctcttgcggaacatcagtcctgaatcctcagaccgct

SEQ ID NO: 29145 - DNA, 378 bp, Homo sapiens
  misc_feature 271: m=a or c
gaaggacttccggtggcttccaaggcgactccgtagtggatgcagcgccggacgccacagccgaaaaacagaatcttggaactggtttagtacaatccaggtcgagttccttgttttttatccgagtggccggcaggccatgtgctgtcttgtttttaacacatcagctcttgccggaagccgctaagagataaaataggaagtcccacccttcccttagagaaggaaaacggagagccgaaggagtcaatctaaattcgatgagcgcgtmgggctccaaggcaggcgctgtcagcccgggagggtgtctgggatttctagagggtcccagaacgggttcttcccaggccgatccgctgcttcctgcccgtctctcca

SEQ ID NO: 29146 - DNA, 79 bp, Homo sapiens
ttggaagatttataattagggaagggccaggtgtagtggctaatgtctgtactcccagcactttgggagaccgaggcag

SEQ ID NO: 29147 - DNA, 150 bp, Homo sapiens
  misc_feature 22: s=g or c
gggagcgcctgcgccgctccgsgagagtccgtggatctcacagtgaatggagtttcgctcttgtcgcccaggctggagtgcaatgacacgatccatcctcaccacaacctccgcctcccgggtacaagggattcttctgccccagcccca

SEQ ID NO: 29148 - DNA, 322 bp, Homo sapiens
gacaaggactaaaatcagatttattcttgaacagctgggaaagctatccatgtgtcttggaaagatattatgcgattttccccatgtaaaagtaaaaatgattctggagaagagttgcccagatgaacctcttcttcccttaaagagagacttaaggtaaagagaatttgctcttaaagccattttataaaagtcataatactttttgctacaatcatttcaggctttttttgttttaattaaaggatgtttgctgttaaataaaattaaggttaaaaatgttaggtatagaagtctaatgttgaaaattgtacaaaaagcc

SEQ ID NO: 29149 - DNA, 106 bp, Homo sapiens
ctaactgttgagtataatgcccagtacctggatgacaggatctgtcatactccagacttcagcgttacacagtatacccatgtaacaaatctgcacatgtacccct

SEQ ID NO: 29150 - DNA, 187 bp, Homo sapiens
agcctggggcggccggccaggaaccacccgttaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccaaca

SEQ ID NO: 29151 - DNA, 117 bp, Homo sapiens
aaaatttctgcgtaagttaaataaatactttctttgcatctggaaagggctaattcaattttcaaagtttactttataattgggtttatcttatttattgaggaaatatggtgcggt

SEQ ID NO: 29152 - DNA, 454 bp, Homo sapiens
agttatttgttttttatgataatgaagatcttgtaatttgtgatcatctcttctttttagaaaagcagcttggattttaaatataaatatcttccctgccctttaagattgctttgcctaggagattcttaggtgacactaagactcgttaagtatctttgtcgtagattgacttttagtcttctaagcaaggctttatcagaatcctaggaattccattatacatttagcagtgcaaaaagtaagctgtgttgggagcaaggaaaatgagggaccagggagaagggcctgaaacagcctaagggaaataggttgaggagggcagtagtctgctgttatttgcaccctgggcttgcgttccttctgaggttgtttaaaatcaatattcctggctgggcactgtggctcacgcctgtaatcccagcactttgggaggctgatgcaggtgttcagc

SEQ ID NO: 29153 - DNA, 129 bp, Homo sapiens
  misc_feature 85: w=a or t
  misc_feature 87: y=c or t
  misc_feature 89: k=g or t
  misc_feature 92: k=g or t
caaattttgcagtaataatattaagtaatcttgatattcacctggatagcgtgtctcttgattgcctccaaagtaaaatccccawtyckggktggcttctttgaatgcagtactgctcctaacaccccc

SEQ ID NO: 29154 - DNA, 83 bp, Homo sapiens
aaatgcataatgtaaaataatatttgttttggcaattactgaagactaagcatttgtttgcctcccacataataagcagacat

SEQ ID NO: 29155 - DNA, 404 bp, Homo sapiens
  misc_feature 85: k=g or t
  misc_feature 389: m=a or c
  misc_feature 391: s=g or c
gtcccgtttacagtgtaatcttggaacctgcacgttcatcagagagagctggctctttcagcttcgcttatttcacttcttttgktttttttaaaactctttccactattccttggtcaaaaaagtagaaagattcaaaaatgcccattccatttttttctcttcagacttggtgttagtgagaattttcaggattttgctgctttagcaacgtagtttctggagtaaacagctaaatggtgctggatcacctcgttttgctctggaatcttcattttttttcttgtctgtcttactgaacagcttacagtttcttggagatcccatgctctcctgctgtgcacatgcccctcgttctcggacgtgtggggagatggggctgacctggmgscctcttactcagc

SEQ ID NO: 29156 - DNA, 170 bp, Homo sapiens
  misc_feature 89: y=c or t
ctgtgcccttgaaattgtttcccctttgccagagaacaaggctaaagtgaatggtgcgcctgagcaatctatccagacacctgaagacytggaatggggaagggaggacccagcctttggatgcctatcagaggatgagatattaaggtcctctttggaaatgtgctggt

SEQ ID NO: 29157 - DNA, 218 bp, Homo sapiens
tattattattttctagatattttaaatttttaacctaagactcatttgagtcccacgcatccacacaaatagtaggtgttttgtgtgtgtgtttgtttgtttgttgtttgtttcgagatggagtttcgctcttgttgcccaggctggagtgcaatggtgcaatctcggctcaccataacctccacctcctgggttcaagtgattcttctgcctcagca

SEQ ID NO: 29158 - DNA, 182 bp, Homo sapiens
acttggctcctgatcttagagtaccaacaacttaattgagatgatagacagctgggtggatgttttatgacgttcatagctttcttttcccaaatataagttagaagtaaaacttcttcctttcccactattactgtgacatgagctcagctatagaaaagcagaagaattacaggcaaatt

SEQ ID NO: 29159 - DNA, 117 bp, Homo sapiens
  misc_feature 110: r=a or g
cagatatcttcttgttgcttttattaatgtatactaattgactatttttgtatcttttaaaggagcagcctttactgttctgatattccatctattcatcccatatctgragccttc

SEQ ID NO: 29160 - DNA, 341 bp, Homo sapiens
  misc_feature 85: k=g or t
  misc_feature 92: w=a or t
tatggttttttggctaacagccacagagggcaaagtttaagactttcttgtaaggactaactgttcttttcaagctactgtttgkttttccwaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacat

SEQ ID NO: 29161 - DNA, 212 bp, Homo sapiens
  misc_feature 94: w=a or t
agcaggctacatttaaaacttttattaaacaactatattatgtaactaagtatagatccatatgtataaatgttttggaaatacatttttaatwataatctatgatcatcacattgcctgtatcttattaatatttttaatgtctcttgaagcactcaaatgtgtttgattcagttgaataaaaggatttctttttctctttttctagaaca

SEQ ID NO: 29162 - DNA, 268 bp, Homo sapiens
  misc_feature 90: r=a or g
  misc_feature 93: s=g or c
  misc_feature 249: n=a, g, c or t
cctcttcttcagctccagcctcagccccagctccaacccccatccttgcctcagtttcaaccccagcttctgtcaccattcttgcctcarccstcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagcnccagccccagcccccccca

SEQ ID NO: 29163 - DNA, 171 bp, Homo sapiens
  misc_feature 87: s=g or c
  misc_feature 91: w=a or t
  misc_feature 93: m=a or c
caaataagagggtgtattttaggaagcagaatacaggctgggctgaagagtggaagccagtggccagatggcctgataggatgatgstgtwamcatctcactttaaggaaacaagggctgaagtcaacctcgggagagtgggaatgaacccgagagacgttctgaaaaaac

SEQ ID NO: 29164 - DNA, 189 bp, Homo sapiens
  misc_feature 88: w=a or t
ccattgttagatagatatctatggatatagatctacatctatagatatagatatacacacatatatatactcacacacatatagcatwaaaatactcagcagggctagttattccgatttcttgcacaattatttagctttttgtaagttcaacatgtaaattttaaagacataaatatagagagacgg

SEQ ID NO: 29165 - DNA, 220 bp, Homo sapiens
gcatccggcgggttcgactcacttaccaggaacccacgcaggaagctgaggaggagaacagacgcctctgggccactggccgggccacttgagcgtgggaccgccgagtgtgaccctgaggccgagtgcgtgcgggactgggcgatagctccgccaggcaggattttgtttgtttcacctcttgaggtagtcccggcgtgtagtacataataggcgccgt

SEQ ID NO: 29166 - DNA, 300 bp, Homo sapiens
tatgtcaattagttactttcttctgggatttagtgttttgtcttggattttatagaaatgtatatatacttttagaaggtacagggaatagatgaaaattaactttagaattatataatttatctgatataagtgcatgtatagcctaaatatatttctatattgaaagatataatctaccactcacttaccagtttgatttaaaaaataactattcatgtcagctatataaattttttaatgtaaaaaaactataaaaataatttaaagtctgtgcttactgaaatagtctatatagcc

SEQ ID NO: 29167 - DNA, 160 bp, Homo sapiens
  misc_feature 89: r=a or g
  misc_feature 91: s=g or c
  misc_feature 138: n=a, g, c or t
tgatgctctcaacttttgagtgcctcaaaaaatgctaaaactttggctgggcatggtggctcacgcctgtaatcccagcactttgggargscatggcgggtggaacatttgagggcatgagttcgagaccagcctggncaacatggtgaaaccctgtcta

SEQ ID NO: 29168 - DNA, 349 bp, Homo sapiens
  misc_feature 95: r=a or g
aattgagatagagtctgaaaccctggcaagccacagcttcctgcagtgtcctgttgccatgggttacgaagggagcgagagggaacttcatcggraaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcagtggtccacatgtgccaggagatgtgggaatggctacccctgaagtcatatggagaaatggggtcctcatcgcacaccatacacaaacatcatctcacaaatggattaaa

SEQ ID NO: 29169 - DNA, 267 bp, Homo sapiens
  misc_feature 78: w=a or t
  misc_feature 82: r=a or g
  misc_feature 83: r=a or g
tccagatgatatttcagacaacaaagagtgctcagttgatctggtgacacacaaaggctcccaagttgttacacattwatgrrgaaaggtggctgaggaatataccagagccctaggccacagtgtcaggtagtaggagatggttattcatgggcatctttgtggttttagtagtaggtagaaagtcctgactcttttagtgtaagttcagatttccttgatttcaaatcatttggaaacatacttcagcactcctcctaaccgcac

SEQ ID NO: 29170 - DNA, 139 bp, Homo sapiens
ttcaccatgttggtcaggctggtatcgaactcctgacctcatgatccacccgcctcggactcccgaagtgctgggattacaggcatgagccaccacacctggcccccttttttatactttttacaagtaatctgacact

SEQ ID NO: 29171 - DNA, 118 bp, Homo sapiens
aaagagaaaaaaatcggaaggaaattaaccaagatgaaaataaagtagatgggatgaatgccccaaaaggccaaactggggaactctaggccgtggtccaggagacggagggaaccat

SEQ ID NO: 29172 - DNA, 178 bp, Homo sapiens
  misc_feature 80: y=c or t
  misc_feature 83: b=c or g or t
  misc_feature 123: n=a, g, c or t
ttattattactgtggttctgattaactactggaaattatatttgattatatcaccaattagttaaatcagtgcttcgacycabtcttatctgttctgttcaaaactatttgttcaaagaaccngttagtgttgtttacagggttacagtttctctcacatgctttcctcacccccggc

SEQ ID NO: 29173 - DNA, 314 bp, Homo sapiens
  misc_feature 279: r=a or g
  misc_feature 285: r=a or g
  misc_feature 302: r=a or g
ctaatttcaagccactgcatttaacaactgccatgcaacatccctaaatatttaacaattggatcttgtgagccagctggagtcagttctaggaaaccactgttcccatcccacagataaaccaggatgcatcacttaggaattgcggtcttgtctttccctgtatctccaatgcccagtttggcccatacaggaaatatggaaactttataagtatttgttgattagagaataagtaaacaattgaatgataatgactaatcaaaactggagtgaagratgggraatactgtctcagccgrattaagaaggtc

SEQ ID NO: 29174 - DNA, 170 bp, Homo sapiens
  misc_feature 138: n=a, g, c or t
aatttcctgcgactcctccctcctttggccaccttgtcatttcatagtataaatggtgtgccataagatggtatattgtctggtgagatgttgtcacacagttctgcacctccaccccccattcccacatggtctgcnctccctcatctccgtgactgaacagcctctcc

SEQ ID NO: 29175 - DNA, 165 bp, Homo sapiens
gattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaaggt

SEQ ID NO: 29176 - DNA, 178 bp, Homo sapiens
tgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgataccaacacgg

SEQ ID NO: 29177 - DNA, 154 bp, Homo sapiens
ttaaaagtgttaacattaatgctcaataaacaaattccctgcagttgttttttttatttcactctttttatattttagagccatccatcctgaattttataaatgattttttatttaaaaatttgagatttttaaaatttttcacagcacagat

SEQ ID NO: 29178 - DNA, 183 bp, Homo sapiens
gaagtttaaatgcttgtttggaaaactttatttaacagtttagaaggcttgatagaaagagtgcattagtctgaagagtatacattggataggaaagaatttccttcttttgtttctccaaatctttccgccttatttagcttgagatctttgcagcttggttcatggattctagccttgccc

SEQ ID NO: 29179 - DNA, 145 bp, Homo sapiens
  misc_feature 120: n=a, g, c or t
tctttttgcttaggatagctttggctattctggatctgttgaggttccataaacattttaagattgttttatctatgtctgtgaagaaagtcattagtattttgatagggattgcattgnatctgtagattactttgggtagtcg

SEQ ID NO: 29180 - DNA, 386 bp, Homo sapiens
caaaagaatgttacagccagcacaggcacagtatatttttaatgtttatatttagctgttaaagttgtgtgatgaatccttccccttgactcttgttggcgtgtctgtatgagaccatccaaagactacattttaaaccttgagccaatggtcggcccgctcactcctccaagtggccctgctgctggccccaaggaatcagaaaaaggccttgtataaaacaggctggctgactggtgatgggagggtgatagaggcatgttctagtgccttcagctctttccccagggtgtaaattctctcctaggcctgacagttggatctagaatttctctcctgcaaaatgggtttatttcagaactatgtgctgttctacaacaatgaat

SEQ ID NO: 29181 - DNA, 412 bp, Homo sapiens
  misc_feature 96: d=a or g or t
  misc_feature 97: n=a, g, c or t
  misc_feature 98: k=g or t
  misc_feature 200: d=a or g or t
  misc_feature 201: n=a, g, c or t
  misc_feature 262: k=g or t
  misc_feature 277: r=a or g
  misc_feature 356: s=g or c
cacagggaggttgtcattttaaaattgttttctgtcctggtcccgtggctcatgcctataatgtccgcactttgggaggctgaggcagaaggatcdnktgaggccaggagtttcagaccagcctgggcaacataatgagaccctgtccctacaaaaaattaaaagaaaaatagccaggtgtgttggtcccagctatttgdnaggctgaagcaggagaatcatttgaggccaggagctcgaggttgcagtgagctataatcakgccactgccctccarcctgggcgatagaatgagaccctcccgacagatagatagatagatagatagatagatagatagatagatagaatgagascctgccaatagatagatagatagatagatagatagatagatagatagaaagaatga

SEQ ID NO: 29182 - DNA, 314 bp, Homo sapiens
  misc_feature 109: k=g or t
  misc_feature 281: s=g or c
  misc_feature 283: m=a or c
  misc_feature 285: m=a or c
  misc_feature 286: y=c or t
  misc_feature 297: w=a or t
  misc_feature 310: n=a, g, c or t
attcagggccacgtgttcaattctgatacagtaggtcctgtaataaggcctaggaatggccatttttaaacagtacactaggtggttttgatacagatccaaggactckaatttagaggaacactaggttagaggtttctcagacctgcaaacacctaagcacctgggccaaacaaagctacaacgaagatctgtatgaagatatatagttctgcagaatttaaaaagagcacaatttaagtcttcggccctcagaagttaaattcatattccatctaagscmamyttggatttcawtaagtagaatgangctc

SEQ ID NO: 29183 - DNA, 197 bp, Homo sapiens
  misc_feature 138: y=c or t
  misc_feature 139: s=g or c
tgaaaaattgcaagttgaatcattctaagtgagggactgtcttgactcttttcctgccaggttttcatagttacaaaacagctcatgtggaccttcaggataaaagacaggtgaagactgccttagagcaagcagagysgcagccgggaagaggactgtttgatcatgataatctcatgcaaagtacataaaggggt

SEQ ID NO: 29184 - DNA, 218 bp, Homo sapiens
aggaacaaaagctccagcggagtctggcggaggcactaagggagcacggggtgttttgaataattattaaaattagcatgtgtctgcgccatcctgtgggtgtggcgcagagaggagtgtaaactctagcggggctagagcaaacattggattagcggcagcagcctgccagcctgcccgaggagtgctgggaccagcgcgctgcacgccgactggct

SEQ ID NO: 29185 - DNA, 100 bp, Homo sapiens
  misc_feature 18: w=a or t
ttttttttgagacagagwcttgctccatcacccatgctagagtgcagtggagtgatctcggctcactgcaacttccgccttctgggttcaagctattctc

SEQ ID NO: 29186 - DNA, 292 bp, Homo sapiens
  misc_feature 285: d=a or g or t
taatatttgcagtaatcactaaattttaactaatactgtctttgtttccagtagtgttctatgagtataattttatcaatatgtaaatatgtgaggcattgattctcacaataattctatgtgctaggtacttaaagcatccccattttccaaatgtaggaaacaggcataaagaagttaaatacttggccagattactcctgtaatcccagcactttgggaggccaaggcaggcagatggcttgagctcaggagtttggaaccagcctggtcaacattgtgaadccccatt

SEQ ID NO: 29187 - DNA, 174 bp, Homo sapiens
aagaatagctgagccagagcgaacgtgagtgtgaaacctctttaagacaccgttgggctgcttggttctgacattctggactgcaaaacagttcctactaggatcctggggatacatgaagcttctgtgaaccaacttttcaagaaaaagcaatggagattggatggatgcact

SEQ ID NO: 29188 - DNA, 187 bp, Homo sapiens
caagttggtgtattttgtgttactaagactgttttagtgtttgtaaaagacataattggggtaagttgaaaaggtttttaacattttatttttgttttcgtctgtgattaattacagcattgatgtaaatatgtttcaattttgaaataataattttgtagaaaagaattgtcattaacacaaaggc

SEQ ID NO: 29189 - DNA, 138 bp, Homo sapiens
  misc_feature 2: d=a or g or t
  misc_feature 13: d=a or g or t
  misc_feature 57: w=a or t
  misc_feature 128: d=a or g or t
cdacattcctctdctccaaaaggaaaaataaacatacaacccttcgttacaaatttwaattcccggttttctgtaacccagactcatgcctcgcttttctcggagacagacataagtagaacatcgcdgcagatgctc

SEQ ID NO: 29190 - DNA, 275 bp, Homo sapiens
  misc_feature 232: y=c or t
ggtaatcttgggcactagcgggcggagttgaagggcgcttggaccccagcggcgatctgtgtttgggttcgcgctctgggagaattttggctttgctcgccttcctctttcagaagactcgaaatcggccagcaggtctgcgagatttgaaacgcgactgttactccttgttttccggttctggccgcgggagcctctcgagaagcgtggaaagaggagaagggcgtatacytgtgaccgcctctggttgtcttgggctcgcgcctggcgccgta

SEQ ID NO: 29191 - DNA, 257 bp, Homo sapiens
  misc_feature 228: k=g or t
caaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacckcttgcagcatattagaacagacgacccat

SEQ ID NO: 29192 - DNA, 233 bp, Homo sapiens
gacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgata

SEQ ID NO: 29193 - DNA, 390 bp, Homo sapiens
ctgcaggtaacaaaagtcaaagtattttatcttttcacagcaagaacagtccatgttgtatataatacaaccaacattatagaacttttagggttgtgactggctttggtgcaaatgtgtgctcaagctaataagttattgtgaaactgagtttcctttaacttacaaagctagttgccatatttctattttattttaaaaagtaaacatgcggctgggcgtggtggctcatgcctgtaatcccagcactttgggaggctgaggtgggcatatcacctgaggtcagcagttaaagaccagcctgaccaaaatggagaaaccccatctctactaaaaatacaaaactagccgggtatggtggtacatgcctgtaatcccagctactcagga

SEQ ID NO: 29194 - DNA, 327 bp, Homo sapiens
  misc_feature 308: w=a or t
tcaaaatttaagctgatgcttagatattgtctctaatatcactgctaattaatcataaatggtgacattaccaacagctgtaaagtagccattccaccttcagacaacagttttgttgttttgttgatttggtttggtcttgagattaactacttctggttgtagcattcacatgttacttccatctctgtttgactttagtagagcactatatagtaactgctcttgctctcatgcatgttatgaataactgctttgccaacagacctgatggcttataaagataaaatgtgagaagcttgtcatcwcactgttctgtcctcatac

SEQ ID NO: 29195 - DNA, 105 bp, Homo sapiens
attccctttgaaaactggcacaagacagggatgccctctcttaccactcctattcaacatagtgttggaagttctggccagggcaattaggcaggagaaggagag

SEQ ID NO: 29196 - DNA, 243 bp, Homo sapiens
attttgggtggtgctgagggtcagaggaagaagtaaaaattgtgagaaaggagaaacatgggcttggggagaacccagaattggggacagaagacctggcactaagctatagcacttagcacctctgatcttgtttttcctcgtccgtaaaaggagattaacaaagcttttctgcccacctcttggggagaagggaataatttagttggtaaaaaaaaaacttttgaataataagcaactccg

SEQ ID NO: 29197 - DNA, 252 bp, Homo sapiens
ttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgaggccc

SEQ ID NO: 29198 - DNA, 74 bp, Homo sapiens
  misc_feature 73: s=g or c
aatagggataagagagaagagggaggagtcgcagatcagccattcttgtcttatggggtcccagctggcgcasa

SEQ ID NO: 29199 - DNA, 234 bp, Homo sapiens
tcctaattaattggccaaacacaatgtaaataaaataggaaatgcttcagttaatatttactatataaacaaacaaacagatagtgggataatggttttatctatcaccatattctagaattgtgcctggcattcagtaagcacctaatggattaacaaatatgtacttgtagatgtctgcagaccaaggtgaatttagtgaatatcaaaaacttcttgagtgctccaccgaat

SEQ ID NO: 29200 - DNA, 270 bp, Homo sapiens
ccactctactctctacttaccacccccacacacattttccttctctttctctttgttgtgtctcttagaattttcttgagctctccttgaatctttacccagcatagcagggacaacacagtcctgagatcatcaaaaggggcccagatctgcttctgggtcctctgggagggctgcgggttggcacagctccaggatgagaaggtcaaagatgcctaaagatgctgggtattgagcccagtgtttaggttgaatgtttcctgtggacca

SEQ ID NO: 29201 - DNA, 161 bp, Homo sapiens
atactttaacttacggggtacatgtgtagaacgtgcagttttgttacataggtatatacgcgccatggtggtttgctgcacccatcaactcgtcacctacattaggtatttctcctaatgctatccctcccctagtcccccactccctacaggccccagat

SEQ ID NO: 29202 - DNA, 334 bp, Homo sapiens
  misc_feature 303: r=a or g
caattgactgcttcttacttttttaggcctcctgtcaaccagctcgttggagcaagggctcagctgtttccttttatgaaaccacaaacatgttttgtttcgtttaaagggaaaacaaatcaaaagcagttttctgaatgggttaaaagtaataaattattaaaccaaatgattgaataacatgggtgaaaaacaatccgttacaaagaactcctaccataaatctcaacaaagctagtcaagccaaagctagttgatcacatctgttactagttagatgtatatttcagattacagataaaraaattaaattgcttttgaaatttgcaggcct

SEQ ID NO: 29203 - DNA, 126 bp, Homo sapiens
agctgggttcaaacctggactctgccacctacagctttgcgaccttgggcatcttggttaaccttgcttaatcctccacaccctcatcctgaaaatcggaggaataacagtatggcagtcccccct

SEQ ID NO: 29204 - DNA, 351 bp, Homo sapiens
  misc_feature 294: d=a or g or t
taagttccttatcagtgttggacattagatctttgtcacatgcattgttgcaaaaattttctcccattctgtaggttgtctgttcactctgttgatagtttcttttgctgtgcagaagcttcaagaagaaaggaatccgattggttctgtgtctgtctcttttggtattctcagaattatgtagtcattcatatagaaagatgattaggaaaataggacaagaatagcagaaatctacataaaaatgtaggaaattaaaattagttaccagcatacaaaaagcttctgtatgtdataattacatactataactcacccctccttggcaaatattctctctcttttgacttc

SEQ ID NO: 29205 - DNA, 166 bp, Homo sapiens
cagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacc

SEQ ID NO: 29206 - DNA, 381 bp, Homo sapiens
  misc_feature 303: n=a, g, c or t
catattatttaaagaccctcagcaaagctcacatccctactaatttgaaaaatctctgccttaagctcttctctccatttagaaaagtgttctgccagttaaaatttgggctaagctatccaataaagccagggcaaatattatgtttacccactttctctaaagtaggtatttcagaagagatcagttaatttctaactgtagcataggttatggtcatgtagtatcttttaaaatttgagtaagggcatgctttgagcaagtaagtttaagttgactttcttctggaaataaaagtaagangtgtctctaaattatttattgaacagtattcctaattactacattttcctggcttaacttggctgctgaagaaattga

SEQ ID NO: 29207 - DNA, 201 bp, Homo sapiens
ccgagtggctgggattacaggtactcgtcaccacgcccagctagtttctttgtatttttagtgaggatggggtttcgccatgttggccaggctggtcttgaacttctgacctcgggcgatctgcccactttggcctcccagggtgctgggattacaggcatgagccaccgtgcccggctttttttgtttgtttgtttgttt

SEQ ID NO: 29208 - DNA, 161 bp, Homo sapiens
cgaaaaatcgaaaaccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcacct

SEQ ID NO: 29209 - DNA, 241 bp, Homo sapiens
  misc_feature 208: k=g or t
tcaatcttcagagtaaataagttgatttttaggaaaagtgaactgtaactgaagcaattgacacatggggactatgtggaaaacatcatggtctggattcaagttacagcattcatggtaatgctcagaaagataataacatactccaagattccactgaaatagtggttgctatttttttttttagaaaatagcttgggactctggkgataatgcaaaatgggcttgctccttccaagac

SEQ ID NO: 29210 - DNA, 345 bp, Homo sapiens
  misc_feature 231: r=a or g
  misc_feature 247: n=a, g, c or t
  misc_feature 260: r=a or g
  misc_feature 267: w=a or t
  misc_feature 299: m=a or c
  misc_feature 302: r=a or g
  misc_feature 303: d=a or g or t
  misc_feature 304: n=a, g, c or t
  misc_feature 318: r=a or g
  misc_feature 327: w=a or t
  misc_feature 332: d=a or g or t
  misc_feature 343: s=g or c
taatgggttctaatgtacatgaaacggttggctactgccttgtctgttacccagaggccctaagcaatcaggaagacagtaacaaaatttctgctcttggtaacgtttgcagtgcatttcataggtgtcattaatatcacaagctgagattgaaaagcttctggggatatatgaaaaattaatgggcattagaaaagtaaaatagcatgaggttgtgtgtgtgtgtgtgtrtgtgtgtgtgtgtgtnaaagaatgcatgragattgwgagcagatgcccaaggggtggagaagagagamacrdnatctctgtggattrgagaaaggwctgtdgagggaaggasgc

SEQ ID NO: 29211 - DNA, 358 bp, Homo sapiens
tctactagcaagacaaaaatccacaactttttagagaaatggctagattttaaaggcaatctgtaatggctgaatcttttattttgcctcttgaatcatacagcagtttgtgagagtcaaatatttgatagctgattgaaaataaatgaaatgtgagcgcttttcagtggaagtaggccagttgctaacattctcttctatctctgaaagttaaatttcattatttaattggataaaaatcaagagcaatatttgtcatatgggggaatttctatataaggtcactctattgggcggcggggaatggtctcgtggccttttttgggtgttaactctattgtttcttatgttgaaataa

SEQ ID NO: 29212 - DNA, 181 bp, Homo sapiens
ctgatgcctgattgttatgtttatgaacaaacaaggtgaagggttcagtataagttggaaatcctagagcaaccatatctgttactttccatcctggttatatttcttaattagactgcgaagttctgaatgaagtcctttttaaatagagcagttaatgccatttctgtctctgcaggtc

SEQ ID NO: 29213 - DNA, 217 bp, Homo sapiens
caagtagtagacggggtcagctacctccttcaggagatctatggaattgaaaacaagtacaacacacaagattctaaggtggctgaagacgaagtgagtgataacagtgccgagtgtgtggtgtgtctctcggatgtccgggacaccttgattctgccctgtcgccacctctgcctctgtaacacctgtgcagacacgctgcgctaccaggccaaac

SEQ ID NO: 29214 - DNA, 196 bp, Homo sapiens
  misc_feature 19: v=a or c or g
agctgaaaaactctccctvagacaggaaaggtagaagacctcctcatccctttctctttggcagtgagatcttaaggtcaaggtgagtagtaggccaggcgcagtggcttaggtgaaggccacaccagacttgggcctacgtcttggccttccaggtcagcagagtggcctgggacttggatgccttggggtcacc

SEQ ID NO: 29215 - DNA, 204 bp, Homo sapiens
tatacaccacattttcattgtcatttgccatttagattgcttccatgtcttgtcttttgtaaataatgttacagtgaacatgggagtacagatatttgttaagagggtaaatcttaggttgtgttcttaccacatcctccaaaatcataataaataaagaagatagaatggggggattggagaaatgtcggtcaaaagaaacat

SEQ ID NO: 29216 - DNA, 138 bp, Homo sapiens
  misc_feature 92: r=a or g
gtaagaattatatcaaattcctttttagcttttaatgagctatccatatggtttcttctcttttgacccatttatgtaattaataacataartaacatttactagtaggggaacatttgtacatatctgggggcgaac

SEQ ID NO: 29217 - DNA, 106 bp, Homo sapiens
cactttaaatggtttgtcattgtgtttataaaatctcattatattgagagttccatgaggaaagaaagaagtttcttaaaataaattctactcaacaataagctcc

SEQ ID NO: 29218 - DNA, 170 bp, Homo sapiens
caaaaagccatagaacttggtcatgttttccattttaaaatgatttactgaaacaaagtaatactaataaaaacccacaggcaccaaacaggctgcttaaaatggtctgttaaagacattttttggttatggaatataagaaaagttttgcacatctgtaagggggcgac

SEQ ID NO: 29219 - DNA, 275 bp, Homo sapiens
tttaatggagaactcaatttaactttgttcttttttctactctttaattaaagggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcccc

SEQ ID NO: 29220 - DNA, 233 bp, Homo sapiens
ttaagttaaggaagtttgtagccaggtgtggtggctcacacctgtaatcccaatactttgggaggccggggtaggagtatcacttgaaatcgggagttcgagaccagcctgggcaacatgtgaaaactgtgtttctactaaaaataattttttaaaatttaatttaatttaaaaaaggataatgttacgcatcatatgatgctatgctagagttgagttgtgagaccaagccg

SEQ ID NO: 29221 - DNA, 287 bp, Homo sapiens
ccagcattcatggatcacatatattatatacgtatttagtgaaaaacaatatatattatttaattttgtttatttttctatttttgttcaaaatggtctctaaatgcaggccaaccacggtgtgtatttaactccccaaacaggaatctattccagtcttggagggatttgctgagagatgatacagtttacacaaaaccacgtatgctccacactgtggactatctggggaatttttcaagagtaatttcaacacactctattttccatccaattcactgccctat

SEQ ID NO: 29222 - DNA, 246 bp, Homo sapiens
ctgcaattaaattaaaaagggttttgtcccatagcctccaacctcctttctggtcctctgactagaaacagcaaattgttccttggactatttttctctctgtcagctagcatttccagttttcctgttaaatgtcttttttctttttccttttttttgagacaaggttttgctctgttgcacgatcacagctcactggagcctcaacctcctgggctcaagtgatcctcccacctcagcccccat

SEQ ID NO: 29223 - DNA, 295 bp, Homo sapiens
cctcattttctcctggcgctgccatgtaagaagtgccttttgcctcccgccatgattcggaggcctccccagccatgtggaactatattttctaaaagtaaagactttaaagaaaggcacaggaggctgggagcagtggcttacatttgtaatcccagcactttgcggggctgaggccggaggactgcttgagtccaggagtttgagaccagcctgggcaacacagtgagaccccatctctacaaaaaattaaaaattagttacacggtggcttgactgtgcatgactggagact

SEQ ID NO: 29224 - DNA, 345 bp, Homo sapiens
  misc_feature 74: s=g or c
  misc_feature 86: r=a or g
  misc_feature 96: r=a or g
  misc_feature 97: m=a or c
  misc_feature 101: s=g or c
atgctggaggctggagcctacagtggctcacctcgctgctgcggttggtggccgcgagggtgactacagcgcascagaatggtgaraaggtggcarmatasgcttatctgactttgcctgcccagttgctccgtgccaggaggaggagccacttattccatgctggaggctggagctgggggcaccgcagctcaccttgctgtggttggtggtggcgatggagactacagagcaccagagcgagagtggtcacggctgaacaatttcaagaagcgagtcgatgtctcatctccctatcttatcttgaaaaacccgtgtacctaagtcgtggatgtgtctgctgca

SEQ ID NO: 29225 - DNA, 292 bp, Homo sapiens
  misc_feature 100: k=g or t
  misc_feature 109: w=a or t
  misc_feature 121: k=g or t
  misc_feature 129: w=a or t
  misc_feature 229: m=a or c
tacagaatcattccaagaaccagcccattgctacagctagagtggagaaaaacagagtgactcaaaagccatgggtaccatgatatcagttttgttgggktgtatttgwcggtttgttttktcattcawgttgaagtgctttgcaaggcttcaggaaacagagttgtgaggagaaagaagaaaatggctgcccatttcagtaccctttcaaaggtatctctgcctaggmacattcttcagaaatgcaacttcttctatttagaaggtgacctcctgacagcgttcactctca

SEQ ID NO: 29226 - DNA, 244 bp, Homo sapiens
aaaactgtttccttgatgttgcaatggtgtaatccagtgagaatagatgactggctcaaagtaagcactcaataaatattgactgtgttgactctcattactttaatcattagtatctttaaatacacttaataaaagcctttcttaacaagcatagctggaggcctttcaggaaacaataagatgataataactaacacttaccgagcacaaatttgtgttttacacactctgctaagcacag

SEQ ID NO: 29227 - DNA, 395 bp, Homo sapiens
  misc_feature 95: m=a or c
  misc_feature 286: k=g or t
  misc_feature 287: d=a or g or t
  misc_feature 295: k=g or t
  misc_feature 330: h=a or c or t
  misc_feature 332: k=g or t
  misc_feature 350: k=g or t
  misc_feature 352: k=g or t
caaagtgagactcttgtctcaaaagaaagaaggccaggtgcagtggctcatgcctgtaatcccagcactttggggggccaaggtgggcggatcamctgggggtcggaagttcaagaccagctaatttttgtattttttggtagggacagggtttcaccatgttgcccaggctggttttgaactcctgacctcaggtgatccacctgcctcggcctctgtaagttctgggattgcaggcatgagccacctcgcctggcaatgttgcactttttagccctccaactckdctctttgkttgtgtgtacacataccaagttgtcagcgcgggchtkccttgccccagaactgtktkgcggcaggtctcacggccgcgatgtatctgatcacatgaacac

SEQ ID NO: 29228 - DNA, 232 bp, Homo sapiens
  misc_feature 98: y=c or t
  misc_feature 99: m=a or c
attataaaacggatatagtaacacccagtttctttgtgaggcttaagaaatataaaaaatgctaaatgatggctgggcactgtggctcacgcctggtymatcctagcactttgagaggccgaggcgggtggatcacctgaggtcaggagtttgagaccagcctggccaacatggtggaaccccatctctactaaaaatacaaaaattagccaagtgtggtggcgggcgcctc

SEQ ID NO: 29229 - DNA, 147 bp, Homo sapiens
  misc_feature 90: r=a or g
  misc_feature 93: m=a or c
tagcaccatgtgtgcgcttcacaagaagacgggatcagaagcaaaggacccaggtacaaaccatagatacatcaaggcagcaaaggaggraamctgcctgctccaccggtgaaagctgaaaaaattgagacatcttcagtgactacc

SEQ ID NO: 29230 - DNA, 88 bp, Homo sapiens
  misc_feature 56: r=a or g
aactttcatgagtatcttatagttttccttatagaggtctttcacccactttgttraatttattcctacgtatttggttcattttgta

SEQ ID NO: 29231 - DNA, 135 bp, Homo sapiens
  misc_feature 90: r=a or g
  misc_feature 102: k=g or t
ccttaattaaaaagtttcaaatctagacactaaatgtgtgtgaatgtacaaagaaaacaaaccattgcttatgctgttatatactagagraatttttgtttkgcttgctgttttaacttgacagatgaaggacgg

SEQ ID NO: 29232 - DNA, 359 bp, Homo sapiens
  misc_feature 110: k=g or t
  misc_feature 293: d=a or g or t
  misc_feature 310: r=a or g
  misc_feature 350: s=g or c
taaggacgaggcggaggctgaggaaggcagcggggagacccaggctgcagcaacaaagggcagcgagcgattggccgggctgcaggcgagatttgcctgaagacctggakaatctccatttttgtcatggactgttaaaacgtttgaagttccaattctggtcttgatttcccagttaaagatgttcttcacccgaatgcagtctttcctgttggtaaaataagacaaccatcaacattgcctgtttgtctgcttttgaatctcttaaggatggatgtttgtaagatgttgcdtaatacagtctggaatrctctgtccatttgttgaattgtaaatggctttcaaatgtsaagttctgt

SEQ ID NO: 29233 - DNA, 171 bp, Homo sapiens
atgtgtataccatcccttcccccaaatattgttcagattaaagtgtctttctctctgtgacctgcaagtatcttaacttagcatgtgtgtccaatttccatagtgaagccaaaaattcaaatgatggttgatattggcttaggaagaatttattaatgaatgactgtgcct

SEQ ID NO: 29234 - DNA, 205 bp, Homo sapiens
aagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggt

SEQ ID NO: 29235 - DNA, 182 bp, Homo sapiens
atttttcgcacgacgcagcggttgggaacacagacattttcggagctggagccgccactgccgccgccattttgtgtctgtggagaaagaagcttctgtggcggctggaagtggacggagatcacccgcgagacggcggcgtttcatacccgaggttccccctgtgtcgtcccccatcccaa

SEQ ID NO: 29236 - DNA, 351 bp, Homo sapiens
  misc_feature 230: m=a or c
  misc_feature 267: n=a, g, c or t
tattgtgtcttgagttgaaaggcagggcagttagcaacacagttcagatttcagtactgcccctgaaatctgaactgtgttcaaagtctaaaacgtttaccttagcaaatccctcataaaactccatttggaagagtcccgagagctaatttgtaaagtatacttgcagaaggtagatgaggagacagattaaatcttattacctctttcagatgagaggctcttgagtmctgctcagctatgagaataagaggggaattaattctnatagaatacacttgttctcgcatagctgttgttccccaccagaaccaaatgagctcaagatctgacaaagaaaaaaaaaaaggt

SEQ ID NO: 29237 - DNA, 195 bp, Homo sapiens
  misc_feature 84: k=g or t
  misc_feature 86: k=g or t
  misc_feature 90: m=a or c
ctcctgagtagctgggattacagctgtgcaccaccacacccggctaatttttgtatttttagtagagacagggtttcaccatgktkggcmaggctggtctcgaactcctgacctcaggtgatccacccgcctcggcttcctaatcgaaaactcctgagtagctgggattacagctgtgcaccaccacacccggcc

SEQ ID NO: 29238 - DNA, 182 bp, Homo sapiens
  misc_feature 91: y=c or t
caatgattattgtgtatcttattttcactttggaaaagcattatcaaatctgaaaaattggattgtaactagaaaagtttgaaaagttttycaaacttcactttctcttcataaaatcgatactgcctgccaacagttgttccttgtgtgtgccaatatctaagtatcacttgaccccaccg

SEQ ID NO: 29239 - DNA, 130 bp, Homo sapiens
gatcacgccactgcactccagccttggggacagagcaaggctgtgtctcaaaaaaaataaataaataaaatggtctttctcaaaggtacataagtgggttcttcagaagtcactattagaagaggagagg

SEQ ID NO: 29240 - DNA, 201 bp, Homo sapiens
caccagaattgcttagaaattatctgcaggctttagggatttttgcttatcagtatatttcatttgccccattgttcagcccatccaccacctccttccatttgttctcagaaactaaactaggagaacataagcacttggttatgtgaaaatgtacttatgattcttccatgaaaacctaaagtattaaaaacccaacac

SEQ ID NO: 29241 - DNA, 253 bp, Homo sapiens
gttcgagatgttaatcatagagttcccatatcacctagcaattttattcttaggtatgtgtccaaaagatgaaaaacacgtacatgaatgcttgttatagcattatcataatatccccaaagtggaaacaacccaaatgtccttgaatggaagaataggtagataaaatggggtatgtccatacagtagaatattattcagcaataaaaaggagtaaagtatttatacatgctacagcatggatgaatctcaa

SEQ ID NO: 29242 - DNA, 213 bp, Homo sapiens
  misc_feature 18: m=a or c
  misc_feature 19: m=a or c
agcggacgccgccgccgmmgccgccgccgcgtacctagccaggtccctgaggggcgggcagatgaggcctaggggtgccgatccctaagtgtcgactatgcgagatctgattccggagctgccatgattgaagtggtagcagagctcagccggggtcctgtatttttggctggggaggcgctggagtgtgtagtgaccgtcaccaacccccgt

SEQ ID NO: 29243 - DNA, 243 bp, Homo sapiens
tgtacctgtctactagaagttttccatcttttcacatttgcatcttgtcacgtttttagtttttccatggctgtattttcagagggtgcacttaatttggaatctgctacaaaacttggtttttatttactgtttggaaaattctgaaattaggacacttactactgcttgtttatcctgatggtctacagctcaaatcccagccttctatatggacacaagtcatttattcaatacccaact

SEQ ID NO: 29244 - DNA, 96 bp, Homo sapiens
agaactgtggacagatctactggcgagcgatgaaaatgttgcagggagagtcagcagaggcatttgtagctaaacatgctatgcatcagactggca

SEQ ID NO: 29245 - DNA, 141 bp, Homo sapiens
ttcaaaatatctaaaaatgatatacttttctctcatttttgcttgctttggggtacctccttattttttaggtttatcggagcttattgctaatgcttattactactatcaaaatactcttttttttcccctctttccccc

SEQ ID NO: 29246 - DNA, 67 bp, Homo sapiens
cggcctctctgcttatctttggtgtcttataatttctgctttttaaatattggctcgcccatcccac

SEQ ID NO: 29247 - DNA, 282 bp, Homo sapiens
  misc_feature 92: k=g or t
  misc_feature 111: k=g or t
cagtaaagatataatctggcatatttcagtaataaaactccctaatactagtggcctaattcttgcccctgttacatatcctttgttggttkggaaggggggacttgatckgcttattgtaattactttagaagtccagctattggagctatctccatcttgcaaattgctagatcttctgccccaaagggaaggagaacgctccagtgcagtgtcacatttcctacagctcattgacagaacatgtcatatgctcttgacagatcacagggagggataact

SEQ ID NO: 29248 - DNA, 316 bp, Homo sapiens
  misc_feature 98: m=a or c
  misc_feature 238: y=c or t
ttagacttgatattgaaacttgatgacaagtgcttaacaagcagatattgagcatgctggttgccaaaaaagttatgaaatgcaaaggaagttcatamcatattctagaatctgtcatttcaggtattccaccactggaagtcctcgctagacctacatccctccatgtgtcgccctgacttgctttgccccctgaggagtgtgctttatggtcagcctttctccttctgttgattcytccccgggcccagcagctattgcaagcttctctcatattaaaagtgtagaaaacagcagcactcccaaccccccccaa

SEQ ID NO: 29249 - DNA, 180 bp, Homo sapiens
  misc_feature 96: r=a or g
tagtctggtgcagttattcatgcagctcaaaccagtgttgttcaagggtcaactgtagtcttaagaggcctctatgacccttcagagacccctggragctaggatggcattttagagttgcccctgattgaggcaagagggaatggatcagtgcagctcaacactaaccaggtgtacccc

SEQ ID NO: 29250 - DNA, 291 bp, Homo sapiens
  misc_feature 103: k=g or t
  misc_feature 143: n=a, g, c or t
  misc_feature 232: r=a or g
  misc_feature 245: k=g or t
tgtcttacttcgcttttgaatgacatttttgtggacaaagaactttagggtaaggggatttcttttcctcttaagtactttaaagatggtgttctatctttckatttgcatttctttttctgatgatatgtgttatatttatnatctttgatccttcacacctttttttccctattatctgcctttaagctttcctgtttgtcgctggtttcgagaaatttgattattttgrctgtatgtaattktctatgtgttcttgtgtttgggttttgttcattattttagatccgt

SEQ ID NO: 29251 - DNA, 80 bp, Homo sapiens
ggcaacttgtttggtgctagtcattaggcacatcagttcttaggaaattctggagcatcttttggagacagtgaacatct

SEQ ID NO: 29252 - DNA, 221 bp, Homo sapiens
  misc_feature 93: d=a or g or t
aattaacagtcatggctgttattcatatttgattcttagttttgtcatgcatttgtagcatagtaggaatctgtacctctgacttagcaaatdaaaatgcctttggcaagttctctcattcattaatggatatccctgagccatttcccatcccctttcaacctttatttagagccattgggataggtatagattaagacaattgggaaagtgagagccga

SEQ ID NO: 29253 - DNA, 295 bp, Homo sapiens
  misc_feature 236: v=a or c or g
  misc_feature 237: w=a or t
caaatgatattctctaaatcacttcgaccaataaatgtattctcctccttaaagcagagttgtatcaactctgtgggagcatttatgagctgtcagtccccacacttctagccagaatcacaataaggtctggctgggtgtggggtgctgcataggaaagggtctctggagaagcaagaagggcacaatcatggcccactgctcccctcttcttctcagtgctctttgccctctcvwgctgcgtgcttcctcttcactccagtgctgatcctcctgctctctctggcagcttcca

SEQ ID NO: 29254 - DNA, 173 bp, Homo sapiens
agttggtttgttgtttggtttaaagacaacagcccctgagctctattaaatggaacaagttcgagagacattcctaaatgtccagacaactccacagcgcgcatttctctccagcagcgggaagattcagagacctcgagactgaacacccaaatctcgctttccaggaccac

SEQ ID NO: 29255 - DNA, 268 bp, Homo sapiens
  misc_feature 89: n=a, g, c or t
  misc_feature 95: n=a, g, c or t
  misc_feature 109: m=a or c
  misc_feature 130: s=g or c
tccccgagttctggggctcagtcggctctagctctctcctgccgccggcgccactccagaaagctgtgggtacccgggagcggagcgcncgcggngtgtgctgggcgcmggtggaggggggaacagcgasgattagacgccgggaagcacttccccaacatctgcgagagaatcccatcatcgcgtgcacatctcatcccaggagggagagaggagctgccgagtagaaagcagactggctgcagggacagaagacaccaagggcacc

SEQ ID NO: 29256 - DNA, 145 bp, Homo sapiens
ctactgcagaatcaaccccaagaccgggggcatcgtcatgcttggccggagtgacggcaccctcaaccccaacggggtgcggttcggcagctcggaaatctataacattgtggaatccttcgaggaggtggaggacagccttcac

SEQ ID NO: 29257 - DNA, 354 bp, Homo sapiens
tcagaaagtcatcattcttgggaagactttggaggtgcctattttttctgctgtaattgttctgggtagatggagtataaacatttgaatggaaaaaaattaacctagaatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctca

SEQ ID NO: 29258 - DNA, 357 bp, Homo sapiens
tagcacattaatacgtttatgtataaaagttatatgttgaaattgtcttttcaaggggttatcacacaacttctctatagtctgttataatagtttccttttctaaccttcttgtaggctttatgacttagtcaaaatgaaagccaaactcacctgtgaaaaatatatacattttatatattagtaatctattatttattttgtcatgctagccctaatacaattaaggttatcaccttctttctctaatcaataccaagaaactctggtctgttattatttatcctgaaactaatttttattctagattctacctgtaccatatgtctgatttttcatgatcttgtgggttggttt

SEQ ID NO: 29259 - DNA, 96 bp, Homo sapiens
aaattatgaagatcccaattatatttgatgaatatgtgttaattcagcactaccagtaaaaatatttcttgtcaaaaattttagttaccagaaacg

SEQ ID NO: 29260 - DNA, 121 bp, Homo sapiens
  misc_feature 96: r=a or g
caatgtatgtgtgcaaagccactaagaacaaaaatgtactttcccaagctaattttcccatgtgtccaatgaatgttttaaaaggtaacaacttaraaaccaataatattgattttttttt

SEQ ID NO: 29261 - DNA, 193 bp, Homo sapiens
  misc_feature 118: b=c or g or t
  misc_feature 119: n=a, g, c or t
taaaaatcttttatgttctacccactccttcctcgttccctctccccactcctccctccccccatcttaagcccatggcaacccctgatctttttactgtctccatcgttttgccttbnccagaatgccatgtagttggagtcatatagtaagtagccttttcagttggcttctttcacttaccagtgtgccc

SEQ ID NO: 29262 - DNA, 206 bp, Homo sapiens
aggatcattaaagaacaaaaatgagctcttgtaaattaaaaacatcaaaatatatatgacatgtggaacgtatagaaatgttgacagattatccccagtattgggaaaagattgtttacagaactttaaaagcacattgctcatgtcaaaaagtggaatgaatttgtttatgtcagaattaaagagttctgtgcattgaagggaac

SEQ ID NO: 29263 - DNA, 186 bp, Homo sapiens
tatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgc

SEQ ID NO: 29264 - DNA, 350 bp, Homo sapiens
  misc_feature 198: w=a or t
atagcaaaggctctcctgggatcgcacaatgctgcaccggaagggaaggcatgaaagcacctgggagagagggagaaagcacaggggggtgtgagtagatagacctgggctgagcctcagccttgatggcactacagctgtgagagaaagagggtgacacaggtggacctccagaacgagtgaggagccccctgaacwgcagttgcctccagagtcaagcagtgcccatggcacgaatgattggcagaagacgtggacaggtaccgtggaagagggaagtagaaaagaggaaaggatcaggagatgagaaagggaaaaagaagagaaagagagagggagggaggaaggga

SEQ ID NO: 29265 - DNA, 274 bp, Homo sapiens
agaagtcactatggtgacggggaggtaccaggtatttgagagcaatcgccaccgctttcctggaacttgagtaaatacaatcaagtggcatcttaaatttttgctggaagtggagtcatgagactaaagatatctcttttaaaagaaccaaagcatatccttttaatgcttataaatcttattggattttcttaattatagtattgttaaaagtttctctattttatatcctagttgaagaatagattttttttttcattcctttagtggcttc

SEQ ID NO: 29266 - DNA, 162 bp, Homo sapiens
agttctgcagttggaaaatctgactggggcagcttctgagcgcaggctgggcctgcacacactcagcgggccgagtggccacctccttcagagctgctcagcacgccctgggatcgcgggcggttttcatcggccggtttgtgaaacggacaagagagaggt

SEQ ID NO: 29267 - DNA, 148 bp, Homo sapiens
atttacgttctttacactacggggactggggtcgtctttgcccacgtcccgacaacttgttccctgaccccctcagggatggccccaaactgtccctgcctctggcaccccctttcattggttccatccatccccacaacaacctgcc

SEQ ID NO: 29268 - DNA, 426 bp, Homo sapiens
  misc_feature 279: n=a, g, c or t
  misc_feature 280: s=g or c
  misc_feature 281: m=a or c
  misc_feature 369: w=a or t
  misc_feature 370: r=a or g
cagatatgtgttgagacggattctccgccgagctgtccgatacgcccatgaaaagctcaatgccagcaggggcttctttgctacgttagtggatgttgtcgtccagtccctggtaggtttatttctctgcttacccttctgtgctaaagcagtccgttaagagggatggagtgggagagggcatactgttaagcagctttttgttgctgttttttgagacggagtctcactctgtcacccacgctggagtgcaatagagtgatcttggctcacacctgnsmatcctagcactttgggatgccgaggcgggcggatcacgaggtcatgagttcaagaccagcctgcccaacatggcaaaaccccgtctcwrgctaaaaatacaaaaaattagccgggcgtggtggcgggcacctgttcccagctact

SEQ ID NO: 29269 - DNA, 94 bp, Homo sapiens
gaaagatgagaaggagaaggaaaaggaggcggagaaggaggaggagaagccggaggtggagaacgacaaggaagacctcctcaaggagaagact

SEQ ID NO: 29270 - DNA, 321 bp, Homo sapiens
  misc_feature 64: m=a or c
  misc_feature 65: w=a or t
  misc_feature 72: h=a or c or t
  misc_feature 86: w=a or t
  misc_feature 278: n=a, g, c or t
  misc_feature 279: k=g or t
  misc_feature 282: d=a or g or t
  misc_feature 309: k=g or t
tctagtttttcttttactgatttttagttatattccatttggttagagaagatactttatgtgmwttcagthttttaaaatttatwaagacttttttgtggtttaatatccattctgtcttggagaatgttccatgtgcatttgagaataatatgtattctgctgttgggtggcatattcagtatgtgtcttaggtctaagtggtttatatagtgttatttaacttctctatttccttattttctgtccagttctatccattattgaaagtggggtankgadagtctccaacattattacacatctatktttcccttcagt

SEQ ID NO: 29271 - DNA, 177 bp, Homo sapiens
aagtcgccggcggcgcccgacggagcaggtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaa

SEQ ID NO: 29272 - DNA, 308 bp, Homo sapiens
cgaatgattttcctcttttcaattaaacccatccttttccttcattatcttttagttcttaagacagaagagcaagataagtctataattgtctgtcacaagatgaaggtagaggcacattatacaaatacagacctgaagaagtagatattgatgccaagttaagccgattatgtgaacaagataaagtggtgcatgctctggaagagaaacttcagcaactccacaaggagaaatacacgcttgagcaagctttgctatcagccagccaagagatagaaatgcatgcagataacccagcagccatc

SEQ ID NO: 29273 - DNA, 138 bp, Homo sapiens
ttaaggtgtatattttattttttttattggcttagttgttttttgttttgttttgtttgagatggagtttcactgttgcccaggctgggggtgcaatggtgtgatcttggctcactgcagcctccacctcccgagtac

SEQ ID NO: 29274 - DNA, 179 bp, Homo sapiens
acccgggaggcagaggttgcagtgagccgagatcgtgccactgcattccagcctgggtgagggagctcaaaacaaaacaaacaaacaaaaacaaaaaaaccaagtgttaacgttttaggataatgacattaccccacgtgggtacaaaaatgatgagcatgtctcagttctgcagggca

SEQ ID NO: 29275 - DNA, 355 bp, Homo sapiens
  misc_feature 79: r=a or g
  misc_feature 254: n=a, g, c or t
  misc_feature 256: n=a, g, c or t
  misc_feature 347: v=a or c or g
atttcttctagtcttagttttagctgtgacttttctgtgtaagactcacttatgcctcttccaggctcctgccttctgrctactatggggcttctcagagtcaataatctcccctaacatattcttccttctgtattccactagttctattaatggcaccatgggtcacccaacccagagtcatcagtgtatcattctccctcactgcccctagccaatttgctaaatcatgtcatccctaccagtagcagatncntattttccaaatgtcaatgcaacagtatatctgtaacacatgttcttcgagaactttgcactttcctatcaagagatggagtttttatcavccctcctt

SEQ ID NO: 29276 - DNA, 372 bp, Homo sapiens
  misc_feature 261: n=a, g, c or t
  misc_feature 366: r=a or g
aaaatgaggtacgtgatgcgtagtaatgtgtggccagcatgtgaatagttcggactttttgcatacattgagaaataaatagacatcccctgaacggtctcaactttcagcctaattcagcaatgctccttctaccctttgcttctgttgtgacgccaatgggtatatcagtgaaaaagatgaaaaattctttgccattatgggtttgtgcccctcgagaaatagttcagaggacccttgaagaaagaaatgaatggaatntatcaggctaatgtgaaaatacaatattagtgattgttagaggacagtgttttgcctgtaacattttaagtgtaattttgtgtttgtgtgtatgctgggagaggrcaaaat

SEQ ID NO: 29277 - DNA, 179 bp, Homo sapiens
gcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactagta

SEQ ID NO: 29278 - DNA, 351 bp, Homo sapiens
tttaaaagttttaaagtgctgaatatgtttggattatctttgtctctggattggggttcagtgagagttaactatatttttttaatggtaccctgttagtatcaccaagtatttatattttccttcatgaaggagctgtacaagtattttgcatcctcaccatatatttggaaggcagctaactgtaaaagatgccacattcagccatatccaattgccacctatgaagagagaaaaggagaaaattagttggtgtctttcccccttttttcttccaccccttctacccatctcttacataccctggattgagggggaacagtaactgatttagactgaccagttgcctgt

SEQ ID NO: 29279 - DNA, 229 bp, Homo sapiens
gatgttgtgtttttcatttcaaattccacttgttcattgttggcataaaggaaaacaattgacttttgaggagaagacccaagatggctgaccagacacagccaggaagagcatctcccactgagagaccagaccatcaagaagacggacacactctgagcatgtctttggaaggacggcattgagagtggacagagggaggatgtagaccctgggctgaaggagtagg

SEQ ID NO: 29280 - DNA, 195 bp, Homo sapiens
cagcctggccagcatggtgaaaccccatctctgctaaaaatacaaaaaattagctgggcatggtggcgggcacctgtaatcccagctgcttgggaggctgaggcaggagaattgcttgaacccaggaggcggaggttgcagtgagtggaggtcacgccatcgtactccagcctgggcaacaagagtgaaactcgc

SEQ ID NO: 29281 - DNA, 279 bp, Homo sapiens
  misc_feature 88: r=a or g
catatcaaagggtgagaatcatttagcatgttgttgaaaggttttttttcagttgttctttttagaaaaaaagaaaaacaaaaacaaraacaaaaatcacaccattgctcacagaattggcatctcatttttgggacctcccatctttctgttttgaaaagtgtacagtagtgcagtgttcctgatgtaactttatggcttacaatgttgacatgtctcaggttcatgtgtttcgattggtgttttccgtctcaggtagattgcaaagtgtaggccccc

SEQ ID NO: 29282 - DNA, 204 bp, Homo sapiens
  misc_feature 15: r=a or g
  misc_feature 16: s=g or c
  misc_feature 131: d=a or g or t
  misc_feature 132: y=c or t
tccacaatggttgarstaacttacactcccaccaatgatgtaaaagcattcctatttctccacatcccctccaacatctgttgtttcctggctttttaatgatcgccattctaactggcgtgagatggtadytcattgtgatttttgatttgcatttcttgaccagtgatgatgagctttttttagtatgtttgttgaccgcat

SEQ ID NO: 29283 - DNA, 93 bp, Homo sapiens
ctaggaataaccttagttgggtatatggagtaaactgttactgagaaatatttttaaagtctgaggaaatggaaatttctttttctttttttt

SEQ ID NO: 29284 - DNA, 50 bp, Homo sapiens
  misc_feature 16: n=a, g, c or t
  misc_feature 17: h=a or c or t
  misc_feature 29: k=g or t
ctcttaattcctattnhcttcttgatgtkccttttgcagtcatgttttgt

SEQ ID NO: 29285 - DNA, 117 bp, Homo sapiens
  misc_feature 97: k=g or t
tgttctgaggggtgtccgagaggctggtgtatgcactgctcacggaccccatgttggatctttctccctttctcctctcctttttctcttcacatckcccccatagcacccaacccc

SEQ ID NO: 29286 - DNA, 146 bp, Homo sapiens
  misc_feature 122: w=a or t
  misc_feature 126: r=a or g
  misc_feature 128: w=a or t
  misc_feature 129: w=a or t
  misc_feature 140: k=g or t
aggctatgcatgtgggaagacagggaatctatggaaaatctctgtactttcatctcaattttgctagggacctaaaactgctttaaaaaataaagtctttattacaaaaatatttttaaatwggcrawwaagatctaagkagacat

SEQ ID NO: 29287 - DNA, 124 bp, Homo sapiens
  misc_feature 25: s=g or c
  misc_feature 51: w=a or t
atataagtctactgagtcgagcagsccgtgctgctggggtagccccttttwtattcatttactttcttaataaacttgctatcactttgtcagcttacttttgaattcctgcatgaagccagga

SEQ ID NO: 29288 - DNA, 118 bp, Homo sapiens
  misc_feature 8: k=g or t
  misc_feature 9: k=g or t
  misc_feature 15: r=a or g
  misc_feature 66: m=a or c
tgagagakkatagarataaagacacaagacaaagagaagaaaagacagctgggcccgggggaccamtaccactaagacacggagaccggtagtggccctgaatgcctggctgcgctgt

SEQ ID NO: 29289 - DNA, 109 bp, Homo sapiens
  misc_feature 14: k=g or t
tatgtgtagttcakaatacttgataatgagaataaatgaccgtgttactgatttatgtatttactatactttttatcgttagagtgtatatcttctgcttattaaaaaa

SEQ ID NO: 29290 - DNA, 117 bp, Homo sapiens
  misc_feature 15: k=g or t
ctttctaaaggactktacaagaagggtttctatggaatattttgctagctgtggtgttcaccgcatccctctagtcttagaagagaagattattccttttttctgtagtcattgagt

SEQ ID NO: 29291 - DNA, 50 bp, Homo sapiens
  misc_feature 16: k=g or t
  misc_feature 17: w=a or t
  misc_feature 18: v=a or c or g
cttaaggtaaaaaatkwvaaaggccctctgagtcttcagaggaggattaa

SEQ ID NO: 29292 - DNA, 124 bp, Homo sapiens
  misc_feature 57: d=a or g or t
  misc_feature 58: r=a or g
  misc_feature 59: s=g or c
  misc_feature 87: r=a or g
  misc_feature 91: m=a or c
gccggtaagtcgtccagcggagcggctgcgagccccgcggccgggtggggtgaggtdrsgtgcgcttccggggaaacgcagctgcgrtcgmtcgggaaccacgcctggcaggtcaggcagggtc

SEQ ID NO: 29293 - DNA, 127 bp, Homo sapiens
  misc_feature 14: r=a or g
  misc_feature 15: k=g or t
  misc_feature 127: k=g or t
taattaaaaaacarktattaattactaggggaaaggagtgttcgttctacccagggtaccacagttccccacagtcaaaacccaaaagcaaggagatgagttgaaagacagtttttctttaagtcak

SEQ ID NO: 29294 - DNA, 102 bp, Homo sapiens
caggaatattatttgtgttctagacttttaaaacagacatggatgttaaaattgtcatccagttttcctcattttacagatgagaaattaatccccagagac

SEQ ID NO: 29295 - DNA, 117 bp, Homo sapiens
caaatagatagttagatatttagaatctggagctcaggagtcctagagatccagacttagtcatcagaatataattgatatttgaaactgtgggactacatagctttacctagggat

SEQ ID NO: 29296 - DNA, 210 bp, Homo sapiens
  misc_feature 153: k=g or t
ttgttttagttctttggagattctcgatattagccctttgtcagatgggtagattgcaaacattttctcccattctgtaggttgcctgttcactctgatggtagtttgttttgttgtgcagaagctctttagtttaatcagatcccatttgtktattttggcttttgttgccattgctttcggtgtttcagacatgaagtccttgcccac

SEQ ID NO: 29297 - DNA, 178 bp, Homo sapiens
atttttctgcatatggatgtcttgttttccagcaccatttattgaagagactgttctaacctcaatgtatgttcttaacacctttgtcaaaaatgacttcagtggaggtgtctgaatttgtttctgggatctcttttgtgttccattggtctatatgtctgtttttattccaggacat

SEQ ID NO: 29298 - DNA, 294 bp, Homo sapiens
  misc_feature 161: s=g or c
  misc_feature 162: k=g or t
  misc_feature 163: k=g or t
catttcaaggacacgatgagaaaaagctaatgcatctctcctgctcttctcactactcaagctcaggaaaaacagcacccggcatccaaagagtgggtgggcttaaggatgtaaagggtccaaccttgacgggtgggacagcgactggctggtgaagtcaskkagctcttgctctagtctccaccagggtgacaccagccagtcgtctggccattcaggcacttgtttgtcctgctcttgctaattgggttggcatttggcttgtcaccaggtatttgggatgctcgcaggggg

SEQ ID NO: 29299 - DNA, 230 bp, Homo sapiens
  misc_feature 32: r=a or g
  misc_feature 112: w=a or t
  misc_feature 141: s=g or c
  misc_feature 164: k=g or t
  misc_feature 227: r=a or g
  misc_feature 228: r=a or g
cagagaaatagtggttcctacctattggggargggagatagacctggtaacaagtaagtgcggtatgttcttgcgtggtgtgtacagagaggttgaggtgggttttcaaggwaagcagcaacaatttgcttgtgtagatastatggaaggactatccagaagakatgacacaacagctgcatcttgaaaaagcagacaatagttcaccaagtggacagagaccaaarrca

SEQ ID NO: 29300 - DNA, 211 bp, Homo sapiens
ttaatatgattagtttactgataaattaaccagtaaagaaatgtagagatgaatgagataaaagaggcccaagcttggaccaatgataatgactgttggggtatgagtcactgaggttgaataaacagtttgtatctggaaatctgaggtccaacacaataaaaaatttagtctaattactctgatggaaatccaaaataaaagggctact

SEQ ID NO: 29301 - DNA, 273 bp, Homo sapiens
  misc_feature 1: y=c or t
  misc_feature 2: h=a or c or t
  misc_feature 3: w=a or t
  misc_feature 121: r=a or g
  misc_feature 129: r=a or g
  misc_feature 137: h=a or c or t
  misc_feature 138: v=a or c or g
yhwttcaatgagtttttctgcacagtttatctaaaacagtagccagtttgatgatccacctaagactgttaaattattaggatcatctactctaacttgaactaagcagaatgaacccaartttctttrttccaaghvagaactggttccagtttatcaatcagtctttcaaaatctatgaattattaggcacataataataattcataggtgcaaaacctatgaattattaggtaccctttaagtataaggctatgtaccaggaattatagg

SEQ ID NO: 29302 - DNA, 110 bp, Homo sapiens
  misc_feature 7: h=a or c or t
  misc_feature 8: n=a, g, c or t
  misc_feature 21: r=a or g
  misc_feature 42: r=a or g
  misc_feature 100: w=a or t
cagtathntattatctttgaraatcaaggagaagtttatgcractgaaaatgtttacacactgtgctgcaatctactgtttgtgaatgtcaatgtattawcaggaaacat

SEQ ID NO: 29303 - DNA, 233 bp, Homo sapiens
  misc_feature 111: r=a or g
  misc_feature 112: r=a or g
  misc_feature 128: r=a or g
  misc_feature 159: r=a or g
  misc_feature 171: r=a or g
  misc_feature 172: r=a or g
  misc_feature 226: r=a or g
  misc_feature 227: r=a or g
tgttgttttaacctgggaagtgttcttcctgcctttctgctaggtgtcagttagatggtcccagagctaggtgctgtgtcaggccctgaagacacagatgactcaacctarrctttactttccagagrtccacagcctgagaggtgtccccaaagaaarggggacatgagrrgactgcatgcttgagagcagggttgtttagggcaggtttggatttagtgagcarrctgggt

SEQ ID NO: 29304 - DNA, 102 bp, Homo sapiens
tcgtctaaattttttcttccaattaaggaaagtgccacaagcactaacaggagccaggaggaactctctcccagtccgcctttgttgaatccatccacgccc

SEQ ID NO: 29305 - DNA, 211 bp, Homo sapiens
  misc_feature 20: n=a, g, c or t
cccgggttcaagtgattctnctgcttcagcctcctgagtggctgggattacgggcatgcgccaccacgcccagctgatttttgtatttttagtagagatggggttttaccgtgttggtccggctggtcttgaactcctgacgtcgtgatctgcctgccttggcctcccaaagtgctgggattagaggcatgagccaccacgcctggcagct

SEQ ID NO: 29306 - DNA, 315 bp, Homo sapiens
cattaaaattcttctaaaacttgtatgtttagagttaagcaagactttttttcttcctctccatgagttgtgaaatttaatgcacaacgctgatgtggctaacaagtttattttaagaattgtttagaaatgctgttgcttcaggttcttaaaatcactcagcactccaacttctaatcaaatttttggagacttaacagcatttgtctgtgtttgaactataaaaagcaccggatcttttccatctaattccgcaaaaattgatcatttgcaaagtcaaaactatagccatatccaaatcttttccccctcccc

SEQ ID NO: 29307 - DNA, 222 bp, Homo sapiens
  misc_feature 34: s=g or c
gcccggtgttggggtctggtcggttcgtgcggasccgcgggccgcggcggtttactagcagctgacgagcttgcctgtccatccagctgacttggaattaggcttttcaggatgtccagcaaagaatcctgtgggaaaaaagagacatctcagaggaaagacaccaccacctcatcacccaattttggtgaaaaagacaagaaagagagaaaaaccccggcc

SEQ ID NO: 29308 - DNA, 308 bp, Homo sapiens
  misc_feature 121: w=a or t
  misc_feature 130: w=a or t
  misc_feature 134: r=a or g
  misc_feature 161: m=a or c
  misc_feature 227: n=a, g, c or t
  misc_feature 228: n=a, g, c or t
tcaaactcctgggctcaagagatccactcgccttgtataatgagaatttctaataatgagaattttactttgtcctcataaaagcattagaagtattcagataaaagctagattggtgatwatcgaaagwagartccctggactatcaacatcagtatcamctagagatgtgtaattatgatcaccaagctaaaaaaagctagtatacaagtaaaatggaacttatnngtataaaactgttgagaagttatttttaaatcaaaattgattttgaccatttaacactaactttaaacacagagattata

SEQ ID NO: 29309 - DNA, 86 bp, Homo sapiens
gactgtctttattgagaatgtcgtcacagtcctttagtgatagattagttagacccatggttgcaatacctttatctccccaaaag

SEQ ID NO: 29310 - DNA, 115 bp, Homo sapiens
agggatgatgattatgtgctaaagagacagttttctgcattggttcctgcttttaatcctagacctggtcgtactaatgtccagcagacaactgatctagaaataccacccccca

SEQ ID NO: 29311 - DNA, 73 bp, Homo sapiens
  misc_feature 7: m=a or c
agaaggmagaagaagagggggaggagaaagagatagaagagtaagaggagggggaagaaagacaagggggcgc

SEQ ID NO: 29312 - DNA, 67 bp, Homo sapiens
cctagtgctgtaactgtgatagagttgtcgtgagatctggctgtttgaaagtgtgtggcccctcccc

SEQ ID NO: 29313 - DNA, 366 bp, Homo sapiens
  misc_feature 133: r=a or g
  misc_feature 134: v=a or c or g
  misc_feature 302: v=a or c or g
agttcagttttattggttgcacgcacagtcagttatttcatccagaaaatctgaaggccctacaaactaaccagaatggaaaccatggggaaaatgtgaagtgtcaaattgacagagatgtttcattgatccrvtcattctccgaaagtgttttgttaagtatatgtgtgtattttatgtaatcaatttactaatgcagatacacatcagggaaaacatgaaagactcaatattaatgtgtctaatttttaagcataatttctgccattatgagtgcatcactttttattaacttgaaatavaatagccattgactggaagaatgaatctaacaggtcatacgttctctagaaagtcaactgttat

SEQ ID NO: 29314 - DNA, 149 bp, Homo sapiens
ctgctttctaaattcgcatttttcctggtgtacctttaatgtgaaccttttggcattcttctgcaattttctgattggagattgcattttgacctagtctgtaagtttttctgtcagaagaggactttcatcaactttcatggaaagta

SEQ ID NO: 29315 - DNA, 133 bp, Homo sapiens
gattcttggttaagtcgcttccattaaacagtactgattttaaaaactagtaatttaaaactgccacatgaaaaaaactgaaaatggatcacaaaacagtcatcttttccttctgaagatttcaccatgcaca

SEQ ID NO: 29316 - DNA, 147 bp, Homo sapiens
agcacctgcgctttcactatccaggcaattggtaaagctcataagaaaactggtttggaggtttcagtgagaattaactttgatcattcattcttaaattctttttttcactgatggcccagaataatttgacttgtatgaggacag

SEQ ID NO: 29317 - DNA, 134 bp, Homo sapiens
  misc_feature 115: r=a or g
tcgtagtatctaataccttttttgttagccttaaagttttggttttcctttttcaggaatacacagtgaaactaagtaatatccctacaattaagagattccttgaacctggcarcaagaagatgccccccccc

SEQ ID NO: 29318 - DNA, 302 bp, Homo sapiens
  misc_feature 121: r=a or g
  misc_feature 125: r=a or g
  misc_feature 129: d=a or g or t
  misc_feature 132: w=a or t
  misc_feature 133: r=a or g
  misc_feature 250: w=a or t
  misc_feature 251: w=a or t
  misc_feature 252: r=a or g
catgtaaaacgaactgagcggctctgtgcttaatactttgttttgcttatttcatctggatcctccagtgtcaacagtgggaacgaaaggatccaagctagtgtccttgaaaaaatatatratargcadaawracaaagaagcccatggtcaaatggtcatttatcagggtctttaaaagtcaagatcattattatttctttatggagacaaagtataattatgtaactgcagtaatagtgcacatctgwwrttttttcctgctcattacatcttcttcctttctttacaattaggacctct

SEQ ID NO: 29319 - DNA, 313 bp, Homo sapiens
  misc_feature 268: h=a or c or t
tacatgaatataacataaataattatcttttttaataaatttctattgtattagatcagagagcagtcttttggaaagtattatagatacattactgtagaatttacaaactcattgtaatacaatgtatttaattttcagaatatgattatctgaatggtattgtcatgattattgttcccattttcagatgaacactgacttcaagtccaatgatatattcactatgccattttattgacttttccttgtaaagcaatgcacacthatttagtaagtatttggtttctgtgatgtgttcagttgcgtgctg

SEQ ID NO: 29320 - DNA, 214 bp, Homo sapiens
agaactaaaaaggagatgactctctaccatagtttggtttaaaaaaaaattactctgtcagttatttatttattatttaatactaaactccaaactgaagtggctctgaggtaaatcagatatgattttaatttaagtttctttattagcagatctataaatggaaggtgaccaatgtcactgcttctaaaatactgtcctaaacaacccaggc

SEQ ID NO: 29321 - DNA, 260 bp, Homo sapiens
ctcaggtgagctttttgacaattgaaatttctcagaataatgacaagttttcgtatttgttgagccagggacggaaaaacaactatagttactaataaggactgtgcaaggagtttggacaccagggaagtaacacttttgccacaaatttttttcctagcatatcccagagaactcatttgccagagctcttgaaaatgagtcttgctgattgttttgctttattttaatttaatgctacatattaagttacggactct

SEQ ID NO: 29322 - DNA, 180 bp, Homo sapiens
taggtccttttcgtacagtgcattccacacttaagtgtaggtgagtaatatttacagtaatacttgtctgatcatccactttatccacatgattgtactctgttctttaattttataaattggcagtgagcagagtgattcttgcagctactatgtgttttaatttataatcagccccaa

SEQ ID NO: 29323 - DNA, 165 bp, Homo sapiens
  misc_feature 2: r=a or g
araatccacactcatgaataaagcctttaaggccctgtgtaacttttcctatcctaccttcagcttcactccaattcctctccccgcaacttttggtgttctggccaccctggccatctagttccttcaccacaccaagttcttttgctcccgcaaggcctccat

SEQ ID NO: 29324 - DNA, 239 bp, Homo sapiens
  misc_feature 7: h=a or c or t
  misc_feature 128: m=a or c
  misc_feature 234: m=a or c
atcctghcctgccggcctggcatgtcccagcctggatatcttagcttcagcaggccttggactcactggactaggtcttttgggacccaccaccttatctctgaacacttcaacaaccccaaactcamtcttgaatgctcttaatagctcagtcagtcctttgcaaagtccaagttctggtacacccagccccacattatgggcacccccacttgctaatacttcaagtgccamaggtt

SEQ ID NO: 29325 - DNA, 344 bp, Homo sapiens
cctaatacagcttataataatgtttacaatttcttagcagcttaaagtttggtaaatgctttttctattcactttcacctgatttgatgggcataacagccctgaaagaaaactggttctactgcaaaaactctagggacagggaacacactgccttgagaggtaatcgattgtcccattagagaacatcaaaggcaggaaacttctttttcaaaattgagctgatagctacttcttttataatttccacacagggttttagttttcctctccagagcaacaaaagaaaacatactcttttatgtgtaatgtcaaaaccagcaacagccgtcaagccgccccat

SEQ ID NO: 29326 - DNA, 352 bp, Homo sapiens
  misc_feature 26: s=g or c
  misc_feature 184: r=a or g
  misc_feature 185: m=a or c
  misc_feature 308: v=a or c or g
  misc_feature 309: m=a or c
cttcttcctggtggtttacgtaagasggagagcaatggggacgggcagggacagagctgcgggctgaggttcctccgttcggcgaacccttctctctgcccccgcctgctctgggctttcttggctatgtctgctcctgacaggagggatgtgtgttgccaggggtgggggcttggcgtgtgtrmgtgtgagaatatgtgtgtgtgtgtgtctttatagcagcatgatttataatcctttgtgtatatacccagtaatgggatggctgggtcaaatggtatttctagttctagatccttgaggaatcvmcacactgtcttccacaatggttgaactagtttacagtcccacc

SEQ ID NO: 29327 - DNA, 167 bp, Homo sapiens
ttctttttcccttgtttttgtagaagactcagaggagaatctttcttatggctccctctgttgagattggaattggaagagaacttaattttttgtatttaaaatgcagtgtcatgcctataagcatttctcctatataggactgctttgctagtgtgcccgcttgc

SEQ ID NO: 29328 - DNA, 244 bp, Homo sapiens
tgatcagtatatagttttttgctaattgattcttgtctaattgattcattttggcactaatttagaaagaggccaaataacattctaatgactatgtgatctagcctgggattttcaaaaatatatctttaacttttaaagtaatgtttaaaagtaaaatttggtataaatggaaactagtataccagtttgacatagtcatatcttgatttttgtatgtgttataagttctcttcagggcgca

SEQ ID NO: 29329 - DNA, 187 bp, Homo sapiens
aaggacgcggctccagtctggggcttacaacttgtgtcaaagaagcgaattttcagctgatttggatgttcagtccccagaagtcaaatttgtgaacttcctcatggatgaaacattcccggagccatctttcttcttcatctgattttttttttcttttcttcttcaattctgcccccagagggct

SEQ ID NO: 29330 - DNA, 190 bp, Homo sapiens
  misc_feature 159: s=g or c
catttaaaatatttcttttttattattattatactttaagttctagggtacatgtgtacaacgtgcaggtttgttacatatgtatacatgcgccatgttggtgtgctgcatccattaactggtcatttacattaggtatatctccgaatgctatccttsccccctccccccaccccacaacaggccccac

SEQ ID NO: 29331 - DNA, 214 bp, Homo sapiens
  misc_feature 6: r=a or g
  misc_feature 10: w=a or t
  misc_feature 11: w=a or t
  misc_feature 61: r=a or g
  misc_feature 67: k=g or t
  misc_feature 68: s=g or c
  misc_feature 134: w=a or t
  misc_feature 141: d=a or g or t
tatgarccgwwtgaagaatttttttttacaagactagttctaaattaacagcttataaaaratttgkstaaatttaataattagtataaggatatgacctaataaatgtctccttacctaaagattcatttgcwttctttdaatatgagtaggcatacttagtagcttttctgaacctagcctatgtctctgtccccaaaatagctgcccttaa

SEQ ID NO: 29332 - DNA, 160 bp, Homo sapiens
  misc_feature 73: r=a or g
tgtatgtttattttttaatctcagtttaaattacctagctgctactgcttcttgtttttcttttcctattaaracgtcttcctttttttttcttaagagaaaatggaacatttaggttaaatgtctttaaattttaccacttaacaacactacatgaccc

SEQ ID NO: 29333 - DNA, 250 bp, Homo sapiens
  misc_feature 26: b=c or g or t
  misc_feature 214: d=a or g or t
  misc_feature 249: k=g or t
atttttgggcatccggatggcgactbcgggaaatcgagttctcatgctggggcgaaaggtgtgtctgcaggagccaaatccaaatgagcagtccaggtacttcagagttttaacctgagcgaaacaggaatgtctcgggtcttaacaggaccgtccgcccgctcggaagaggcgaatctcccacggcagacgtctgggtgtgcgaatgccagtdgagcggggcctcgaggacgcgtcacacacagctakg

SEQ ID NO: 29334 - DNA, 332 bp, Homo sapiens
  misc_feature 159: s=g or c
  misc_feature 290: m=a or c
  misc_feature 291: m=a or c
  misc_feature 331: r=a or g
  misc_feature 332: r=a or g
cacacagtgggcagatagtggagtgatatgtagtgttatctggcaccttagtccaatgtatgccattactgagggaccccactgggggtaaatctatccctcctagccaagcacttatgttattataggctgggaaggggatgtctgcccaggtgacasggcgaaagaaaggcgggtctaagataagagccagtagagtgtagcaggtacagtttgcagacaaagcaagagcataaaaaggatcaataccctatgtgagttgcaatgtacaacagagagcatagcaaggmmcaaattatctgaagtaaatggtgtctgtgtctggagcatrr

SEQ ID NO: 29335 - DNA, 249 bp, Homo sapiens
  misc_feature 35: b=c or g or t
  misc_feature 36: m=a or c
gcagagaagtttccgggactggctctcctttcttbmttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacgta

SEQ ID NO: 29336 - DNA, 309 bp, Homo sapiens
  misc_feature 8: m=a or c
  misc_feature 30: b=c or g or t
  misc_feature 70: s=g or c
  misc_feature 183: r=a or g
  misc_feature 187: k=g or t
tttaaatmaaactgtcatgaactggatttbctaatacatacccctatcaagtggaaagaagattccaggstcattgaaacccgaatatgggtaacttgttggcagataatcttgataaaatatcaagtacaaggctgggcacagtggctcgtgcctgtaatcccagcattttgggaggctgargcakgtggatcatgaggtcaggagttcaagaccagcgtggccagtatgttgacaccccatctctactaaaaatacaaaaattggccgggcatggtggcacgtgcctgtattcccagctactcaaga

SEQ ID NO: 29337 - DNA, 132 bp, Homo sapiens
  misc_feature 12: m=a or c
acagcgactggmgacggacggagagcaacgcgctgggagaggagagaccaccgacaacagacccgcgctctcacacatacactcacactcgactctttcctctccccccacctcctcctccttccaccccct

SEQ ID NO: 29338 - DNA, 311 bp, Homo sapiens
  misc_feature 247: n=a, g, c or t
tcaatttatatataaggtaaaggcattatactggattatcctgcaatttctttgagttgttagaatgcttacgcttaacttatttggggaaacaaaactccagcccttcttgtgtatgttctgatatccctttgctctacttttagaggaatgaaccctaataggatggtagcagcattcttgtttctttatatctctcctctgtgattgtataccgttttttcaacttaaagcaacttcagctggnaatatgtagaggttggccaaggtgaactaaatagtctgtaacattgattagatatcaagcaact

SEQ ID NO: 29339 - DNA, 225 bp, Homo sapiens
caaacagaaaacacataaactagcctaagggataaacggaacatgataaaaatattgaatatattttaaaattaattatcagaaggagagtagaaaaagaatcaaatagaaatgaaaagataacgtcaatacattttccaaaacccactaaaggaattaaaccacacattcaagaagcactaagaatagcaacatttaaataaaacacacacacttcagcctgaa

SEQ ID NO: 29340 - DNA, 83 bp, Homo sapiens
atcctcatagaggtgccgggttcctattggttagttggttgtttttccgtctgagtgaatttttgccagtcttgtgggcagat

SEQ ID NO: 29341 - DNA, 311 bp, Homo sapiens
  misc_feature 13: y=c or t
gctattattattytgagatacgtcccatcaatacctaatttgttgagagtttttagcatgaggggcagttgaattttgccaaaggccttttctgcatctattgagatgatcatgtggtttttgtctttggttctgtttatatgctggattacgtttattgatttgcgtatgttgaaccagccttgtatcccagggatgaagcccacttgatcatggtggataagctttttgatgtgctgctggactcccacacaataataatgggagactctaacaccccactgtcaacattggacagatcaacgagactg

SEQ ID NO: 29342 - DNA, 190 bp, Homo sapiens
  misc_feature 13: y=c or t
catttaaaatatytcttttttattattattatactttaagttctagggtacatgtgtacaacgtgcaggtttgttacatatgtatacatgcgccatgttggtgtgctgcatccattaactggtcatttacattaggtatatctccgaatgctatccttcccccctccccccaccccacaacaggccccac

SEQ ID NO: 29343 - DNA, 155 bp, Homo sapiens
  misc_feature 46: m=a or c
tattgacagtgtgtgggaaggtggagttatttgagtagatttggcmtctgttctcatggagcttcctttctagaggggaaggcagatgatggatgaataaatataaatgattctaataggttggtgcagcagtcattaaaagtaatggcaaaaaa

SEQ ID NO: 29344 - DNA, 148 bp, Homo sapiens
  misc_feature 13: r=a or g
  misc_feature 47: s=g or c
  misc_feature 118: r=a or g
cgggaagcacaargggtcagggaattccctttcctagtcaaagaaasgggtgacagatggcatctggaaaatcgggtcactcccaccctaatactgcgcttttccaacagtcttagcraatagcacaccaggagattatatcaccgcc

SEQ ID NO: 29345 - DNA, 323 bp, Homo sapiens
  misc_feature 274: r=a or g
ctcatttagatgatttattttcttttagatacgcgttcatccaatttcttccttgtgcccactgctcccatctgaggtgacacgtacaaaatggaatggtggggatgagcaaggagcaagagaagggctcctggatccatgtgctcatttccttgtattatcccttggctctatgtgatgatgcagctcaggcattgtccgctgttttctcataaggacctgtggctacttaggtgtagtctatgggtccttgaatgcgctcactgagatgcarctggccccatctggccctaagggagcattatgctggcctccccctctac

SEQ ID NO: 29346 - DNA, 196 bp, Homo sapiens
  misc_feature 12: m=a or c
  misc_feature 87: s=g or c
  misc_feature 119: s=g or c
  misc_feature 120: m=a or c
taaggtgccacmattaccaatggaagggtagcacattaagatgagcttcacagtcacactgacattttcctcaagggcatttttcasatcatggcgttgggggaatagtatctgagcasmagacaatagtatcattgacttaagaagacagaggttgtaacttggggctgtcaaagttgctaggacatgaaggcct

SEQ ID NO: 29347 - DNA, 102 bp, Homo sapiens
cgtgaaattaacataacgtagccatttagtgcattcaaaatgttttgcaactgccatccttaactagttccaaaacattttcagcaccccaaagacaaccgc

SEQ ID NO: 29348 - DNA, 317 bp, Homo sapiens
  misc_feature 13: h=a or c or t
  misc_feature 17: r=a or g
  misc_feature 50: r=a or g
  misc_feature 51: w=a or t
  misc_feature 52: r=a or g
  misc_feature 53: w=a or t
  misc_feature 145: s=g or c
  misc_feature 146: s=g or c
  misc_feature 158: w=a or t
attcttggatgahcttrctgctcttatttctccttttgtgtgtgtgtgtrwrwgtgtgtggctatgggttttcatttgtaactccatctgcttaggagagtgggctctctataagggaacctgctgtaaacttcattgcagcaassatgtagagagawataggacttaattccactaggggctctcatctcacaccttaaggaggagattttagaaaaactgggccagattttctttgttctccatcattttaatgtggcaggctgttcagttttcttactcttacctatgtgatatttcttcgtaacgtgtccaaa

SEQ ID NO: 29349 - DNA, 319 bp, Homo sapiens
  misc_feature 2: b=c or g or t
  misc_feature 218: y=c or t
tbctggcaggactgtgctgggctgatcccgcttgcatttttcagggctctgttcctgcctcttgaggtgactaatccacaggcccagaacagtaagccttcttgccctgtcactgtaagcaccagccagcccctccagccagccgctgcagctggcctctgtggtctgctcagatgcaaggaaaccaggccagaccatggtcacttgtaaaatcccaytggtccctggaaagattcccctacggctgtccctaccatacccccagccttagagacagacagaagggaggcggtggccaagctgcttggatgagggagcg

SEQ ID NO: 29350 - DNA, 204 bp, Homo sapiens
  misc_feature 13: m=a or c
  misc_feature 14: r=a or g
  misc_feature 15: w=a or t
  misc_feature 135: s=g or c
  misc_feature 136: k=g or t
cactacagtggamrwgattccatgtgatttctgaggctagatcataaaaggtgatgaggcctctgcctaactaggggaaatgctttctcttgagatgctcactcttgaccagcctatagagagatccacagggaskgaactgaggccccagcccacagccttggttgagctccagcctgcagtcatccccaacttgccagcctt

SEQ ID NO: 29351 - DNA, 230 bp, Homo sapiens
  misc_feature 127: s=g or c
  misc_feature 138: m=a or c
cccgacccccagcccggacacctcattcccctcccactacagggatcaagtgacctgggaagaaccgagtttaacaccaggatgtgtttccttagatttcctttcctaggcgatttccagggagagsccctgattggmcaatcacatcacagatcacactgcagtttccatgttagcactgtggatgggtttttaatcaataaaaactgggggtttcttctcaccgacaa

SEQ ID NO: 29352 - DNA, 240 bp, Homo sapiens
cacagtgttggaaaaagcaagtttaatttaaaatatagtcactccttccctatcagggtgagccattttttgtctgaatttcctccatgtctcagtgctgcctggcagggcctatgggagagttcatctcaaaagaggtcaacagcaaatgctacagatctgtgtgggaaatgtggctcatcaacattgctaaagctataaccctcattctttagcctggctttccccacttcccactcc

SEQ ID NO: 29353 - DNA, 201 bp, Homo sapiens
  misc_feature 4: y=c or t
  misc_feature 127: y=c or t
taayttatctgatgcagttgtcattgtatctagatgtactacatacataagataaaagggtaaatgtaatgggactaactcttgatgaaatttctatattcaacttgaatggtaaaatatttgattyctaaagtatactgtgaaaagttatatatgtaatatggtaatccctagaccacttaccaaccagattgaaataaa

SEQ ID NO: 29354 - DNA, 129 bp, Homo sapiens
acaccactgcacccggcaaatttttgtattttttgtagagacagcatctcacgatgttgcccatgctggtctcaaactcctggcctcaagtgctgagattacaggtgtgagccacctcacctggcctaa

SEQ ID NO: 29355 - DNA, 119 bp, Homo sapiens
  misc_feature 8: y=c or t
  misc_feature 9: w=a or t
  misc_feature 16: r=a or g
  misc_feature 26: w=a or t
  misc_feature 76: s=g or c
attaattywgagaggrgggtcggggwgaggtctggagtggtgggtttgacatgggggccggctcgccaaggtggasgtggggaagggggcgtgtctggtcccctaccccgaagacctca

SEQ ID NO: 29356 - DNA, 363 bp, Homo sapiens
  misc_feature 111: m=a or c
  misc_feature 117: w=a or t
  misc_feature 144: y=c or t
  misc_feature 145: r=a or g
  misc_feature 328: n=a, g, c or t
  misc_feature 329: n=a, g, c or t
  misc_feature 330: n=a, g, c or t
  misc_feature 338: m=a or c
  misc_feature 339: n=a, g, c or t
aacaaccacagtagaaacatttctactttgagagaatttcagtattctcttaatgttgtgtaattgattaggtaactaaaaagcgcaaattgttggcaggttttgctgcamattgtwctatgtctttgttggctggtgtatttyrtaaactaaagctgcctatgtttctttttaaagctcgcattcccagaatcagcttaggcttctatgaattcagcctgtttctaaaagctgaaaatctcagtttaaaaatcaaaatgttaacacaaagctaagattcatcagagcccaccctattctaaggaaccacaataacttactctggctnnngtgttaamncgatctttcagatttagagcgact

SEQ ID NO: 29357 - DNA, 135 bp, Homo sapiens
  misc_feature 133: n=a, g, c or t
  misc_feature 134: y=c or t
  misc_feature 135: n=a, g, c or t
agccaggatttagtcctggcccagcccagagctgggacctggagcacgatctgttgacttccctgggtaggacactgccacctctgggctcaggtcctcatgcctccaaatggcatctagagtttgagcattnyn

SEQ ID NO: 29358 - DNA, 170 bp, Homo sapiens
ccttccttcttatctaatgggtcaaaccttgcagttcgcttcctgaatttttttgtttgttttctcatgctttccttcttctctacatactactaaaaaaccattagttgttattctgctacatataaatttctcaattttaatgtaaatataacctttgatgccagccc

SEQ ID NO: 29359 - DNA, 75 bp, Homo sapiens
ctcattgaactcgcctgcagctcttgggttttttgtggcttccttcgttattggagccaggcctacaccccaaac

SEQ ID NO: 29360 - DNA, 195 bp, Homo sapiens
  misc_feature 16: k=g or t
  misc_feature 131: w=a or t
  misc_feature 164: k=g or t
agtagagatggggttkcagcatgttggtcaggctggtcactcgtgacctcgtgatttgcctgcctcagccttccaaagtgctgggattacaggcgtgagcaccatgtccggcctggccctactttttaatwaactgactctgaatgtcaatttcagtagcgackgtacagctatttgctatgttttccaggggca

SEQ ID NO: 29361 - DNA, 410 bp, Homo sapiens
  misc_feature 199: s=g or c
  misc_feature 216: v=a or c or g
  misc_feature 288: d=a or g or t
  misc_feature 289: n=a, g, c or t
attaataaagaactaaagtcatgtgcaaggattgtgcttggagaacggtctctggggaggggaagtgcccaagacacctgaggatccaagaatgtttccaaacaaagagccctagggcatttcctccagggtattctgaagacttcatctgctgcattagagcggtgggaagaaactacacagacgggcctcatggccsagggacctgcctgatcvtggctgatcttttaatgctctggtgcagctggggagctgcctcttgcttctgggaaccctcagtgttgggtdnggtattagatgttagttatgattgatgtccacagcttctttaaagaagtctgggagtagttaggtgttctcagtcacctccaatctgggctgtactgaggtctgtggccctccaaagtctt

SEQ ID NO: 29362 - DNA, 109 bp, Homo sapiens
ctgcaagtggtgtaactatgtttttcaatgatcgcatttgaaacataagtcctattataccattaagttcctattatgcagcaattatataataaaaagtactgcccct

SEQ ID NO: 29363 - DNA, 184 bp, Homo sapiens
ggttagccgggagtgttggtgtgcacctttagttccagctacttgggaggctggggcatgagaattgcttgaacctaggaggtagaggttgcagtgaaccaaaattgtgccactgtactgcagcctgggtggcagagtgagtctccatctcaaacaaacaaaaaataacaaaaaaagacctcat

SEQ ID NO: 29364 - DNA, 113 bp, Homo sapiens
tcactttttttccccactcattggtcagaagtagtcatatggcccccattcaaatacagagtcaggcattccaatcctgagaagttatcgagtgcccagaagaaagagagcct

SEQ ID NO: 29365 - DNA, 68 bp, Homo sapiens
tgtaaaatctggaaagttagcttgttctaataggggctatgctctgcaattccctttttttttttttt

SEQ ID NO: 29366 - DNA, 110 bp, Homo sapiens
taaattgttatagtagcttatggaaaatgctattaaagataaattttcatacattgtatttttagtcaagtaaaatatggatgaaaattaataaagtactgtcaaggtac

SEQ ID NO: 29367 - DNA, 326 bp, Homo sapiens
  misc_feature 129: y=c or t
ataagatattcaaaactttattataagataggatttgtgtgagataattttgaccaactgtgggctataatctaagcgctctaagcatgtttaaggtaggctgtgctaagctataatattttgtaagtyatgtgtattaaattcactttcaacttagggtattttaaatttgtttattgggtttattgggatgtaaccctatcataggttaaggagcatctgtaattcagtgagaggcaaaagatgatagagtggttaatctacgaatttgtttgttcacatctattttgcttcttcttcaaacattctgttcattgtaggcacac

SEQ ID NO: 29368 - DNA, 175 bp, Homo sapiens
  misc_feature 105: n=a, g, c or t
ctacttcccttctaggtgagacagcatttttaaacttgagttataaatatggtacacccttcgagttgcaccctgcctcccagatccgtgaatcctatttgaaancatcttgccctgagacacaatgaacaaacgcccgtatacaaggaggctgtgggctcgggggcccgggcag

SEQ ID NO: 29369 - DNA, 205 bp, Homo sapiens
ctgctgcaggttttgaccatagtgattggttgctgaaatgggaccctggtacaggcttcattcctaagtggactgactagggtgtacagtcagcagtgacactacctggggaggctgatgctttctcagtgctggactttgctcaggcccattagcaatccacaggcagccttgtgcatctgctctccttgttaacaccgacacc

SEQ ID NO: 29370 - DNA, 123 bp, Homo sapiens
tatgaaagattggataatgatactaatgcaaccaaggcagatgttgaaaaggccaaacagcagttgaatctgcgtacgcatatggccgatgaaaataaaaatgaatatgctgcacaattacaa

SEQ ID NO: 29371 - DNA, 207 bp, Homo sapiens
  misc_feature 126: w=a or t
  misc_feature 129: m=a or c
  misc_feature 133: r=a or g
atgctttctcttgaattttgaaattgctgattgctggcatataatagctaatatttggtatgatacgctgctgccaagcttggttccagattccacatgctaaatgctacattcaggtagaaactwagmacaragaggtaatgataactagtacatgggttgggattcattctggcccccgtgtccacatttaactcactaccgttc

SEQ ID NO: 29372 - DNA, 203 bp, Homo sapiens
  misc_feature 173: v=a or c or g
  misc_feature 180: m=a or c
  misc_feature 194: w=a or t
tctctacaaaaatacaaaaatgagctatgcatggtggtgcactcctgtagtcttagctactcgggaggctgaggtgggagaatcgcttgagctagggaggagatcgcagtgagcggagattgcgctgctgcactccagcctgggcaacagagagagaccctgtctcaaaagavaaaaagmaaatctcagttgtwaaggcagca

SEQ ID NO: 29373 - DNA, 207 bp, Homo sapiens
  misc_feature 132: r=a or g
  misc_feature 137: m=a or c
ttaacaattatttactcgatacaagttctttattggatatatttgcaaatattttctcttagtctgtaacttagcttgtcttttttattttttacttttgagacagagtctcgctctgttgcccaggctggragtamcaagtggcgtgatctcggctcactgcaacttccacctcccaggttcaagggattctcctgccccaacctc

SEQ ID NO: 29374 - DNA, 127 bp, Homo sapiens
ctgtgaaaagaaaattctatagtgaattgtgaaaagtggacatatttctaaattcattccactgcctttatccaaacttaagaattacagacatttgttattccttcggcaagacatccccggctgc

SEQ ID NO: 29375 - DNA, 253 bp, Homo sapiens
  misc_feature 15: k=g or t
  misc_feature 122: w=a or t
  misc_feature 126: w=a or t
  misc_feature 142: w=a or t
  misc_feature 147: r=a or g
  misc_feature 157: s=g or c
  misc_feature 158: r=a or g
  misc_feature 201: n=a, g, c or t
gaaaatagttatcakaaataaagagttagtactgagcttcagggcaggccttcttcaagtgtatacttcttttctgattcaaagataaattaagttatgattatatgtatattgagttcttwgggwtttttttggaattttwaatgraatgtgaaasrtgccattacaatagatttcaaaagcttagtcctataacacagnaaaatatttacctttttttcactatggaggtgagggtatttctgagatgcca

SEQ ID NO: 29376 - DNA, 385 bp, Homo sapiens
  misc_feature 114: s=g or c
  misc_feature 115: s=g or c
  misc_feature 161: k=g or t
  misc_feature 266: n=a, g, c or t
  misc_feature 267: r=a or g
  misc_feature 268: n=a, g, c or t
  misc_feature 351: r=a or g
gcacttgatgggaatcatggcagcatccaggccattgtcccgcttctgggagtggggaaagaacatcgtctgcgtggggaggaactacgcggaccacgtcagggagatgcgcasscggtgttgagcgaggccgtggctgttcctgaagccgtccacggcckacgcgcccgagggctcgcccatcctcatgcccgcgtacactcgcaacctgcaccacgagctggagctgggcgtggtgatgggcaagcgctgccgcgcagtccccnrnagctgcggccatggactacgtgggcggctatgcctgtgcctggatatgaccgcccgggacgtgcaggacgagtgcaagaagartggggctgccctggactctggcgaagagcttcac

SEQ ID NO: 29377 - DNA, 193 bp, Homo sapiens
  misc_feature 133: m=a or c
  misc_feature 188: s=g or c
  misc_feature 189: n=a, g, c or t
tgcataaaataatatatcttagtcctttgtcctactgtattagcggtaggaccctaaaacaatcattttggtactgcaaacagctttagttttatttaccaaagctactttgggtaacctgctaaaagaactmaacaggactcagaagcagttgtacttaatagttattgtttattgtagcaaaaggsnccat

SEQ ID NO: 29378 - DNA, 116 bp, Homo sapiens
  misc_feature 36: m=a or c
  misc_feature 40: s=g or c
  misc_feature 70: y=c or t
  misc_feature 80: k=g or t
aaagctgtgcagaaattctgacctgaaacgcttcgmatcsggtctctgcttgttgaaggaccttcaccgytatttctgakaagagcaaaagtgatgcagatctgttcttcctcttc

SEQ ID NO: 29379 - DNA, 159 bp, Homo sapiens
ttttgtagttttgcatttagagtctcaatgaagtgcttcaaaagtggtagaagatactacagggactaagaaaacttttataaacactgtgatgctttaacaaaaactcagtcatgtacctgtaaatatcagaacccagtaaggggagctagcagcgcc

SEQ ID NO: 29380 - DNA, 160 bp, Homo sapiens
cagcactttgaaattaagcatttgctaattttaagaaattgtatgtaaaacagaatggttcttgtgtttcagtctcagtcttatgtgagacttctgagaatacttacctggaattttaaaacttggaacctctgatgacttcataaaagaaaagccctga

SEQ ID NO: 29381 - DNA, 378 bp, Homo sapiens
  misc_feature 170: w=a or t
  misc_feature 176: w=a or t
  misc_feature 187: r=a or g
  misc_feature 190: w=a or t
  misc_feature 202: m=a or c
  misc_feature 220: w=a or t
  misc_feature 224: r=a or g
  misc_feature 225: r=a or g
  misc_feature 236: r=a or g
  misc_feature 313: r=a or g
  misc_feature 324: d=a or g or t
  misc_feature 325: n=a, g, c or t
  misc_feature 326: d=a or g or t
  misc_feature 327: n=a, g, c or t
tgtatctgggtaggtgtagtgttcttcctgagccaaattttgagcttttaaacaatcagctgtgcaaatttagatcaaacatctttaatgcttggctcgtggaattttgcagtgtctatgtactttgttctattttgtgtgtttgtgtatggatgtgtattttaattgtwataaawgaccatatccratwagagcaatgtamagaaaatctgtaagccawagtrragaaaaatcaraatgtctcataatcttatcccttaaagggtgtcattatttacattctggaatatggtctttaagacatttctctctrgaatatttaadndnatatattcaatataatgtgatatgcttatctttgggcactctccaaatata

SEQ ID NO: 29382 - DNA, 138 bp, Homo sapiens
  misc_feature 15: s=g or c
tgatgattattctgsctttcgaaaacatcaggtgcaataaaaaatgatgcaacaggaaaatattcaggttccgcatctaaaaattaagatatagtgatacctaccttactgaaatatggtgatatggtgaagcacccc

SEQ ID NO: 29383 - DNA, 291 bp, Homo sapiens
  misc_feature 118: r=a or g
  misc_feature 119: r=a or g
  misc_feature 142: r=a or g
  misc_feature 174: d=a or g or t
  misc_feature 175: s=g or c
  misc_feature 188: w=a or t
  misc_feature 255: s=g or c
  misc_feature 280: s=g or c
gcatggcttccaaaggccacagttcaggtatgatggataggatggcttagcattttaactgctatttctgcatgacaccttgaaatattgaataagagggcttgtttaaatttagtgrraataaataattgaagtggatttrtgaaaagagtttatcctaatctattctttaadsctgtatttttggwatattcattccttaaatgtgatagctcattaaatttccttagatcaccagggtataagtaaaaatcsagtaaatccctattctactagaaascagtagtaaca

SEQ ID NO: 29384 - DNA, 55 bp, Homo sapiens
  misc_feature 13: k=g or t
tttatatatatakatataaaatactatttggatatattataattgtatttatatt

SEQ ID NO: 29385 - DNA, 99 bp, Homo sapiens
gtaggaggcagaactgggctactattggtcaattttagttaatgcaacatttactggctgtcctttgtgtgcccaattttgttctagtcactggggccc

SEQ ID NO: 29386 - DNA, 272 bp, Homo sapiens
  misc_feature 130: r=a or g
  misc_feature 193: r=a or g
cagtcagtgtcgtagcagggaacagatgacacattcaaattacaaaaatacaaggtatttataaagacatttacaaaagtgtgtgcaggatgttggaaaaaccataggagatagtagagtggcctgaaarggagggaagagtgagtagttactggaaattgttaaggaaagtccggtggaaagggtgaccttrgagtgattcaaccaatgaaatacggccatgcagagagtgacccaaggggatgaatatcccagcctcattctccttatct

SEQ ID NO: 29387 - DNA, 89 bp, Homo sapiens
tgacaatttctaaatggaaaagggttgctgtgttttctctgtctctcttttttaatgtccttttttcttctcccccgctccctgctcag

SEQ ID NO: 29388 - DNA, 221 bp, Homo sapiens
  misc_feature 176: m=a or c
  misc_feature 179: r=a or g
aacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccamctraaaaatgtctgaatgcttacacaaataaattttataacacgc

SEQ ID NO: 29389 - DNA, 118 bp, Homo sapiens
aaataaataaataaataaaaagtttgtcctagttacatcatggtgactgtggtcaacaatatgttgtagttgtttgtattcttgttttttctttctctttcttttttttttttttttt

SEQ ID NO: 29390 - DNA, 72 bp, Homo sapiens
  misc_feature 4: w=a or t
  misc_feature 23: m=a or c
  misc_feature 27: k=g or t
agtwaataatcatactcaaaggmtaakagatcagggttatcctggagaaggtttcttgggtgcagtggtgca

SEQ ID NO: 29391 - DNA, 206 bp, Homo sapiens
  misc_feature 127: r=a or g
  misc_feature 148: w=a or t
ccagttatttctaagtagttttgccatcttagctgttatagcctaaggaatagagtgccattttaaatgaaaatgtaaagataaccatcagagtatctcatcttttctcaagcaaaaatgatttggrtctagatatatctttgtacgwgcttctctggaaaagtacagaatactggatttaacagagtaaaacctaagggggtcac

SEQ ID NO: 29392 - DNA, 71 bp, Homo sapiens
caaactcgccgctacgcgagaatgccttgtcagatatatccgatatgctgaagaacttgacagagagccat

SEQ ID NO: 29393 - DNA, 79 bp, Homo sapiens
  misc_feature 25: r=a or g
  misc_feature 41: k=g or t
  misc_feature 43: m=a or c
  misc_feature 57: w=a or t
tattatgtgtacgtgtgtgcacagragccatacaaaatatkamaggggacaggtggwtgaagcttaaataccctcttct

SEQ ID NO: 29394 - DNA, 146 bp, Homo sapiens
  misc_feature 126: s=g or c
aaaacaggtggaatccgggctggagccggagctccggcggcgcgggtggcggcacgtccctccagacagtaccacaggcacctggagtaccggcatcggtcgctgtggcccccgagtgtccgtcasagcctaggggagcctgcctt

SEQ ID NO: 29395 - DNA, 82 bp, Homo sapiens
  misc_feature 39: w=a or t
gatacaatttcttttttgtttgtttttgttttgtttttwaaaatgcaatttcatatgttaggtaggttggcttttctttttc

SEQ ID NO: 29396 - DNA, 109 bp, Homo sapiens
ctgatgtccagcttaatagaaggcaattatcatatctattaacacttgcctttgtaatctgctgtgatgaggtgtttcagttgaaatatatgaagaaaatccagccgca

SEQ ID NO: 29397 - DNA, 395 bp, Homo sapiens
  misc_feature 181: s=g or c
  misc_feature 265: n=a, g, c or t
tctcttgcttcagcctcccaagtagctgggattacaggcttgcactaccatgcctggcttattttagtatttttagtagagacggtgtttcaccctgttggccaggctggtcttgaactcctgacctcaggtgatccacccaccttggcctcccaaagtgccaggattacaggcgtgagcsactgtgcctggcctggcctaatatttaacagaaggatcatattccaaataattcaaaaagtacacccatcagctaaaggaattntacttgttataggcagtctcttattcctagcagaaaacatacgaaaatatttcttgcaagtaatgtgggtgcacaaagccttcagaaacaatttgaaggaaagattgacagtaacaagaatttcacttaa

SEQ ID NO: 29398 - DNA, 114 bp, Homo sapiens
attatcagtctccccccacatccctgactagacacggccagtgtcactttcagatgattttacagcgtgttaccccgccgccgtcaccagcccctatccgcatctccccctcat

SEQ ID NO: 29399 - DNA, 241 bp, Homo sapiens
aagaaacaccctgtcccccatggcaaagccaggcagaggagcacattgaagtttcccggcatgtggaggcaccttcgccagcagggggtgggaccttgagaggctgtgccagcacccagtagaacaggaggtactcaccctggctttcacagggcccaagccccagtgtcttccaggatcctcaccagccccaaaggaacggctctctcttctccctcctggagatatgccccctgatccc

SEQ ID NO: 29400 - DNA, 116 bp, Homo sapiens
tcagtgcttcacgtcgctgggacattgagctacaagaggctctcctcggttccgcattgatcatgttgtctggttaaactctgaggcttgttttctactgtgaatttcccgcaacc

SEQ ID NO: 29401 - DNA, 162 bp, Homo sapiens
cataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagcca

SEQ ID NO: 29402 - DNA, 98 bp, Homo sapiens
tttgtgtagttgttgatgcttctagactcctcttcttccttcctccctgaaacgccagctttgaagcccacaccatagactgtgcctgacaagccctc

SEQ ID NO: 29403 - DNA, 122 bp, Homo sapiens
taagtcaacatttgctgatgggccatttagctgatgggccattacaaagtgtaagggttaggggaggagatcaaggaaaacccccaaattttgacctgaccaagcaactggaaggatggcgt

SEQ ID NO: 29404 - DNA, 80 bp, Homo sapiens
cttaatggttttatactttacaaaatcattttgggtgagtaaatgaggttttcctgtagcacaatgaaaaggccacaaga

SEQ ID NO: 29405 - DNA, 214 bp, Homo sapiens
  misc_feature 149: n=a, g, c or t
  misc_feature 156: w=a or t
tagtatccaaatccagtttctccactgtgtagttactattttaacccccatcaatctgtgctgaggcaatttaagaccatgcaaataccttggtcttcatcaaacttcctccctaggtttagcatgtattaatgattcttgcctaaacnagctgtwactctgacgattgcagaaagacgatttccctcatctctagctctagctttcctaaccc

SEQ ID NO: 29406 - DNA, 225 bp, Homo sapiens
tatctgcctgtcagtgacaaacaagaaacccacacaggcgtccatcacaaaggtcaaacagtttgaaggctccacatcatttgttcggagatcacagtggatgctcgagcagcttcgccaggttaatggtatcgatcctaatggggattcggcagagtttgatttgttgtttgaaaatgcttttgaccagtgggtagccagcacagcgtcagaaaaatgcccccc

SEQ ID NO: 29407 - DNA, 143 bp, Homo sapiens
acactcgctccgcggttcgcatggcgctctgaagacgccggcgcccgccgccttgaggagccgctgcccccgctccctgaagatgggggaacaatgaaataagcgagaagatccctcttctcccccctctctctcttgccccc

SEQ ID NO: 29408 - DNA, 270 bp, Homo sapiens
  misc_feature 113: v=a or c or g
  misc_feature 114: m=a or c
  misc_feature 146: s=g or c
  misc_feature 223: d=a or g or t
  misc_feature 224: s=g or c
aaaaacataaataggaccatactatacttgcttgcgttttttgccgaacagtggcacagtaaacatccttgtgcaaaaatggcaaatgtttgtagataagtaatattaactgvmgtattttatcatgtgctgggtcttgtgcgaasccatcacgtgtggaaccttttctataatcctcatagtgacctgttgagaagatgtttctattttttaaatgaggaadsagcatagagcttgaaagtggtaaagtgggaatttgaacggaggacg

SEQ ID NO: 29409 - DNA, 294 bp, Homo sapiens
atgttaatcattatggaaacactacttaagagaatatggctgaaatatgtttgggtttttaaaaatatctttcttacagactaatattgtctgtggacctttctacatttgtttgtttgtttttgaaacagttttgtcacccaggctggagtgcagtggcgcgatatcagctcactgcagccgcctcctcccaggttcaagcgattctcatgcctcagcctcttgagtggctgggactacaggtgcgcgccaccatgcccaactaattttttgtatttttagtagagatgaggc

SEQ ID NO: 29410 - DNA, 101 bp, Homo sapiens
caggttcaaatgattctcatgcctcagcctcctaagtagctgggattacaggcatgcatcaccatgcctagcttttatgtttttagtagacacggggatac

SEQ ID NO: 29411 - DNA, 95 bp, Homo sapiens
tgagacagagtctcgctctgtcatccaggctggaatgcagtggtgcgatctcagctcactgcaggctcaacctcccgggttcacgccgttctcct

SEQ ID NO: 29412 - DNA, 112 bp, Homo sapiens
gttcgctttactttaaaaaggtatttttttcctaattataaaactgatgtgtcagttacggaaaaattagaaatgcagcacaaatacatgaatattttaccacaaaattgcc

SEQ ID NO: 29413 - DNA, 83 bp, Homo sapiens
  misc_feature 28: m=a or c
  misc_feature 29: m=a or c
  misc_feature 45: r=a or g
  misc_feature 62: k=g or t
gggcatctcctgcaggccctgaggggtmmctctcgtaggcagggrcacagctcaccatggckgtgtgctggctgccaggacat

SEQ ID NO: 29414 - DNA, 96 bp, Homo sapiens
  misc_feature 48: s=g or c
  misc_feature 50: s=g or c
  misc_feature 51: m=a or c
  misc_feature 52: s=g or c
agacaaggcgggggaagggggagtagcggtggcttaagccgcgcggasasmscaacctgggtcgctccctgcttcgccgccgcctccggaccgagc

SEQ ID NO: 29415 - DNA, 110 bp, Homo sapiens
atcatccaggcaggcttgattgctacatttcactactctttccatctctgcccccacctctccagcattttagaaacctgttggggtaaaactgaggtgtgtggcttcct

SEQ ID NO: 29416 - DNA, 315 bp, Homo sapiens
  misc_feature 200: w=a or t
tacatcagttaaattttttgcccattatgttagaaaaagtgatgctattcaagtgtctatgtaagtgtaaggaaataggcattctcatattttctggtagagtgtataaattgatacagccgcttggggatagttgcagttctcatcagttctaagtgctttgtaaattaaaaagatacaaattctgttgcatatcagtwccatttcttgttatctactgcataaaaatgcttgtatatgcatacaagaatgaggcatgtgcgaggatgttcatggcagcattatttataatagtgcaaaataaaacaacccaaa

SEQ ID NO: 29417 - DNA, 270 bp, Homo sapiens
  misc_feature 194: n=a, g, c or t
gatttggtatgttaatgagtgtataatgaggtcctaggtgaaacctaggtcaaatccagtgctatgttgggtccagtcggtcctagccagcttgtcccacatcctgtttttcagggtcttttatcagcccctagcctatgctgctaattcaacagtttcctttttgctagttttgtgaaactgcttctattctnctgcaaccaccctgtattattcctgtctcactactgacacaccagtgtggtttttgtgacttgtctgaagcctcac

SEQ ID NO: 29418 - DNA, 259 bp, Homo sapiens
  misc_feature 14: k=g or t
  misc_feature 145: w=a or t
  misc_feature 202: k=g or t
tatgccttgtagtkattgtcatgggattgaacagtgacacaccctcaagatgtaaggaatttattcaactgattgtccaaaaggttttccaaatcttataaactgtaagtcattgagccttaaaattagaataaagcttagagawccatctacctcttcttaccaggaaaaaaatcaagacctaaaggaagttgagagtaakatacgcaactaaattaagtgcaaaactgaaactagaatctaggtcttccatacattc

SEQ ID NO: 29419 - DNA, 182 bp, Homo sapiens
  misc_feature 15: r=a or g
  misc_feature 16: k=g or t
catcttaaaaaaagrkaactagtactaatcattgtagtggcctaagtgtgatttaactcttgaagtcacaccctccgaaagatgagtagaaaccagcaccagcacagcccagatcttctctttcctctccttttcctcatttattcctaaaggaatctgaccattttacgtctctacggccc

SEQ ID NO: 29420 - DNA, 126 bp, Homo sapiens
  misc_feature 120: w=a or t
agctgagacttgagcccaggtctttcagatttcaaaccaggtggtcacatgagaagtccaaaaaattttggctatttttccagaaaaaggaaaggaaacaatttgttattcttaccaggwagtgca

SEQ ID NO: 29421 - DNA, 258 bp, Homo sapiens
  misc_feature 200: h=a or c or t
caatgcacattgtcagtacaaccaccctttaaggtaggtgctattatgttcacatcttacaggtgagagaagtgaggcagagagcagttctgtaacttgcctggggttatacagcaagtcagaggcaaagccagggcctggatgcaggcaggctgccatagagtccaggctcgggcaattccccttctttctctctctghtcagccccttgggacctctcttggcagcctgtgacccagccgtagccctgcccctgaa

SEQ ID NO: 29422 - DNA, 348 bp, Homo sapiens
  misc_feature 273: m=a or c
  misc_feature 274: m=a or c
  misc_feature 282: w=a or t
  misc_feature 283: d=a or g or t
  misc_feature 285: n=a, g, c or t
  misc_feature 286: w=a or t
  misc_feature 292: m=a or c
  misc_feature 305: w=a or t
  misc_feature 306: r=a or g
  misc_feature 322: m=a or c
  misc_feature 332: m=a or c
cagagttacaagtcacaaatattaggattttagaaccgaaacaaaatttacagatcccctagtaaaaaaattttttaaatttttattttcataggttttttgggggaacaggtggtgtttggttacaatgagtaaattcttttgtttttgagacagggttttgctctgtcgctcaggctggagtgcaatggtgtgctctcggcttactgcaacctctgcctcccgggttcaagcgattctcgtgcctcggcctcccaagtgacttgggattammggcgggcwdtnwtcatamccggctgattttwrtatttctggtggagamggggtttcamcaatgttgtccaggtt

SEQ ID NO: 29423 - DNA, 243 bp, Homo sapiens
taataaggaatggattgaaccacttaaggatggagtgtgtaaaatgaagtaggtttggaggtagaaccataaaagaaacaaatgtctagctgctgtgtaaaggaatgctaattcagcagagcagacctagcagaagtgattagcataaaagaaccagaggactgagattaggaaaaccaggagaggggagtgttaactgtctcaggtgctacacatcagtcctttgagatgcggaccaagagc

SEQ ID NO: 29424 - DNA, 224 bp, Homo sapiens
  misc_feature 119: r=a or g
  misc_feature 200: d=a or g or t
acttctttttttaagcctttgtgattatgtcaaacttttgttaatataattgatgatggtttgaggcagtagtttgggggaacaggatctcaggtattagatctggattcaaacttcartggtgaccatggacaaattaacctctctgaaccttagatttttcatctatgaaatgggagtactaatactacctcttaggdtcattgtgaagatagtacatggac

SEQ ID NO: 29425 - DNA, 166 bp, Homo sapiens
caggagtaacaggaactctcattcattgctagtgagaatgtaaaatgttacagccactttggtggcagtttcttataaaactaaacatgatcataccatgcaaatcagcagttatgctcttaggtatttacccaactaatttgaaaacttctgttcacacaagcca

SEQ ID NO: 29426 - DNA, 367 bp, Homo sapiens
  misc_feature 258: y=c or t
  misc_feature 259: n=a, g, c or t
acacactcttaaatgtcctactttcctagcagagcaacagctatgcatttagaataaatgttacctgcttcaactttcactgtaggagtcatgcaaggtgactttattttaggcaaatcattaaatagggaatactaagtccaaggcatttattttgcttgaaggaggcttcataggtttctttaaaccagtatgatagtttggattgaccaatgtatataataggcccgttctggaaataatctaggtcactgcacyntaagccaagggtactaaggaaagaagtgtggttgaaaaaaagaaaatccacaataaacataaatactaaggtcatgtcaattgctgtctcttcaggcacataatgtaa

SEQ ID NO: 29427 - DNA, 179 bp, Homo sapiens
  misc_feature 67: r=a or g
  misc_feature 68: r=a or g
  misc_feature 71: r=a or g
  misc_feature 72: r=a or g
aacttcaaggtgctgcaagcagctttcaagaagatgggtgttgacaaagtaggtgcctgcgctctgrrggrrgccctgaggagcagtgtgaccctggggaagaagaggacccaccagcccaggcaactggggctgctggggtcattccggtgctcgtgcctccctccacctcccgacag

SEQ ID NO: 29428 - DNA, 133 bp, Homo sapiens
gttggcggagaggcgaagtgccgcagagaagcatggagatcacagagcaaacctaaaccaagcgcccatctctctgtgagaactgagcagacagcagaggttaaaaaacactgtcctggcccggaagacacga

SEQ ID NO: 29429 - DNA, 68 bp, Homo sapiens
gcaatcggctccagtgcgcctgcggaggcggtcctatgacgtgaataaccctataccttccaatttga

SEQ ID NO: 29430 - DNA, 286 bp, Homo sapiens
cacatccagtttcattaacatgctttttgaggttctgtgcctggtccttgcttacttctccagcagcagctctcagccctttacccttgcttgtgctgttttagtcataccatagaacttcattctgttcatcaaaagaagctatttcccctaacttctcagacttttatatgatttcctttccataaagtattcatccttattttttatccagctaaaatctatgtaactactaggttaccttaaatgctacattttctcaggaaaatgttttttgacacccagc

SEQ ID NO: 29431 - DNA, 309 bp, Homo sapiens
  misc_feature 74: s=g or c
  misc_feature 133: m=a or c
  misc_feature 268: r=a or g
gctggagagaatgagcttggagccgcagggcttaatcccgcgcggctcagagatgggtttctggactcgcgaasagctgcaacaaaggcatcactcactgtataagtatttccatttcttgagagcaaaaggmagaacttaagcgggcggcacttggagtgtaaattgctttgtagtatttaaaggcagaaatggatcctgggcagccgagctgcaacaaaccggcaaggacttcctgtgaaatcatgaccaccatgtgctctttcarcctctatcagttcctacctctaagcacctgagagccaaagc

SEQ ID NO: 29432 - DNA, 310 bp, Homo sapiens
  misc_feature 137: b=c or g or t
  misc_feature 138: w=a or t
tgattgtgacacactggcacaaacccgcatgtatgaccatcggccttcaaaaaccctgtctccaatatatgagatggatgtaatagaagcatttgagcagaaagtggaatcagaaacacatgttacagatatggatbwtgaagatgaccaacaattttgcaaaacaagattggacactactaaagcaactgctctctgaacaggattcaaacttagatgttacaaattccgttcctgaagacttaagtttagcacagtatctaatcaatcagacactacttttagcacgagatagctcaaaacctcaggg

SEQ ID NO: 29433 - DNA, 80 bp, Homo sapiens
tgaaggcctgagaaccaggagcactgatgtccatggacagaagatgaatgtctcagctaaaacagcaagtccaccagcgg

SEQ ID NO: 29434 - DNA, 279 bp, Homo sapiens
  misc_feature 232: n=a, g, c or t
  misc_feature 233: s=g or c
tttaacagctgcatttttcattgtccaaatatagtcacatacatttgaccattttataattattgaataataaattcgttctgctattttacaatgaaaaataatgctgcagagagcatttttgcacatgtatcgtggcagatgtaggccagaggctcttcttttatccatcctatggccaacctatgaatgtatacacgtttaatgagattttgccagcaatcaaagcctnsagggaaaatgtccctagctctttactacatcagatcaaggactcca

SEQ ID NO: 29435 - DNA, 203 bp, Homo sapiens
  misc_feature 157: k=g or t
  misc_feature 158: k=g or t
atagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggtttkktatacatttcaaacaggttgcacaaaagttaaaataatggggtcg

SEQ ID NO: 29436 - DNA, 109 bp, Homo sapiens
cgtcacccctttctttgactaggaaagggaactccctgaccccttgcgcttcccgagtgaggcaatgccttaccctgcttcggctcgcgtacggtgcgcacacccacat

SEQ ID NO: 29437 - DNA, 224 bp, Homo sapiens
  misc_feature 110: w=a or t
  misc_feature 129: m=a or c
  misc_feature 132: k=g or t
atagtctctctcctaacttcattccattgtattgcaatcagtcaagtaaggtgatttttttttttctggatgtctcaatctagagattttatagcattttgcaaatgggwatgcttcactactatccamagkgttctcccctttagtaattcatattgaatatatccatattcatatgcattttataaaacagttaacagaatctaaataagatatagccgagc

SEQ ID NO: 29438 - DNA, 123 bp, Homo sapiens
gtgaacataggtgtctacagtcattttctagctgggtaaccctgagctggttatgcagtctctctgttagtttccttatatgtgtaacataaaataacagtagtgtgtattattgaggatttt

SEQ ID NO: 29439 - DNA, 139 bp, Homo sapiens
  misc_feature 23: y=c or t
tacaaagtgtagagtctcacagygcttaaccactatgtaaaagacactaatgagaaaagactcaaaaggaaggcagaaaaagtctcatatggcaaatactggatgacattttggggctattgaaaatatgggtggcggc

SEQ ID NO: 29440 - DNA, 405 bp, Homo sapiens
cactatttgaaaaccttgtcctgggcatgaagtagaagcagcctttctgggggaccatggcccagcagtgggggaggaagtaagtgtttccacagtaactgatgttaagctccaggtgttactcattatgacttcagggaggaggagggggagggaaaataatgtaaatacttattatttataatcatacagtatctttatgccacttttagcacatgctcattaatatgctagtacatttagaggcacatctgcctagactggcttagaatataaattctgggatccctcttttgcttggagctgacatcagtgtgtaagagcccaagggtggcattctttcattcaacatatatttactgagtactttctatgtgctagggcctggggataaagcagcaaacc

SEQ ID NO: 29441 - DNA, 236 bp, Homo sapiens
  misc_feature 124: r=a or g
ccaaatccaagcacagggtaaaggtttgcagtttatatttttaatttttagtacatgtttactgagctaccgaagtgtgcccagcactgtgcacacgctgatccctccatggagcatggttggraaattcccagagcagcccctttctctgaacacaagtgtgacacaactcgctggctgttagcccccgcaagccaaacgtgacgaaggcaccttcaagactctaacaagagcac

SEQ ID NO: 29442 - DNA, 112 bp, Homo sapiens
ccagtgcatgaagtgtgaaaatattttaaaatgacatttttactaatatgagcaagtcatgtaaacattgaagaacttggtaacatattagtaaatggatattaccaaattc

SEQ ID NO: 29443 - DNA, 122 bp, Homo sapiens
cctgttaaaaactacatggagagtcccagactttgaaatcgagacagtgggaccttggcagtatttgggggtaccaagctgaataatattttattagtggcaaacactaaacagtaacaggc

SEQ ID NO: 29444 - DNA, 123 bp, Homo sapiens
ttttcgcgttcttcggactagccagaggctcaggttggtgaccgagcggcagagttcctagcgcctgcagtgtggtgaactccaacttttaggccaagttgaaaatgcagccgacgacccccc

SEQ ID NO: 29445 - DNA, 296 bp, Homo sapiens
  misc_feature 124: w=a or t
  misc_feature 287: w=a or t
  misc_feature 288: m=a or c
  misc_feature 289: d=a or g or t
ctcccagatttagaatgtgccaaaaatgatgccatggggaatattaaaaaatgaaaaaaagaagattaatgtggtccttatttccagtctgatataatggctacaagatgtggatatattatawgaaatgttttagaaatacataatcaactttcatttaaaagagaagcttccaaatccagtgagggaagcttcgcggttgtgtgtagggattagcagtttggggttctgagtccctggtccctctcccctgccctcctctccctcaccccctaacttcttaactwmdtccccct

SEQ ID NO: 29446 - DNA, 120 bp, Homo sapiens
aagtccgatttcaagcccaacccgatgggattcagaaaagcccgcccagcgtccccaggcccagcagtccacgccacaccgtcggcgacggatttcgtttctattccccgcacggcccca

SEQ ID NO: 29447 - DNA, 193 bp, Homo sapiens
cctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaat

SEQ ID NO: 29448 - DNA, 291 bp, Homo sapiens
gggcatataggagagaacagtgggagttcaatttggctagagcatagcatgagggaagtagtctggaacaataagcctaaaaaaggtaggctgaggtgaaatgctggggcagtttaaataaaatgtatggaatctggtgattccttacattcttactgattctgagtggacagtctctcaggtagtagttttgatggcacctggaagatggtctgcgggacacaagagcctgggaaggagaagactagtagccagctatggaatttgtttatgtgacttataatggggccc

SEQ ID NO: 29449 - DNA, 77 bp, Homo sapiens
aagcttggcgtttgtttggtggggttacacgcgggttcaacatgcgtatcgaaaagtgttatttctgtccggggcct

SEQ ID NO: 29450 - DNA, 337 bp, Homo sapiens
  misc_feature 132: s=g or c
  misc_feature 300: v=a or c or g
  misc_feature 301: k=g or t
ctgtagttgtttgagtttctagctttaaaaagttaagggagcatctggccgggcgcggtggctcacgcctgtaatctcagcattttgggaggccgaggcgggcagatcatctgaggtcgggagttcgagacsggcctgaccaacatggagaaaccccgtctctactaaaaatacaaaattggccgggcgtggtggcacatgcctgtaatcccaactgcttggaaggctgaggcaggagaattgcatgaacccgggaggcggaggttgcggtgagccgagatcgtgccattgactccagcvktgggcaacaagagcgaaactccgtctcaaaaaaaaa

SEQ ID NO: 29451 - DNA, 142 bp, Homo sapiens
  misc_feature 121: k=g or t
  misc_feature 129: r=a or g
  misc_feature 130: r=a or g
atgtgtatatcttgatactttaacatgtaatgctattacctctgcatattttagatgtgtagttcaccttacaactgcaattttccctatgtggttttgtaaagaactctcctcataggtkaagatcarraggccccaacga

SEQ ID NO: 29452 - DNA, 54 bp, Homo sapiens
cgtcacccctttctttgactaggaaagggaactccctgaccccttgcgcttccc

SEQ ID NO: 29453 - DNA, 122 bp, Homo sapiens
cttataataatttttaaataaattacataatttagattcacttgggacaaaaactatccatttcatgaggatactgaaatttattttctagagttttcatcgagtctgaagtggctgtaagc

SEQ ID NO: 29454 - DNA, 241 bp, Homo sapiens
  misc_feature 196: r=a or g
aaggatgagcagatcagatcacgaaatgggacaatcttcccaggagggaagctgcagtccagtgcatgaaattagtgcacggagtggcaacagtttccttctgcactcctgataatcacattgcacttactgaaacagtttgtaaattgattgtatctctaagctaaacagccttggaacactaaaaacaaaccaractaaaacaaagaaaatggtgattttataattagtatggcccgaa

SEQ ID NO: 29455 - DNA, 255 bp, Homo sapiens
  misc_feature 121: m=a or c
  misc_feature 243: n=a, g, c or t
taaatctttaaacagttaatagatactattagattgctgtacttctgtggtttatactcttcactgtgagagtagaatacttcaaatgcttgtgctagatgttttgcctttttaattttamaaatctgtctgggcacagtagctcatggctgtaatcccagcactttgggaggctgaggtgggtggatcacctgaggttgggagttcaagaccagcctgggcaacatgattaaaccccatctncactaaaaacac

SEQ ID NO: 29456 - DNA, 319 bp, Homo sapiens
  misc_feature 205: n=a, g, c or t
  misc_feature 206: r=a or g
aaaagtttatgatgatgggcaaaagtcagtgtatgcagtaagttctaatcacagtgcagcatacaatggcaccgatggcctggcaccagttgaagtagaggaacttctaagacaagcctcagagagaaacctctaaatccccaacagagtatcatgagcctgtatatgccaatcccttttacaggcctacaaccccacagagatnracggtgacccctggaccaaactttcaagaaaggataaagattaaaactaatggactgggtattggtgtaaatgaatccatacacaatatgggcaatggtctttcagaggaaag

SEQ ID NO: 29457 - DNA, 285 bp, Homo sapiens
ttgtagcaccgagaaaagggatttatagcttcagcttccacgtggtcaaagtgtataacagacaaaccatccaggtcagtttaatgcagaatggctacccagtgatctcggcctttgcaggagaccaggatgtcaccagagaagctgctagcaatggcgtgctgctgctcatggaaagggaagacaaagtgcatctcaaacttgagagaggcaacctcatggggggctggaaatactccacattctcgggcttcttggtgtttcctctataaacacagagcccct

SEQ ID NO: 29458 - DNA, 304 bp, Homo sapiens
ctgaaccaaggcaagatgttatttggactctatttataccatttactgtttgtggaaacaatgagataagtatttaatgaaaaggattgtgcagcagaaatgtgacagctcatatccattacatagttcgagtataagcacactactacaaactctaaattgttagacagatggtggcttttgggcttcattcaacagaaaatagcactaattctctaaactagcaattcctgggttttactactcattgatttcttaatagatttaattttatttcaccattaaccaacacttatttctaaat

SEQ ID NO: 29459 - DNA, 164 bp, Homo sapiens
  misc_feature 145: y=c or t
cttctggcctcccaaaatgttgggattacaggcatgagccactgcgcctgactgatgcaatcagcaatctcctgcaacctctgtctcctgggttcaagccattcttctgcctcagcctcccgagtagctggaattacaggtgcayaccactacacccaggttag

SEQ ID NO: 29460 - DNA, 118 bp, Homo sapiens
tgtatgcactttagttgttaataatatattagtattggttcattagttgtatcacagaaactgtattaatgtaagaggttgatgataagaaactgggtgtggttatgtaggaactcgt

SEQ ID NO: 29461 - DNA, 186 bp, Homo sapiens
  misc_feature 129: w=a or t
ataaataaatacataaaataagataaactgggaataaaccaatcatggtggggatgctgttcaaaggaagctcagctcagtcaagtgatgataaactcctgagcacctcacagcacctgttgggagccwtctgtgtatccctcatctcccaccagtttcctgcctgagcatctaccccggggattg

SEQ ID NO: 29462 - DNA, 119 bp, Homo sapiens
gggagaaaagactatctgatttcaaaaccgacgcgacccgagctgggctgcggaaatggcgcccatgtcccggctccggccaggtcgtgatcaggagacaggtgtggccctgggtcaga

SEQ ID NO: 29463 - DNA, 388 bp, Homo sapiens
  misc_feature 299: n=a, g, c or t
  misc_feature 300: n=a, g, c or t
aaagaaaaaatatttagaggtgaaaccatgttagactagttggccatcagtattttcatttttctattatctaggacccatagatttttgtaatattttaaacctatttttaatagggcaagatttgcctactctagttccatttattactctacaatgttgaaaaaatgatggaggttcattttttacataaccacatgaaattagagctggacttcaatttccatatatttttctgtgtgtatattatacatgtgtgtctagtttaggggtttgttaaacttggcactttgaacgtnntggagcagattcttcttttttgagtggaggggctgtcctgtgcatttcaatggttctgcccggcctctcccaactcaatgctggcacc

SEQ ID NO: 29464 - DNA, 353 bp, Homo sapiens
  misc_feature 296: n=a, g, c or t
  misc_feature 297: n=a, g, c or t
cagcatttatctatttcttgaatctataatgattcctttaacacttttctagatcttgagttatttgttcaaattatttgtctcctctccaagactcattgttctatacttgtacgcattgcaaatactatgctcacttgcagagtttttgaaatcgcatgcatttgtttgctcaatattacgatgtattatgttacaatgaagagtttaatgccatctttaaatgcttgcttttgccttgcacccttttttaaaatataaaagtgctagattaagcgttcatgccagttaccacnnttgttgattctgccagaagagcatttaccagtaggttctggttcttgttacccaac

SEQ ID NO: 29465 - DNA, 296 bp, Homo sapiens
taaaactggcgtcggggagaagtaggtcagagggtatgaagtggtagttgtagttacgtggggtggatacgtctagagatgggatggacagcatgaggactgtagttagtaatatcgtactatatactaaaaattttgccgagagtagatttgaggtattcttatttttaaaaaaaagtaattctggaaggtgatgtgtgtgtttgcttgactatggaaatcatttcatggtgtatatgtatatcaaagcattatattttagaccttaaatatgtacaattttttaaacccccact

SEQ ID NO: 29466 - DNA, 378 bp, Homo sapiens
  misc_feature 116: r=a or g
  misc_feature 117: m=a or c
  misc_feature 120: r=a or g
  misc_feature 121: m=a or c
  misc_feature 133: m=a or c
  misc_feature 331: m=a or c
  misc_feature 350: m=a or c
taaagaattaataagtttaggggcaaatgtgaatgtgaaagattttgcaggttggacaccactgcatgaagcttgcaatgttggatattacgatgttgctaagatacttatagcarmtgrmgcagaatgttamcacacaaggattagatgatgacactccactccatgattctgctagtagtgggcacagagatatagtaaagctgttacttcgtcacggtggaaatccatttcaagctaataaacatggggagcgtccagtggatgtagcagaaacagaggagttggagttgctactaaaaagagaggtgcctttatctgatgatgatgmaagttacacagagtaaagmcaagattgcatcctacagcaaaactcca

SEQ ID NO: 29467 - DNA, 121 bp, Homo sapiens
caatgagcaccacttttgggcctgatgtagtgcttgaccttggggcaaatatcaaatatggtaaaatgtggttccttctctgcttgcatttatagcccagtcaaggagcaaaccagcaccg

SEQ ID NO: 29468 - DNA, 398 bp, Homo sapiens
  misc_feature 299: n=a, g, c or t
  misc_feature 300: n=a, g, c or t
  misc_feature 301: k=g or t
  misc_feature 374: n=a, g, c or t
agaaatgcaagtttctacttccaaccaaatgttatattgtacattatgctaataaaaagaagaaaagtttatatgtcctatcttagtccccctttatctaaagactgccatactcttccccaaaatcaatgaaatgtgggtgaatccttcatcccatatatcaagagactttgctgtgtacgtaatattcaagtctcaggaggaagtgtgaatcttatttccatagcccaaggctagctagattgccaattggcccctttttgcttaggaatccagggtttcccttaactctttatcannktttctgagcttttctgcctcatagaaggcaatcctttcttcacttagcattcttgaatcacactctaagttcnaagctacccctcactcccattttt

SEQ ID NO: 29469 - DNA, 221 bp, Homo sapiens
  misc_feature 133: r=a or g
  misc_feature 220: k=g or t
ttagagggtaattaagatacttggatactgaggattgcagcacatctgggggatttgaagggaaaccaaacagtttaaaaagtgaatttcattcaaatgtttcctagcatgctcttattaaactttgactcaraccattaaagccagtctttttttggtgatttgttcttgtcagaaaaattctctaaacaaaatctaaagtaatgactttaactttttkt

SEQ ID NO: 29470 - DNA, 385 bp, Homo sapiens
  misc_feature 182: d=a or g or t
  misc_feature 183: n=a, g, c or t
gtgtcggaggatgaggttttggctgaggactgaagagatggccttggaagaaatggtgcagagattaaatgcggtttccaagcacacggatgaaatcatgcaccaggacatcgtcccgctctgtgctgccgacatccaggaccagctaaagaagcgctttgcttacctgtccggtgggcggdnggcaggacggaagcccggttatcaccttccctgactacccggccttcagcgagattccggacaaggagttccagaatgtcatgacctacctcaccagcatccccaggtacgtgcacccagagcccggcagacattgtggtttggggcagagtccctgtgagatttcaccagggtggggtccctgcaactatgggatgaggca

SEQ ID NO: 29471 - DNA, 446 bp, Homo sapiens
  misc_feature 140: w=a or t
catgaaaatttggcatttgtgcacacctcctgaatgtaaacatggtgtctttcatctgcagaatcatgttaacagaaagctttagtgtgagatgaagcttagaatttaggagctccctttgtaaaagtggtgatgatggwggtaaggttgccaagtcttgtactactcaatttcttcctcgatgtcttatttgttttagaaaaacttgagcagcctcaaaaccagtaattttaggaaaaatagtagcctttggttctgttagttttattgttaaactgaataggtgcacaaagagtacatttttaaattaatttgtatatgatgatttagaactggtacagtgaaaatctaccattgtaattttgcatagactagcaccaagggttacagaaccaacacatccctattagttatgtgttctgataaacatttttttcatgtatctt

SEQ ID NO: 29472 - DNA, 179 bp, Homo sapiens
  misc_feature 100: n=a, g, c or t
tctacttctaggtgtttagccaagagaaatacaaacatgtccatgtaaaaacttgtacctgaatgtgcctaccaatcttattcacagaagccaaaaagtngacacaacccaaatgtccagcaatggatgtattcagcaagcacaatgtggtctatccatacaatgaaatattacccagt

SEQ ID NO: 29473 - DNA, 327 bp, Homo sapiens
  misc_feature 106: k=g or t
  misc_feature 140: m=a or c
  misc_feature 307: r=a or g
  misc_feature 308: m=a or c
gatgtggttgttggttgttgttgaacaaaagaaagtgaaaatactcttctgcagtcttctttagtagagtagcacaaagagcagtagccaaaggctaaaggagtckattgaaattgttctggccccacttagagaagtamaaaaggaaggtaaaattttgggggaaaaactttcagtctgaagaaagtacacactgttttttcaattaaatttaacttacggttaaaggcaaacttaatgcacaagatttcattaccatatttacaataatggtgtaggtgataaaatgcatagtggggtttatagrmaaaaaaagttattttccaa

SEQ ID NO: 29474 - DNA, 120 bp, Homo sapiens
gtctttaagtgaaattagggtatctcaacctcagcattcttgacattttgattcagataattcactgttgtcaatgactatcctgttaattataccgtgtgtagcagtgtccctggccat

SEQ ID NO: 29475 - DNA, 304 bp, Homo sapiens
aacaaatgggattatatctaactaaaatgctgttatacagcaaagaaagcaatcagtggagtgaaaagacaacctacagaatgggaaaaatatttgcaaactagtcatctgacaggagattaatatccagaatatacaggaaactgaaacatctcaatatcaagaaaacaatctgattttaaaatggtcaaataatctgaacagacatttctcaaaaagagatttaaatatgtccaacagataaataaaacaaaatgttggccatcaataatcttcaaggaaatgcaaatcaaaaccacaggga

SEQ ID NO: 29476 - DNA, 144 bp, Homo sapiens
  misc_feature 119: w=a or t
taaaaagtcaatatatgtataattctgagatgacttaggttggacattcaatgttgtgctatgaatttcctctttatgcagagtatctgtttgcttgcagagtggctttctggcttgcwgccagcctgtgcatggaccacgtcg

SEQ ID NO: 29477 - DNA, 220 bp, Homo sapiens
  misc_feature 132: m=a or c
  misc_feature 133: v=a or c or g
  misc_feature 144: k=g or t
  misc_feature 193: k=g or t
tctatgtcttgttcagcagaaaccagaggagtcctgtctgggggtcccatcattattcgggatacccgccgccagcggcctgccttcggttacccacatccccctggaacggatatctgtttggggcactamvatctatcctgkagaaactatggccaaatctccatcaatgctttgctaatttctgggactkaactcgtagaatctacatacagggcgt

SEQ ID NO: 29478 - DNA, 175 bp, Homo sapiens
tcattctttttttgattgtttttggtttttctgagacagggtctggctctgtacctacgctgtagtgcagtggcatgattatagttcactgcagcctcaaactcctgggctcaagcgatcctcctgcctcggcctcctgggtggacgggactacaggtatgtaccacgatggcct

SEQ ID NO: 29479 - DNA, 273 bp, Homo sapiens
  misc_feature 128: n=a, g, c or t
  misc_feature 129: d=a or g or t
  misc_feature 133: s=g or c
aaatatttaaacggttttttcagcatatcatcactgatcattggtaaccactaaagatgagtaatttgcttaagtagtagttaaaattgtagataggccttctgacattttttttcctaaaatttttndcagsattgaaaggtgaaacagcacaatgtcccattccaaatttatttttgaaacagatgtaaataattggcattttaaagagaaagcaaaaacatttaatgtattaacaggcttattgctatgcaggaaatagaaggggcgtcc

SEQ ID NO: 29480 - DNA, 194 bp, Homo sapiens
  misc_feature 146: d=a or g or t
cctgttgctgttgcattgagttcagttgtttcgagtatccacttaaaatgctgtgacactaatcatctctgcatgagcagtttgtctatctagtaacttgcctattgcagtaaaaaggtgatctcttgcagttctcatggagtttdcattgtctcgtgcaatgccatcgaccttgaatttcagcataggaaccc

SEQ ID NO: 29481 - DNA, 144 bp, Homo sapiens
acctgccttccgcattcatctcactgggagcttcagaccagagctgtttctgtttggccattttggcccctcccttcaagtatgttttcttttgtaagaaactgccaaagtggctgtagcatttcgctttcttaccagtaatgc

SEQ ID NO: 29482 - DNA, 291 bp, Homo sapiens
  misc_feature 146: m=a or c
tgaaaaatcagttcctaggttgcactgcccacatttcaagggctcagtgtccatgtgtggctagtggctactatactggaccagcacggattagaatgctttcttcattgcagaaagttctattagtgctggtctagaggtcattmagttttgcccctttatttaattttttcccccttttattccacaaaggagaaaatgagggacaaagaaaggaagtaacgttcagcatcagacagctaattaatccagttttttggactggttgcctgttagattttcccatgcccc

SEQ ID NO: 29483 - DNA, 87 bp, Homo sapiens
tttcttaagagaacttaaagaactggtgatttttttttaacaaaaaaagggaccattgcaacttttgttaatttaattttttttttt

SEQ ID NO: 29484 - DNA, 111 bp, Homo sapiens
gtggcttgagtgcttgtcacaaatctcctaaaggccttcgtttctggactgacatttcagtgctttcagctgtcatttctgggaaacaaaatggtttggcctcaccatcca

SEQ ID NO: 29485 - DNA, 181 bp, Homo sapiens
ctcttttcgcggcgttctccacctgcgcgggcctgaatggccttcaggagcacagtcggcctgaggagttgacggttactcaccgccgtgagcccaagtaactcgccctccttcggctagaaaccctccgcctgggcccgcgcgacaggagcgcggtctctgaggggagcggcgaccccgc

SEQ ID NO: 29486 - DNA, 183 bp, Homo sapiens
tgagaccagcctgggcaacatggcaaagcctacaaaaaattagccaggcatggtggcatgtacttgttgtcccacctacttaggaggctggggtccgaggattgcttgagcctaggaggccgaggctgtagggagccatgatcgtgccactgcactccagtctgagtgacagagcaagacccc

SEQ ID NO: 29487 - DNA, 305 bp, Homo sapiens
  misc_feature 279: r=a or g
  misc_feature 280: n=a, g, c or t
  misc_feature 281: s=g or c
ctggctactgcttttgcatgacctataaaggtcttataaggctctgaacagtaattcaaaatgtaaacgtgtaggtactcaaaaacataaatgtcacatctgctttagctcttcatctccattgctgtgctgtagttttccaattgatggaaaggttttattcagatcagccatttctctttttcctggaggcattcttaatctccgtgttctaacctttaacaatataggcttcagttgccgtgtgatgatttccattgcctggaatctacatgtttrnsttcttccaaagaattgtgcacctc

SEQ ID NO: 29488 - DNA, 118 bp, Homo sapiens
  misc_feature 103: d=a or g or t
ggatgttaaggatttcccttcattatggcttttatgttaaccaagggcattctcataggtgattaagtcacatcaggtaggccctaggcctgggtctgacccdcgcagttaccccccc

SEQ ID NO: 29489 - DNA, 224 bp, Homo sapiens
  misc_feature 121: n=a, g, c or t
  misc_feature 127: y=c or t
  misc_feature 172: s=g or c
gaggcgggcagatcacgaggtcaggagatccagaccatcctggctaacacggtgaaacttcatctctactaaaaaatacaaaaaattagccggacatggtggcgggcgcctgtaagttccnagctaytcaggaagctgaggcaggagaatggcgtgaacccgggaggcggasttgcagtgagccgagatcgcgccactgcactccagcctgggtgacagagcgt

SEQ ID NO: 29490 - DNA, 182 bp, Homo sapiens
tgagcattgatcctggaccctgaatacaggcctgcctcttggcagagttgatagaagtaggtgacttcaatcagaaacaacaaaggtgacgttataactgatcccacagaaatacaaaagatcctcagggtctatacaaaagatcctcagggactattatgaacacatctatgcacacaaac

SEQ ID NO: 29491 - DNA, 407 bp, Homo sapiens
  misc_feature 347: w=a or t
  misc_feature 348: k=g or t
cacattctacctaaaaacgtgaacctcacaatactcgaaaatctccccacatacacaaaaagactctatatcacatacggaaaaggtagctggctttagttcagtgatttttcaatgaggaatgctgcacttccaatgaaaacagacagccagtgtagagacagtccgtatcctgtttctactgtatgactctgattcataaattactaaagtgtattcctgagaaataaatatttcaccagccagtgacagcgttatgagctaattaaaatctgagccctggaagaagtggtgccattagctcaattcacaggactggaaagtatgtgtctgctcacggactgagwkgtagacatttacatatgggaaggagggggccggcttattaagagcacattgaggtttgg

SEQ ID NO: 29492 - DNA, 300 bp, Homo sapiens
tagaggggtttacagattaaacaggcagaagaatcagcaaatttgaaaataggacaaatgtaattatccagtccgaggaacagaaagaaaaaagaatgaagagtgaacagagcttgagggatctgtggcattttatcaagttaccaacatacgcattaaaggagttccagaaaatgaaaagaaaaaggcagaaataatatttgaggaaataatggctgagacttcccaaattcaatgaaatacatgagctacacattcaagaagatcaacaaattataactaggataaactcagagattg

SEQ ID NO: 29493 - DNA, 125 bp, Homo sapiens
aaagataatcctttcaacaaatgggagagggacatctgaacattcacaggcaaatatatatatatatataaaatatatcaaatatatatcatatatatatatctcaacatagacctatgcccaga

SEQ ID NO: 29494 - DNA, 245 bp, Homo sapiens
  misc_feature 100: d=a or g or t
  misc_feature 101: m=a or c
  misc_feature 131: y=c or t
  misc_feature 132: m=a or c
  misc_feature 138: m=a or c
tgatctaggagtcccactactgggtatctacacagaggaaatcattatttgaaaaagatacttgcacatgcatgtttataacagcacaattcaccactgdmaaaatcgtggaaccaacccaaatgcccaaymaatcamcaagtggataaagaaactgtgagatatatatatctctagaggaagaagcaaatcacagagaaatacctacagtgtgattctattgatataaagtcaaaggcaggcgt

SEQ ID NO: 29495 - DNA, 163 bp, Homo sapiens
  misc_feature 136: w=a or t
agaaaattttcgcaacctactcatctgacaaaaggctactatccagaatctacaatgaactcaaacaaatttacaagaaaaaaacaaacaaccccatcaaaagtgggcgaaggacatggaacagacacttctcaawaagaagacatttatgcagccaaaagcg

SEQ ID NO: 29496 - DNA, 125 bp, Homo sapiens
ttaatggacatgtaatgattatgtatatgggtaatacagttacgttttgatacatgtatacagtgtaatgatcaaatcgggtaattagcttattcgtgttaaatgtttctttgtgttggcaacct

SEQ ID NO: 29497 - DNA, 416 bp, Homo sapiens
  misc_feature 37: r=a or g
  misc_feature 38: n=a, g, c or t
  misc_feature 142: m=a or c
  misc_feature 146: m=a or c
  misc_feature 159: v=a or c or g
  misc_feature 263: r=a or g
  misc_feature 264: d=a or g or t
  misc_feature 311: h=a or c or t
  misc_feature 312: v=a or c or g
  misc_feature 313: r=a or g
gggcagatgaggtccggagctgctgagggatcccggrntccttctgttggtctgagaccctggggcgggcggaatcccggagaaagccggagggactccccaggggaagcctgggagctgccgttctcctccctggctgtgmaaamcaggaaggggctvgtgatgctggctgcgggcctccctcctggactgcgacattgtcaccaaattctataaagacgtcatgcaggaagtgataacgtgtgctgcgacgttctggaagrdactcgaagctaaaaaaagaacaaaaaatcaatgaaaaaatgaaacthvrgaaacaatgagatgctatgtcaatatccgtagttatggaatggaaaataaatcttacaaagagatgctggagttatctaagaaatttacaccatactggcact

SEQ ID NO: 29498 - DNA, 258 bp, Homo sapiens
  misc_feature 132: w=a or t
gaaaatgttagggtttcctccacctttttatgaagtaaaagaacctgtcgtaccagcatcatgagctggatgcaggagcccatggctgaaaggagttaaaacgcccagtggtcattaagtgaaaacatcttwttatcaacctgcaaaagctgcagcgttctctgccaggtcaaatgggcatgtttagaaaataagagaagatggctgagtatagctaatgaataaatggttgtttctttagaaaattaaacacacaca

SEQ ID NO: 29499 - DNA, 287 bp, Homo sapiens
aggcaatctcgagccacagagacgtccccgctgacgagaaggaagtcctacgaccgagggcagcccattaggtccacagatgtgggattcacacccccatcatcccctcccactcggccccgcaatgaccgcaatgtcttctctcgtctcaccagtaatcagagccaggggtcagcgctggacaagtctgatgacagcgactcctctttgtcggaggtcctgaggggcatcatctccccggttggaggagccaagggtgcacggacggccccactgcagtgtgtctc

SEQ ID NO: 29500 - DNA, 91 bp, Homo sapiens
  misc_feature 70: d=a or g or t
  misc_feature 71: r=a or g
gagacaggggcagactgtagcccccagtccctgaggttgctacttaaggagatgcttttgcagtgagggdrtggggcagcagccaccaggc

SEQ ID NO: 29501 - DNA, 112 bp, Homo sapiens
taaagccataatatgctgaatattcaatgaacttccataaattagtaagaaaaagaaaactatccaatagaagaatggtcaaaagatatgaaaagaaatttataggagcgta

SEQ ID NO: 29502 - DNA, 399 bp, Homo sapiens
  misc_feature 299: n=a, g, c or t
  misc_feature 354: d=a or g or t
agcaaataccttttgtttctctcacgttggggctacttgttttagggcgcaaaggaacggcctcgaaagggggtccttccccagccgagaaccaggaatcttccctcggcccgcgcgcgcgaccggccggtgcgccgcggcccgcgaacaatcctccaaacacagactgtttgacttagaatcttcccttttttactccattcaagagcagcattcataaatttccagaatggagatctcctctcatcagtctcacctcctgcagcaactgaacgagcagcgcaggcaagatgtatttngtgactgcagtattctagttgaagggaaggtcttcaaagcacatcgaaatgtatdattcgctaagtagcggctactttaaaatgcttctttctcagaatt

SEQ ID NO: 29503 - DNA, 405 bp, Homo sapiens
  misc_feature 28: k=g or t
  misc_feature 308: d=a or g or t
  misc_feature 309: n=a, g, c or t
  misc_feature 390: s=g or c
acaaaacccggaaggaccccgccgaagktttctccggttcgggagagagacggagtcccgctctgtcacgcaggctgccaggctggcgtacagtggcgcaatctcagctcgctgcaacctccacctcctgggttcaagcgattttcttgcctctgcctcctgagtagctgggattactggcacacaccaccatgcacagttccttgttcaaaatgccaagaacctggatgactcatagtcaagaccctccaccagtaacatatattggcgagccagacaggagcttggaaccctcggtggacagtgcdnagcacagaggcaaccacaggtttctaacagggccactctctggtgaaactgaaaggtttctgtgtgaaagtgcctgaccascactgcccaattcaa

SEQ ID NO: 29504 - DNA, 250 bp, Homo sapiens
  misc_feature 131: s=g or c
  misc_feature 132: y=c or t
  misc_feature 136: k=g or t
  misc_feature 138: r=a or g
attggagagaagcaactgtaagccaaggaacaccaaagactgcaggaaaccccaaaaactaggaacagggcatggaacagattctacccatattctcaggaagagtccctgccaacacctggaattcaagsyttckgrattccagaatctaaaaaacctgggcttagataatgattacgccaaaccactggattcaagaaaaagctcgtcatgcccaactattgcatgacagtatgtgagagccaacctc

SEQ ID NO: 29505 - DNA, 200 bp, Homo sapiens
  misc_feature 126: w=a or t
  misc_feature 128: w=a or t
  misc_feature 133: w=a or t
  misc_feature 135: k=g or t
  misc_feature 137: y=c or t
  misc_feature 142: k=g or t
tcactactgtgttacatttatatcacaagcttcaattaaaatggattttaaaggattttaggatttacctttagtattaacaacgtatctactgacatactgttaggattcaaaaccagttaagtwtwagaawtkgyttcakgtggttttcctagggtacaatttataaaaggtagaaagcatccaagtggctcctcatt

SEQ ID NO: 29506 - DNA, 160 bp, Homo sapiens
  misc_feature 118: w=a or t
ttcatctaaaagtggaaagatttttgcttctgcgttattaagagcctctttgtttggaggagatggttatctccttcactcattaacctttgagtgcttgttatctacaaagatgaawaaaatctttcatttattatttatgatacttgtctgagcgccg

SEQ ID NO: 29507 - DNA, 126 bp, Homo sapiens
tgccagatttcttgtatttattccacatcattatgcctataatgtgccgctttgtgattgggcatttgcctacttttctttcataattagtgatatatgcgatgtaaaaccactagtaaaggtacg

SEQ ID NO: 29508 - DNA, 113 bp, Homo sapiens
  misc_feature 113: m=a or c
agaaccttcctgccgtcgcgtttgcacctcgctgctccagcctctggggcgcattccaaccttccagcctgcgacctgcggagaaaaaaaattacttattttcttgccccatm

SEQ ID NO: 29509 - DNA, 133 bp, Homo sapiens
  misc_feature 127: y=c or t
  misc_feature 128: k=g or t
  misc_feature 130: d=a or g or t
  misc_feature 133: s=g or c
cattgtcagcttggacatttagtatccatttacattatttattttgttcatacctgacttgcttttctctcgaattttggagtgaggctaggggaagataaccatgttagcatttatttaatttgcykgdacs

SEQ ID NO: 29510 - DNA, 426 bp, Homo sapiens
  misc_feature 150: w=a or t
  misc_feature 303: h=a or c or t
  misc_feature 304: n=a, g, c or t
  misc_feature 305: n=a, g, c or t
  misc_feature 403: r=a or g
cccaaatgcttttggcaattttcctggaaagctcagaaattgcctattttttcagagctcatcgtagagttcacaggtatgttgacaagaaaaccattttaaaatctaaaaactatctccttttggtctttaatttcatttctgtggggwgtatgatgtgaaaaatatgataaatttcttgggacagtgtagtgccagtgtttatgaacatttctgcttttgtttatgtgaaaatctaaggagtttcccacagatgctgtggagttaaggccaaaaatatgcatttttttcaaagtgccgathnngtaaaaagtacacggtttctctgaatgaatgccttgagaggaggcatgtgcagggtgttccattgcacatcaatcttttctttataataattgtgcgrataaaaaagaaagatgctctaaa

SEQ ID NO: 29511 - DNA, 139 bp, Homo sapiens
  misc_feature 59: r=a or g
ttctaattataaggtctaatatattttatgaaagtaatataaacactaatatttattarctttattaggaaacagttgtgagggaaattaaaggtgaccttcaaaacagataaacaataaaacaaagtaggcgcattag

SEQ ID NO: 29512 - DNA, 198 bp, Homo sapiens
  misc_feature 132: w=a or t
tgaaaaccatctacagagcccttcccgggtccctcgacccagtggtgtagccgttaccaatgtttacaaccatgggccgcccctccttagatgtgtttactcgcattcacaggccacctgttggtttgagtwtcatgtgtctccttccctggcctaggttgacttgagcacacaactcgatctttcttcccctccatc

SEQ ID NO: 29513 - DNA, 287 bp, Homo sapiens
ttttagtaattgaatttctctgcagtagtccttcaagcacttgaatgtaaacctttagcatttattcgtttaatgactactgatacgaatctcaagcagatttcttgctcttaaaagttatgtttcactgagttctggttttgtgtagctatattttatatagctagatattcctcacagtgaacatgaattgtaataattggttatttccttaagtctttagattataataatttcagattattgcacgtctgtgatttgagaggtgagttatttaagaggccgct

SEQ ID NO: 29514 - DNA, 102 bp, Homo sapiens
  misc_feature 45: k=g or t
actgtactgctgccatctcggctcactgcaacctccctgcctgaktctcctgactcagcctgcccagtgcctgcgattgcaggctcacgctgccacgccata

SEQ ID NO: 29515 - DNA, 111 bp, Homo sapiens
agtacagtggggcgcggtcttggctcactgcaacctccacctcctgggttcaagtgattctcctgcatcagcctcccgagtagctgggattacaggcatgcaccaccacgt

SEQ ID NO: 29516 - DNA, 74 bp, Homo sapiens
  misc_feature 21: v=a or c or g
  misc_feature 31: y=c or t
  misc_feature 54: m=a or c
ccatcggagtttttcactcgvagccccggaycctcccccgagccgcagcctctmtccccgccccggatcggagc

SEQ ID NO: 29517 - DNA, 250 bp, Homo sapiens
  misc_feature 138: r=a or g
  misc_feature 142: m=a or c
cgtgtgtgtattttggagagtctgagtggtggtgtatgtcagttgtgactggtatgtgattttaaatattgacctttttgctatatgggtacattatctttttttttaagagtacattatcattgaaatcaaaaagarggcmaggaatctttggatgtagggaggtttttgcttcctgttgttgacattcagtatatgaatgctcctgaatagccctgtagagagaggatgctagcgaatgtgaggctga

SEQ ID NO: 29518 - DNA, 100 bp, Homo sapiens
  misc_feature 14: s=g or c
  misc_feature 16: n=a, g, c or t
  misc_feature 38: m=a or c
  misc_feature 96: w=a or t
attataagactcasgntatattttggaaatagtcctgmaagaatctaccattggattggatattgtgtgtgagggaaaggcaagaatgcaagatgwgtcc

SEQ ID NO: 29519 - DNA, 333 bp, Homo sapiens
  misc_feature 132: y=c or t
  misc_feature 133: y=c or t
  misc_feature 135: k=g or t
  misc_feature 141: y=c or t
  misc_feature 183: s=g or c
  misc_feature 184: k=g or t
  misc_feature 297: m=a or c
gatgcgcggaggcggtggcgatggcgatgatgcctctagtcctgcatcatccagagcggcaggcggagctggggtccggactgcgagatggaggaggggcggcgctgcggccacccggcaggcttatctgtyytkggggcyccttttgtcacatattgctcatctgtgagctgaggccctgaskcactgagtatttttggggagcagaagaaggagacatttctctccgaaaatgaactcaacaggccaccttcaggatgcccccaatgccacctcgctccaatgtgcctcactcamaaggaaaggaaacagcacctctctccaggagggtct

SEQ ID NO: 29520 - DNA, 375 bp, Homo sapiens
  misc_feature 132: h=a or c or t
  misc_feature 140: m=a or c
  misc_feature 162: s=g or c
  misc_feature 164: s=g or c
  misc_feature 312: r=a or g
  misc_feature 313: d=a or g or t
aaatgtgtcatgtgaggcaatatgcattctttgtattctgattttttaagtgttttcatatttatagccatcacaaaattttgcccaaagtgtatggctcagaagagatgatcaataactaaaatgttttthcgtttggmaacatggtaaaattttaggtasasagtggagctttgtataattggtaactttaaccaacatttacgtaagtacggtctttgcagtattacacaataccgcatgagctaatatgcagtatttaggtaatgcattgaatgaagttgaaaatatgctcttaacacactgtgcatrdtttttctaaaattgagaaatatctgaaatacagaatacgaatttaataaaggaagcctacct

SEQ ID NO: 29521 - DNA, 137 bp, Homo sapiens
  misc_feature 135: m=a or c
gttttaaggtacatgtgcacaacgtgcaggtttgttacataggtatacgtgtgccatgttggtgctgcacccattaactcgtcatttagcattaggtatatctcctaatgctgtccttccccccgtcccccggamcc

SEQ ID NO: 29522 - DNA, 104 bp, Homo sapiens
agctgcttttttccctactttgagtgcatggactttcaagttacatgtgggatgaagttgtacggttttgatatctttgtgttacataatctcatagacatgac

SEQ ID NO: 29523 - DNA, 87 bp, Homo sapiens
caggatgcctccctaggttcctactttttgttactagctttattatagctatattattattattattattattattattattattat

SEQ ID NO: 29524 - DNA, 163 bp, Homo sapiens
  misc_feature 129: s=g or c
  misc_feature 130: r=a or g
tattttcaaatgaatatttttgttgagattcacaccggtgcttaaaaatcaccatgttgttttgtctctgacttctcctactagattggtgagtttgattactgtagtcttttctaaatagcactctcsrtaatcttttcctgtggaaacatttggtggcacc

SEQ ID NO: 29525 - DNA, 145 bp, Homo sapiens
  misc_feature 141: r=a or g
agcgggagctacagcatcagcaagagcaacagtagctacagccccggcggcggtgcctgttccagtctttgctgctgcagtccgtgcaaccacccagagggggaggggggaaccaccagtcgctgaggaacaagaggaggrggga

SEQ ID NO: 29526 - DNA, 198 bp, Homo sapiens
caatcatatgttgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggagcgg

SEQ ID NO: 29527 - DNA, 309 bp, Homo sapiens
  misc_feature 129: r=a or g
  misc_feature 130: d=a or g or t
  misc_feature 135: r=a or g
  misc_feature 137: w=a or t
  misc_feature 144: n=a, g, c or t
  misc_feature 162: m=a or c
aaaaaccggagcctcgggccgggctgcgtgagggaggagggttcatcatgcctagtggcgtataagaagaccccgccaccggtccctccacgcaccacttcaaagccgttcatctcagtcacagtccardagccrtwactgagntctgcccaggacacctamctggacagccaggaccacaagagcgaggtgactagccagtcgggcctgagcaactcgtcggacagcctggacagcagtacccgaccgcccagcgtgacacggggtggagtcgccccagcccctgaggccccagagccacccccaaac

SEQ ID NO: 29528 - DNA, 205 bp, Homo sapiens
tttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccaaat

SEQ ID NO: 29529 - DNA, 182 bp, Homo sapiens
  misc_feature 124: r=a or g
  misc_feature 134: r=a or g
acagggggaaaaaaggaaagagagttgcatctaccctggaagcagaatttgttttccatttaccctcaaattcaaatgagtcacaatcatagtcataggtctagtccactaccaaagccctgartgctgtcaaragaaagcatctatctccaccctcctttgtcaaccttcatcaaagggtc

SEQ ID NO: 29530 - DNA, 189 bp, Homo sapiens
  misc_feature 13: k=g or t
  misc_feature 115: r=a or g
  misc_feature 126: r=a or g
  misc_feature 130: r=a or g
  misc_feature 133: k=g or t
  misc_feature 134: k=g or t
  misc_feature 142: r=a or g
ttttagggttgakggaggcactattgttgtttgcattttactgatggggaattaagcacagagaggttaagtgacttgtggatcgtcacacagcaggtaaccagtagaggtgaarttttaacccarggcrgtkkttctccaragtcgttggtcttgggaaaatggctaacggttcacgttacacctcaa

SEQ ID NO: 29531 - DNA, 279 bp, Homo sapiens
  misc_feature 121: s=g or c
  misc_feature 123: y=c or t
  misc_feature 127: w=a or t
  misc_feature 134: y=c or t
  misc_feature 135: w=a or t
tggatagtatttttgaactaccactgacatgatttttaagagtacgtgtgcctttagtgatgttttaaaccatgaaattgtgcagtgaaaagatttatagaagttatgcaatctaatcaascyttawttttcaywattgggaagcagaggtcatagcagttaagaagcattgtggagttattcagctagtcagtgtttgggtcagtacctcctctgtgcactttactatgctatggtgtctgccacagtatatctagtttctgatatatagcacaatct

SEQ ID NO: 29532 - DNA, 166 bp, Homo sapiens
  misc_feature 50: k=g or t
  misc_feature 51: k=g or t
  misc_feature 121: s=g or c
  misc_feature 132: d=a or g or t
  misc_feature 134: r=a or g
  misc_feature 139: w=a or t
  misc_feature 140: w=a or t
  misc_feature 147: y=c or t
  misc_feature 148: w=a or t
  misc_feature 158: m=a or c
gtcattgttttatcagtgctaatgtgtgcaagcagtttttttattttgckkttctcctggcatcagaaagtggtggcgttttctgtactggattgcaccaaggaagcttttggggaggaasgaaggacattdarattcwwtcctggywaatgaaaagmagcccata

SEQ ID NO: 29533 - DNA, 181 bp, Homo sapiens
aaggtctgatatgttggccccttctatggaaacaacgctgccaaatcctggagcaaaacctgaagtgtcttcatgtgcattctctggcaggccacagtccttctgagcttgtaagatggtgcagcatgcagaccagacttgtccccaaggtctcagcgctgcggtctcactcctccccttc

SEQ ID NO: 29534 - DNA, 127 bp, Homo sapiens
tacaaaaaatcagcctggcatggtggtgcgtgcctgtagtcccagctactcagggctgaggcaggagaattgcttgaacccggcaggcagaggttgcagtgagccgagatcgccctgctgcactcca

SEQ ID NO: 29535 - DNA, 167 bp, Homo sapiens
  misc_feature 125: y=c or t
  misc_feature 127: m=a or c
  misc_feature 129: m=a or c
  misc_feature 131: k=g or t
atggagtctcactcttgtcccccagcctggagtgcaatggcacgatctcggcttactgcaacctccgcctcccgggttcaggcaattctcctgcctcagcctcccgggactacaggtatgcaatyamcmakgcttgtctaatttttttatttttagtagagatggcg

SEQ ID NO: 29536 - DNA, 109 bp, Homo sapiens
cttctgtgcccaacctcaagaagacgaatgcccaggcggcacccaagccccgcaaagcgcccagcacgtcccactctggcttcccgccggtggcaaatggaccccgaca

SEQ ID NO: 29537 - DNA, 329 bp, Homo sapiens
  misc_feature 316: n=a, g, c or t
  misc_feature 317: k=g or t
caaagtaataatagtgtctacctcataaggttattgtgaagaataaataagctatcaggcatgtaaagtgctgagtacaattcctggacctaggaaatggtccataaagagcacttatattgataaatgatccttgtgggaaagtcctgttacgtctctgagtctcactcactatcttcatcagtaaatggagataaaaactatatgtcagggagaatcaaataaaaggatatatatatatgctttgaaaaaggaattttgtaagactgcattatattaaaatgcatagtataaataggacttttccccttgtttnktcacttctccct

SEQ ID NO: 29538 - DNA, 114 bp, Homo sapiens
acccatcgcctttgccaccctcgaacgggcaaaagaaagaaagaggcagccaccctcgcccccgccaaaacaaacagacaaaaaactgtcattctcatatgaccacggactcgg

SEQ ID NO: 29539 - DNA, 145 bp, Homo sapiens
ttgtttgtttggttgttttttgttttttggttttttttaatgacaatgaagtgacactttgacatttcctaccttttgaggacttgatccttctccaggaagaaggtgctttctgcttactgacttaggcaatacaccaaggaac

SEQ ID NO: 29540 - DNA, 145 bp, Homo sapiens
tagatgatagagacagatgggaagggaaggggaccagctgttaggaccaacaaaaataaaggcctgagacatgccggagaggagagggaagcgcaaaaacaaaatgagagaacagagccagcaaagtgagctcaaggaaggtccc

SEQ ID NO: 29541 - DNA, 258 bp, Homo sapiens
ataacggtgtaaaggaggaagggatggaacactgccgagtgtatctgagtatattttgtataactgtgagtcttggagccatagtaatgtttctcatgccccccaaaataattaaagtcaaccaggaataatgaggagagttcaaaatgaaatacaaacagtaacaaatgaacttaactgtatttcagatgcataatacaaccacattgaaggaggtgggcaagaaaaataagaagttatagcattttgatgggaaat

SEQ ID NO: 29542 - DNA, 421 bp, Homo sapiens
gttgagcagactatttttagttaataaattagttaacatgcctttagaattggcatgtagagttggcagttctttcagaatggaaagtatacataataagatgagaggtgctgggaatgacattttaaaatatgtcaaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttggcaaagatacccgtcaatagtcaaccagtgtccatggcagagaatggtaactgtgagatgaagcagaatgctgccaaagctggaatggacagaagaactagagttacagtgtgttaga

SEQ ID NO: 29543 - DNA, 177 bp, Homo sapiens
tctactcttgtcagtactcacttcctacatataaatcagatgtcattcttcagatcaagaaacaaccttcagtgggcttcacttgccgtagtctgccagcaataatttcttgttacttgactatgtgtgtgtcccataatccagacaagctgaataacatttgtttcacctctccct

SEQ ID NO: 29544 - DNA, 113 bp, Homo sapiens
tatattacagctgtaagatttacaactgtattttttggaggttgggttactgcttacaccttgctgttcttgcaaatatcatttcaagggcagacttttaaaactgttttttt

SEQ ID NO: 29545 - DNA, 189 bp, Homo sapiens
  misc_feature 135: r=a or g
  misc_feature 159: n=a, g, c or t
ccccctttggccccctaccctgcagcaagggtagcgtgacgtaatgcaacctcagcatgtcagcagcaatataaaggagaatgaggcggcgcgcctcccagacgcagagtagattgtgattggctcgggctgcgraacctcggaaacccgaatgtgagnaccttaagggatccacagctgccgccaccc

SEQ ID NO: 29546 - DNA, 200 bp, Homo sapiens
  misc_feature 127: y=c or t
  misc_feature 140: r=a or g
actttacatatataattccatttagtctctgttagttagctctgcaaagcagatgccattccatctcacaaagaaaccaaagtttacacaaatgtgcccttaaaaaagaaataccccacaaaaagcyaaccaaaagtagrattcaaacccagttgttaatcacattaaagcctgtgctttaattcactctaccatgacag

SEQ ID NO: 29547 - DNA, 312 bp, Homo sapiens
  misc_feature 134: r=a or g
agaatatggtcccattatctcccagctgcctaagcaatccataagggcctgttctgcgtggatgatcagtgtagtggaagcagggacttgctgagagctgaaatctctgtttgatttgctgtaacattgtaaargcgaaactgggacattttactttacagtctatgattccacactgcatggcccgatttttattcaagaaccaagtcctgtaatgttccctttggattctgaggagaaaaaagtgaagctcaattgtgaagttaaaggaaatccaaaacctcatatcaggtggaagttaaatggaagcac

SEQ ID NO: 29548 - DNA, 274 bp, Homo sapiens
atattgcagtccccagatccagaacatgggaagttagggaaaatgtgtgattttgtgttttgaattactgtcagaattacatacacaattacaacaaactttttttaaaagacatttcattgtactgcaaaaaatctgaatatttatatttcttgtttttttctttatatgttttgcattttaatatgttgagccactggaaatttgtaacagattaatttgttataggagtttaaatgtgttgtcattgtctccattgtctttgtccagagcc

SEQ ID NO: 29549 - DNA, 221 bp, Homo sapiens
ccttcctccacaaaggggtcctggaggtgcacgttctcgcagccttccatagcttgccccaattcaacaggcaattcaaaaacctaggtgctgttgaaaggaacgcctccctaagcctgatgtccctgggaatggacacagctggtcgccgtctatcctaccttggcctgcaggggccggggccctcctagaggcgtccccgcccccatccactccgaaag

SEQ ID NO: 29550 - DNA, 108 bp, Homo sapiens
  misc_feature 4: k=g or t
  misc_feature 7: k=g or t
  misc_feature 18: k=g or t
  misc_feature 38: k=g or t
agckgckaattcagcgckctaggtgtacagtgtctccktcccttggctcctagcaatgtagggaacttgaggttcttcagtatcttcagagattccttccaggccatt

SEQ ID NO: 29551 - DNA, 82 bp, Homo sapiens
  misc_feature 7: r=a or g
aggctgrggctcgaagcggggaccctcgccccgtcctcggctgtccagtcctcctcctcgcagaccccggcggttcctaccc

SEQ ID NO: 29552 - DNA, 257 bp, Homo sapiens
caaaaactctttgtttaattaagtcccagctatttatctttgtttttattgcatttgcttttgggttcttggtcatgaaatccttgcataagccaatgcccagaagggattttccaatgttatcatcgagaaatttttatagtttcaggtctcacatttaagtccttgatccatcttgagttgatttttctataaggtgagatatgaggatccagtttcattctcttacatgtggcttgccaattatcccagcattg

SEQ ID NO: 29553 - DNA, 211 bp, Homo sapiens
  misc_feature 136: m=a or c
tgtaattcctaatgttgagggagggacctgatggaaaatgattggatcataggggcaaatttcccccatgctgtactcatgatagtaagttctcatgaaatctgattgttcgaaaatgtgtggcatttctcccccmaccttctgccaccacgtgaagaaggtgcttacttctccttcaccttctgccatgattttaagtttcccgagcacc

SEQ ID NO: 29554 - DNA, 441 bp, Homo sapiens
  misc_feature 274: k=g or t
tgttcagagaagataacgatagtacctaaagctccacaggcacccagagcagttggctgtgctcactgtggatttcacattggtgggtagttacagcagggagcgtgcacgctgtcaggacgatggccctcggtcgtttcagagaccctttgggtgtttgatggaccttgtctgtaactgctactaggcatccttacgggttctagatctgcataatttgaaagataaggatgttttcaactatgagtacaataaattgaaaccaaaaacttgktaatcaataggaagttcagtcctttttcaaaatcaaactgctttctcctggtaccttatttgcccctttcctcccagccactcagtggtgaacttgttcctcattatattgagctgtttttagaacttgttctcatattgctttgttactactttgtttaaaagtga

SEQ ID NO: 29555 - DNA, 362 bp, Homo sapiens
tcaaggtatcaggcaaggccatgatctctctgaaggctctcggggagaatctagttcatgcctttctcttcctttctggtgtggtcagcaatccttgatattccttggattatagattcatgcctcaaatctctgcctacgtcatcacatcacattctccctctgtgtctgtgtctcctaaggacaacagtcatactagattaggacccaccctaacctagcgtgacttcatctgaacttcctgacatctgcaacgagcaaatttccaaacaggatcactttaacaggtatcaagggttgagacttcaatgtacctttttggtgaacacaatttcacccacaacccttgtcccctcccgcat

SEQ ID NO: 29556 - DNA, 275 bp, Homo sapiens
ttcattcttaacagactggattatggacagaacttggaaatattgagaataatttcttaaagccacttcatataggacttaatatgtcaaaagcacattatgaagcagaaattaaaaatagccaagaagggcccagaaatctaaagatctttgttctataactgtaagtggagaagagatccctaatatgcctcctgaaatgcagcttaaggtcctgcattcagctcttttcacatttgatttgattgaaagtgttctagctcgagtggaagaac

SEQ ID NO: 29557 - DNA, 228 bp, Homo sapiens
ggagtccgcgtaggaggggtcggaggtcttacccaacagattgacgcggcgttagtattggccgtgtacccgaaaaactgattgactgggctggcgttaactgtgcggaggcaggttggagtgcgatgacacaatctcagttcactgcaacctccgcctcccgggttcaagcgattctcatgcctcagcttctcaagtagctgggattacaggatttccctggggaag

SEQ ID NO: 29558 - DNA, 107 bp, Homo sapiens
  misc_feature 62: r=a or g
  misc_feature 63: w=a or t
atctttgcccagactaatgtaatggagcatttcccctatgttttcttctaatagttacacarwttcaggtcttatatttaaatctttaatctgttttgagttgattt

SEQ ID NO: 29559 - DNA, 101 bp, Homo sapiens
  misc_feature 12: m=a or c
  misc_feature 15: r=a or g
  misc_feature 16: w=a or t
  misc_feature 18: r=a or g
  misc_feature 56: m=a or c
  misc_feature 66: r=a or g
  misc_feature 70: r=a or g
  misc_feature 80: r=a or g
  misc_feature 98: m=a or c
atcagggtcgtmagrwartcagcctcagtttgcctttacttgcctaaggtcattamaggggcccaraatragagggaccrtcagatgatttccttgamagt

SEQ ID NO: 29560 - DNA, 216 bp, Homo sapiens
  misc_feature 179: s=g or c
ggaaaacctttttgaggacacatctacagataataattgctgtaagccaactgatagctgatgtagcactaagcggaggatcaagatttcaggagtctttattcattatcaataattttgcaaatagtgacagacctatgaaggcaactgcctttcccgcagaagtcaaagacttgacsaagagaatccgcactgttcttatggccactgcccaac

SEQ ID NO: 29561 - DNA, 98 bp, Homo sapiens
  misc_feature 13: m=a or c
  misc_feature 21: m=a or c
  misc_feature 54: y=c or t
  misc_feature 58: y=c or t
  misc_feature 62: y=c or t
ttagaccaggtgmggtgcagmggtggttgctgcttccagtttcccttcagactyagcygtgygaaccccactcctatcctttggccttagttttccca

SEQ ID NO: 29562 - DNA, 236 bp, Homo sapiens
  misc_feature 148: m=a or c
caaatccgaggcaatatttaatgaggaagcctcactcatatcaagttaagaatgaatttcatacaatgtttccactgtatttggtaaactagatttacatactaggtataaacatatatactagcaatgtcttattaaatgtaaagamattatatataaggtgaaatacatatacacacacacacacacacatatacgtatgtattcaatcacacacattttcagaaatttcagtt

SEQ ID NO: 29563 - DNA, 142 bp, Homo sapiens
  misc_feature 60: m=a or c
tttaagttctgggatacatgtgcagaacgtgcaggtttgttacataggtatacatgtgcmatggtggtttgctgcacccatcaacccatcatctacattaggtatttctcctaatgctgtcccttccctagtccccccccct

SEQ ID NO: 29564 - DNA, 73 bp, Homo sapiens
  misc_feature 3: m=a or c
  misc_feature 8: m=a or c
  misc_feature 16: n=a, g, c or t
  misc_feature 18: m=a or c
  misc_feature 31: y=c or t
  misc_feature 49: y=c or t
  misc_feature 52: m=a or c
camacaamcaaacaancmaaaaacaggatgyactactattttgatgtcyacmacatctaggaccgccaaaaaa

SEQ ID NO: 29565 - DNA, 193 bp, Homo sapiens
  misc_feature 176: m=a or c
caatagtagtaatttagaaagtgttctctgagaaggcaagacttaataagctgctaactcaattattattcatttataattgtggctatacctttctagtactttatatttaaagtaactttctgtgtacatgctgtatggagaacacagtcaccagattgtaaggtctttatgamcagagagttttttctct

SEQ ID NO: 29566 - DNA, 96 bp, Homo sapiens
  misc_feature 54: m=a or c
  misc_feature 55: y=c or t
  misc_feature 57: k=g or t
  misc_feature 69: m=a or c
aacagactgggggttaatttagccagaaaagggggcgggaagggctgtagggtmytktcaattcgccgmcatgaacgtggtttttgctgtgaagca

SEQ ID NO: 29567 - DNA, 206 bp, Homo sapiens
  misc_feature 125: m=a or c
tttatatattgtggttggcacagtacaggaaaagacaggcaaataagaaaaactgtcaggttcaaacatggagtggtgaagatttgtacttaagtgtaagagcaaattttggtaaaaaagaaagmatgggtttgttgactataatgttatcattttataatgcctgaaaactaaggtttcaggcctaagggactggaaagaatgga

SEQ ID NO: 29568 - DNA, 92 bp, Homo sapiens
  misc_feature 16: k=g or t
  misc_feature 17: y=c or t
  misc_feature 22: k=g or t
  misc_feature 43: w=a or t
  misc_feature 56: k=g or t
  misc_feature 61: y=c or t
agtcttatctctgcakygagckcttgttcatagagcagttgcwtcagaaatatttkacatycatagtaatatggttggttatcaattttctt

SEQ ID NO: 29569 - DNA, 292 bp, Homo sapiens
  misc_feature 125: w=a or t
  misc_feature 145: r=a or g
  misc_feature 146: r=a or g
  misc_feature 151: r=a or g
  misc_feature 153: s=g or c
  misc_feature 156: s=g or c
tacaaaagaaattgtgcagcactcctttccttccacaaggcttgatgtgcccacactgcctccctgcaggacaggcatgggtgccatgtgtgagggtccacaggccaggccccctcttttagccwcaggttttcccagtttcacrrggtgrasgasgaatacgtgtttggaaccagtgacttccgggggccccctccggtggccttaaggtgacatcctcacccacctgggggcctgaggcaagcctgatagcttctacagtcctgcaggcccaaaaagctaaccaagcagc

SEQ ID NO: 29570 - DNA, 150 bp, Homo sapiens
  misc_feature 17: m=a or c
  misc_feature 116: m=a or c
  misc_feature 128: m=a or c
  misc_feature 130: m=a or c
  misc_feature 131: v=a or c or g
  misc_feature 132: m=a or c
  misc_feature 139: m=a or c
  misc_feature 149: y=c or t
taatgaaaattagttgmtttttagttgatttttttgtcccaacattttttttaacctttttgccactcattatatgtttgcagttctaggtctttgacagctgaagaccagaggamtcaaacaggcgmgmvmcacagamtactgacccya

SEQ ID NO: 29571 - DNA, 200 bp, Homo sapiens
  misc_feature 77: y=c or t
  misc_feature 78: k=g or t
  misc_feature 97: w=a or t
  misc_feature 103: h=a or c or t
  misc_feature 122: m=a or c
  misc_feature 163: s=g or c
  misc_feature 164: h=a or c or t
  misc_feature 168: m=a or c
  misc_feature 169: v=a or c or g
  misc_feature 174: y=c or t
  misc_feature 182: m=a or c
  misc_feature 192: h=a or c or t
atcagccccggcgctctctcatcccttctctcttccttggtgcttctttttcctgctcggtgagtttgtttgtttgyktgtttttgagacagagtcwcactthgcttcccaggctggagtgmagtggtgcgatctcagcttactgcagcctccgcttccgggshtcamvcgatyctcctgcmtcagcctgchaagtagct

SEQ ID NO: 29572 - DNA, 301 bp, Homo sapiens
  misc_feature 33: m=a or c
  misc_feature 108: r=a or g
  misc_feature 123: w=a or t
  misc_feature 137: k=g or t
  misc_feature 155: w=a or t
  misc_feature 160: m=a or c
  misc_feature 287: w=a or t
ctttatcgtgctttgcttttttctagtgcttamaactatctgatattggtatgtctgtttatttaattttatgttcccttccgtagaatgtaaattcgctcagagaarggggattggtctgtwctgcactatgtgtkcactgtccaaagcagttwctgcmctataattggggctcagtaaaaatctgtttaataaacagatgaatcaataagtgtacccttctgaaaaactatgttaatgatgatgaaaaccaaaatcaagagtttcagatatttttcctatttgtwacctcatttgagtc

SEQ ID NO: 29573 - DNA, 158 bp, Homo sapiens
  misc_feature 28: s=g or c
cgattcgctggggcgcgtctttcccacsacgaggccaccagggtgactgcgggattccgatctgcgccggagctgcgatgctagagcactcttgccacccccaccccacggacgtgttgcagtgattatcagaattttgcgtgcggtttacccgtggg

SEQ ID NO: 29574 - DNA, 185 bp, Homo sapiens
  misc_feature 166: k=g or t
ttattagattttttgtagaaacagggtttcaccatgttggccaggctggcctggaactcctagcatcatgtgatctgcccacctagcattccaaagtgctgggattacagttgtgagccattgtgcccagctgggttctgcttttttgcatttttacatacatatkatatatgcagactcacaga

SEQ ID NO: 29575 - DNA, 237 bp, Homo sapiens
cagagagaaattaagaagagagaacagaggcaaggtgagagctttcaagagaatctatatttaggggacaactggaagaaataacttagaaaaggagagagtcaaagcaaagctagtaaattttaatgacaagggaagcttagagagcaaagaattccaggagggaggtagtgatgatagcatcaaataatgcacagaggttaaggaaggtgagaactcagagaaacaaggccccgc

SEQ ID NO: 29576 - DNA, 77 bp, Homo sapiens
gctttattttgttctctttataagaaacactttcagaagtgcaatagcaaagattatttgagaaaataatcttataa

SEQ ID NO: 29577 - DNA, 235 bp, Homo sapiens
gaaaactactcttcttacattaagatattcgttcggtttccatgggtaaaagaagtaatctacatgcaatcaacatatttagtgaggagatacatacactaaggaggataactgaaaatttttatttcattaagcaaattgtacttcactcctgtaacaatgtaagtggggaatgaaaattcaggtattcacattcagaatttgatttctttcctttatgaaagaatgcaccagt

SEQ ID NO: 29578 - DNA, 179 bp, Homo sapiens
  misc_feature 10: n=a, g, c or t
  misc_feature 17: y=c or t
  misc_feature 66: y=c or t
  misc_feature 138: r=a or g
tatggtgagnatacagyacataatacatagaatacacaaaatatgtgttcatcaatggtttatgtyatcagtatgacttcctgtcaacagtaggttattagtagttaagtttttggaaaagccaaaagttactgtgtraggggttggcacccataacctccatattgttcaagggtcca

SEQ ID NO: 29579 - DNA, 115 bp, Homo sapiens
cagttcaaaagtctttataactaaattctgaaatacagagtgccctgttgacctcacctggggtctcattcactgtcccaccttccctggaccaggcttccccctccactgtccc

SEQ ID NO: 29580 - DNA, 126 bp, Homo sapiens
acattaaattgaaaataatttcttgtattataaggtgatttggttcctatttgcagttctttcttctttttataaaataggtgctgttttacctagtttcttatgaaaaacatggtttgggccata

SEQ ID NO: 29581 - DNA, 155 bp, Homo sapiens
cctgtggtcccagctacttgggaggctgaggcaggagaattgcttgaacccaggaggcggaggttgcagtgagccgagatcatgccactgcactctagcctgggcaacagagcaagactccatctcaaaaaaaaaatgtaaggaaaagggcagcg

SEQ ID NO: 29582 - DNA, 178 bp, Homo sapiens
agaaatgtttgtctgagtaataattgtcataatcagattttaatctagttcttgcctctccagagaacggttgattaaaattgctggaagtaaatcatagaattattcttcccattcattctttcttaaaatccttttaaaccttttacacagggtcttggatatcaaagagacaagc

SEQ ID NO: 29583 - DNA, 173 bp, Homo sapiens
gaaaataaagaaatgtggtatatgcacacaatgaagtactattgatggatgcttaggttggttccatagcttggctattgcgaatagtgtcacagtgaacacaggactgcagctctcttccccaaactgactttaaatcttttggataaatactcagcagtgggattgctgga

SEQ ID NO: 29584 - DNA, 216 bp, Homo sapiens
tagccgggcatggtggtgcgtgcctgtagtcgcagctacttaggaggctgaggcaggagaattgcttgaacccgggaggcggaggttgctgtgagctgagatcgcgccactgcactccagcctggtcgacgaagtgaatctctgtctcaaaaaaaaaagaaaaaaagaaatatttattttttaagaatattaactattttgtaataaggcatgcac

SEQ ID NO: 29585 - DNA, 391 bp, Homo sapiens
  misc_feature 5: r=a or g
  misc_feature 16: y=c or t
  misc_feature 282: b=c or g or t
  misc_feature 283: d=a or g or t
  misc_feature 297: d=a or g or t
  misc_feature 324: k=g or t
  misc_feature 375: n=a, g, c or t
ctcaraggccttcagyttttcccatgtcctctctcctctcttccctccaatttgcctcctgctgtttatttttgtatcaattatcttcccctccttagtgtttgtgggtacttcaacacttaaataatttcttttgtttgttttcccccttttcctaaactagtttctttttagtattttagtccccagttcttttggatattttttattttagaaaaaatctcatgattgaagtagtctcatttgctttattggtaactttttatattccttatataagtbdttgatgtttaagcdatctttgcagtggtaattttctttttkatcagagcgtagagcccttttccactgtgttagctttaacagtcctaatantttaatttcaacactt

SEQ ID NO: 29586 - DNA, 302 bp, Homo sapiens
caatattcacatgatccaaatactgggataataatgtattacacacacacacacacaaacacgtatgtatgcatgtgtaacatatatgcagatacacattacatagctatatacacatagatggtttgtcttattttgtagaaatatataactttgtataaaaacaatgttttaaattgttggggaaatttcttaatatgtagcaaaagcataaccagcgttcaagtcaagcctgaagttaggaaatctttaattttataaatattcagctcttttataccattgtatgtgtgcccctcccc

SEQ ID NO: 29587 - DNA, 128 bp, Homo sapiens
taaattttaggtatacagtgtagtgatttgatacgtgtatgtattgtgaaaggattgccacaattgaattagtgaatacgtctgtcacctatcagttacctttgtctgtgtgtgatgagaatacctaa

SEQ ID NO: 29588 - DNA, 169 bp, Homo sapiens
caagaattttgttttgtaattcaccaatatcaaaggtgatgtttgatgtgaaagctccctgcaaatgggctttcacaaggtcccacggatactcactttggttgtattctaagttgattacacaaatatgagtgtgattaaaatgacaacgcaattactgctgcaattg

SEQ ID NO: 29589 - DNA, 140 bp, Homo sapiens
tttttaaatagaaacattagctagagcaaggaacttagaaacactcaagcggcactgaatgtgtagaattgcataaccaatatagcttctttgctttcacatttacaattagttggagttttagttcagccgtacccagt

SEQ ID NO: 29590 - DNA, 228 bp, Homo sapiens
actcgtctcattatatactgaagggaaatatcaattatttgtatacattcctatacaactctaagatagttgaaataggaactttcttatttagttgcaacatgaggaaatttgagatgatgttatctgccacccccagatctttccaaaggatttcttctagccttaattatcgacctcacaggacaaacctttgccattccccatctattttttctttcggctccc

SEQ ID NO: 29591 - DNA, 129 bp, Homo sapiens
  misc_feature 10: w=a or t
  misc_feature 57: m=a or c
  misc_feature 98: y=c or t
  misc_feature 126: r=a or g
  misc_feature 128: s=g or c
cttctatggwttattaatgtaataagaataaggtttacaattattaaactatttcamccccgtacgtgtgttgaatggcagtcatcaaaaataatggycttatagtacagcagttttatatagaarasc

SEQ ID NO: 29592 - DNA, 213 bp, Homo sapiens
  misc_feature 10: m=a or c
aaacctaggmagtagctttccaacataaagtggaggtttcaacacaggagactttaagcaagttccagtgtgtctatatttggtctggctgatcggctggactctggccttccccgctcacgttagcagacagctctgccctagtgggcgcttagcctgcgacggcagcccgagaggatgtctaacaagcttctttctccccacccccataac

SEQ ID NO: 29593 - DNA, 205 bp, Homo sapiens
  misc_feature 197: m=a or c
tgttagagaccttagtaacttgcatagcatttagtatgctttgaaaagttacctttatgaataagatatgtcaagtgtctgtcatgtttcttatgagattgacctttgccttcattatatcttacatattttcttttttgtaattttttttttcatatcaacatttctctgactctacataataaaatgttaaagcmcacagctt

SEQ ID NO: 29594 - DNA, 179 bp, Homo sapiens
catggcgcctcccctcggacgtcggtgtcgtggcgcctccccgcggatgtcggtcttgggtgttttgggggagaaaacaagccccatccttcccgcggggtttctgggcttcacgcctgccttgccctctcagacaaaggccaggacttgtgcggcccacactagtgtatcgccctaac

SEQ ID NO: 29595 - DNA, 377 bp, Homo sapiens
  misc_feature 272: n=a, g, c or t
  misc_feature 303: n=a, g, c or t
  misc_feature 304: n=a, g, c or t
  misc_feature 305: k=g or t
  misc_feature 347: w=a or t
  misc_feature 348: n=a, g, c or t
  misc_feature 349: k=g or t
tatttttggtggagatggggtttcgccgtgttggccaggctggtctaactcctgatctcgtgatctgcccacctgggcctcccaaagtgccaagattataggtgtgagctaccatgcctggctgattcttaacagacattaaaatttgagaatctctgtttaggatttattcagaatcctaaggatgaatcctggatgaatatattcttcaaactaacttatttaaataagcctattagtctcttatctgtcatttcatagcacattggganattgacaattcgtgataaccttgggatgatnnkcctcaatgagacaggcccatttcatcctgctagtgattagtwnkctgtattgtgcatcatggtaaagcacat

SEQ ID NO: 29596 - DNA, 106 bp, Homo sapiens
aacaaaataaccaacatacatttgcacccatatcttactaagtaggtcagtgtggtaatatattttctgtgaaaatcatgttataactgtaaggtaatagagggca

SEQ ID NO: 29597 - DNA, 284 bp, Homo sapiens
  misc_feature 267: n=a, g, c or t
  misc_feature 268: r=a or g
attcaggcttgctcaggcaacatgggctttgttgacttgctttctccagaaaggcaattttattcctggtaaggagcaaggctatcctatcatttggaacctaaatcaccttaacggtaaaaacagcaacaacttgtttctctggaatattgataaaggtacgaattactgcaaaagtttttttatattgtaattgaagtgtggttaaagaaattcattgtctgctttgttagcttttgtatactaaatatctcggtaattttggtnrtctcaaagatgtcctc

SEQ ID NO: 29598 - DNA, 114 bp, Homo sapiens
ttagataacatactgatggacaaaattataaaataagaaatgagatcagaaacatagtaatgatgggctatttcagtcgtgacataagtcttactttttttttttttttttttt

SEQ ID NO: 29599 - DNA, 145 bp, Homo sapiens
agaactagaaataccatttgacccagccatcccatttctgggtatatacccaaaggactataaatcatgctgctataaagacacatgtacatgtatgtttattgtggcactattcacaatagcaaagacttggaaccaacccgga

SEQ ID NO: 29600 - DNA, 302 bp, Homo sapiens
  misc_feature 122: s=g or c
  misc_feature 135: n=a, g, c or t
  misc_feature 158: m=a or c
  misc_feature 180: y=c or t
  misc_feature 181: m=a or c
  misc_feature 288: b=c or g or t
agaaaatatttaagatattttgcctcctattggccctgcagaagctggacctcctgaactgtgtgacctacttcagtggtacctcaggttctacatggtgagtatcctggggactggaagastggagatgatcanggcccataggggacctggttaamattgactattttaactattttymagtgtacagttctgtggcattaaatacattcacattgttctgcaaccatcactgtcatccacctccataacttttctatcttcctaaactaaaactctgtactcacbaaatactgacttgc

SEQ ID NO: 29601 - DNA, 292 bp, Homo sapiens
  misc_feature 114: y=c or t
  misc_feature 128: k=g or t
tttttggtagagacggggtttcaccattcacagggtggtctcgatctcctgacctcatgatccgcccgccttggcctcccaaagtgctgggattataggcgtgagtcaccgcgyccggccaaagttckgtttcttgacctgggtagttgtgacaaagacatttgccttataatcataattaactaatctctacatttgtttgggtctggttttctgtttcatcttaaaacaaaaagataaataataaataatgcatacataaatccaaggaaaaaagttaatggggcatcaa

SEQ ID NO: 29602 - DNA, 165 bp, Homo sapiens
acatgactgcgttcactttttgagcttataaatgaagcccgagtgcctgccaaaacctgctgcagtcagcccacgagcagagcagcgtgaggagctgattctcagttttcccggcaaaaggagcaatactgctctgccgtggttccgtgttgtcatctgtgccgc

SEQ ID NO: 29603 - DNA, 110 bp, Homo sapiens
tgcacgttttaactattatatgttcttggcttaactttttttgtaaagttaagacattacacttttacatgaatctgtaatttcaagatatcttaatggttgacagggtg

SEQ ID NO: 29604 - DNA, 58 bp, Homo sapiens
ttgacttttcctagcagcgtgatcatgggcaagtggcttttttttttttttttttttt

SEQ ID NO: 29605 - DNA, 206 bp, Homo sapiens
  misc_feature 120: w=a or t
  misc_feature 132: k=g or t
tttcttaattttatgctctttagacgtttaaaagaaccaaaaaagaaacttttgcttcttcgttttcggttgggatttgcagtttaatggcctcagatccttctccagatccccagggtwtctttgtcttakttatggagaaaaaccggtcactttgtccagcgcactgtgaggcccccactcaggccagccctggccccccccta

SEQ ID NO: 29606 - DNA, 236 bp, Homo sapiens
cattcccaataaaactcagcttgagcccatgagttcaaaactagcccgggcaacatagtgggaccctgtctttacaaaaaatcaaaaaattagctaggctcggtggtgcgcacctgtagtctcagctacttgagaggctgaggtgggaagatcccttgagcctgggaggttgaggctgcagtgagttgtgattgtgccactgcactccagcctgagcgacaaaggaagacgctcga

SEQ ID NO: 29607 - DNA, 157 bp, Homo sapiens
aggtgcacacctccacgcctggctaattttttgtattttagtacagacagggattcatcatgttgcccaggctggtcttgaactcctgagctcaggcagtccacctgcctcggcctcccaaagtgttgggattgcaggcatgatccaccacgcccac

SEQ ID NO: 29608 - DNA, 117 bp, Homo sapiens
  misc_feature 65: w=a or t
  misc_feature 100: m=a or c
tgagttttttcttttacacaaaaaagactcaaatactttttcaaagctaataatccatggtgtawaacacgtcttttaacatattatactctgcattgcmatgattaaattgttttc

SEQ ID NO: 29609 - DNA, 272 bp, Homo sapiens
tctgtgaacatgtaatgtaactggcttttgagggtctcccaaggggtgagtggacgtgttggaagagagaagcaccatggtccagccatcaggctccctgtgtcccttccattgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaat

SEQ ID NO: 29610 - DNA, 170 bp, Homo sapiens
tgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatgcg

SEQ ID NO: 29611 - DNA, 389 bp, Homo sapiens
  misc_feature 115: r=a or g
  misc_feature 144: n=a, g, c or t
  misc_feature 331: w=a or t
  misc_feature 332: y=c or t
  misc_feature 333: n=a, g, c or t
  misc_feature 369: n=a, g, c or t
tactcttgtacatatgttgtgggtttaagagtcttttgcatttgttctgtgacacctttttttgaattgactgttttaaaacggaggcctattttttccggtttgggactcctartggttatggcatcccataatgcttcgtgncggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagwyngcatgccagcgcacggcctaattgctgtgaaacagngagaaggtaaagctacctga

SEQ ID NO: 29612 - DNA, 87 bp, Homo sapiens
caggttttatttcgtctcaatttcctggtagtggtgttatgtatagtaatggatcgaccttatcaattctattactttgtccccctc

SEQ ID NO: 29613 - DNA, 238 bp, Homo sapiens
taaggaaaccaggtgtgggcggctgggccttgcagctaacccttaaccctctggcaacccgcagatagccccaactggccccaacagttccctggggtcccttttggatggggccaaggtggagctgctagaaagattcctttggggagatggtcagaaatacttcagttatttattattttgttatttttattttttgctgttgcctcctggaaacggacttgaagtttcctccccc

SEQ ID NO: 29614 - DNA, 304 bp, Homo sapiens
  misc_feature 141: r=a or g
  misc_feature 156: w=a or t
gtggatgggtccctgagactttgcgaagtaggagccctgtgtgatagtgcgtcagagtcgggcctgagagcagtcctggccagggctttaacaggatggtctccggagcctgggattctcggagggctgaccaccaggaaraaaacctcagaaggwagaaacctcaggcggatcgccgggcggcagcgcgagatcccagcctcaggcccggattcgggaagggtcgacgaagcccttttcccaatcttcacttcacccgccgccgccccagtccccgcagccgccgctccgcggtcatttttct

SEQ ID NO: 29615 - DNA, 191 bp, Homo sapiens
aagagagagagcagaaaagaagaaacgggcaactaaaactccaatggtaaaattttcagcattttcctaacttttaggtagatcccatttttttacataattaaaatgcctatattatgtttaatgccatagtgatagctattaataaaagctggttttatgaaatgctaatttgttttggacagaagagc

SEQ ID NO: 29616 - DNA, 207 bp, Homo sapiens
  misc_feature 131: k=g or t
acaacacttagagtggtgatttcttagtggtaggaatttaagagttacttttgttttcttttttgaggttttctagtttccttattataataaacatacattacttttgtaatcagaaaaaaagtattttktaagtagagatgtatgtaccttgaaaaaaagcaagatcttaaatgattgtgtatctgacatgaaagtccttcctca

SEQ ID NO: 29617 - DNA, 364 bp, Homo sapiens
  misc_feature 174: n=a, g, c or t
tgattatcacgttcctgtaaatacacaaaaatattttgtggtcttttactggcagcccagtggatgggactttaaaaaatcacccagattccaacaaccagagaaaacgactggtgtatattttttccagtctttatttgtatgtctgtgtatattcaatggaaaatgtttgangcttcactcacagcacattccattagagaaagctactaaaatcataaggaaaatctaaaatgcagtaagccagtcagcaagccataatgggcatatgaaaacaaagttttttgccatgatttgtggaccacagaagatctgtgttattagtctatttaagtttggtgtttgaaattaaaaatgttcgaca

SEQ ID NO: 29618 - DNA, 191 bp, Homo sapiens
  misc_feature 110: m=a or c
caaataagttgatgaaaggggactggtttagcacaagccatccacattaattcaaacctgtggctctgaagtttgttttttaaatgaccacaagtgtaagactgaatgamagaataaatgcgtgcattccataggatgcaagaaaaggagtgaggaatgggaaaattggaagaacgagagggggagagata

SEQ ID NO: 29619 - DNA, 107 bp, Homo sapiens
  misc_feature 61: m=a or c
  misc_feature 80: m=a or c
agggctgctgtccagtgctgctttattggcagtgctgccagggtctccgttagctctctgmaaattgccttcctttctgmtcctcctactccctccttcccccgtaa

SEQ ID NO: 29620 - DNA, 198 bp, Homo sapiens
  misc_feature 132: y=c or t
  misc_feature 148: w=a or t
caccttgccattgatagagattatatcccaaagccctctaaccatctaatcctgcctggtgtagtcactgactcctggcccctttgatccctgttctaattccttgaatctgtaatactgaccttctacccyccctctccccttacawattaaaaccgtgattccttaaagctttgacacttaccacctcccatgcca

SEQ ID NO: 29621 - DNA, 94 bp, Homo sapiens
aagcaaaaatgacaaaatttactgtggcactaaatgcacatagacatatatttaatatgattctgttacaaacagtgggaaagggggagcagga

SEQ ID NO: 29622 - DNA, 59 bp, Homo sapiens
actccccctctgtctctccaaggaaaactaggcccctgcgcggccaacgcccaggatcc

SEQ ID NO: 29623 - DNA, 355 bp, Homo sapiens
  misc_feature 242: n=a, g, c or t
  misc_feature 243: n=a, g, c or t
taggaaatgaggtggctaggatattacccagctggtgggtgacttgggcagtgtgttcctgctttcagtggttagcctttagcaaatctgctttagagtgagagtagagggcaggctgttgtattacagtgctcttgtttttgtaaaatttaattcactctactgttattttgtctccttgggtaaagtgttatttaatttttcttcattttttagtaatatataacagtcagtgagagaanntggttttcagagatgtcatccaaagcagattttacagttgtttcctggttataaattgtctcaacaattctcttttagtcatttagattgtttaatatgggaaaaccggggt

SEQ ID NO: 29624 - DNA, 264 bp, Homo sapiens
ggagtaaattaaggaatgattgaattttgtgggtcttgatggaaaaacgctggtcttcttttaatgtggaaaaacagctagtgcttcagtcctaggaattatgtctctgctgtgggcagttgtcataaactcttctcacaatccgagctgctctttgtcctctgtgaatgaaggtacttttgcttccatttcatccaaggatgaatgaaaatgtatagcatctgcccaaacctaaaaagtacagtgtgtttatcacgagagcat

SEQ ID NO: 29625 - DNA, 119 bp, Homo sapiens
  misc_feature 113: r=a or g
  misc_feature 116: r=a or g
agagatagagcttcgcggagacggcggaagcggagagcaacagcgcgccgagacttccagtgtcctactattgaagcctgcacctgctgcattgctgttttcctgagacggartarggg

SEQ ID NO: 29626 - DNA, 144 bp, Homo sapiens
tattgctatcctcatcaatctcccattgactttcttcacagaattagaaaaaactactttaaatttcatatggaatgaaaaaagagcctgtatagccaagacaatcctaagcaaaaagaacaaagctggaggcatcacgctact

SEQ ID NO: 29627 - DNA, 111 bp, Homo sapiens
cctctagatcatgttatattctatatcagacaaactattttcttttgacctttcttcccctccatccagtatttcggttgatttcattttctcccctctcttccccttcca

SEQ ID NO: 29628 - DNA, 230 bp, Homo sapiens
  misc_feature 100: w=a or t
  misc_feature 105: r=a or g
  misc_feature 123: m=a or c
  misc_feature 150: w=a or t
taacatcacagttaaaagaactggaaaagcaagagcaaacacattcaaaagctagcagaaggcaagaaataactaaaatcagagcagaactgaaggaaawagagrcacattaaaaaacccttmaaaaaattaatgaatccaggagctggwtttttgaaaggatcaacaaaattgatagaccactagcaagactaataaagaagaaaagagagaagaatcaaatagacgcc

SEQ ID NO: 29629 - DNA, 206 bp, Homo sapiens
  misc_feature 118: m=a or c
ccaatccaagtaccaatgagaagagcagtgagaagacggacaactgtgaaaagatcccaagacccttgtctttgattggctcaactcttcgatttgacaagttagatcaaagcagaamcaggagtctcctgatgtgttttcttcacattatgaaaacgatttcgtacgagactctgattgcctactggcagagagctcccagccca

SEQ ID NO: 29630 - DNA, 276 bp, Homo sapiens
  misc_feature 112: s=g or c
agcacggcgggaaccggcagccggagcagtcccggagcagaagcagcagcagcagcagcagccctcgccgttcgcggaggcagccgagccggccatggcgttgtcgatgccsctgaatgggctgaaggaggaggacaaagagcccctcatcgagctcttcgtcaaggctggcaaggtgatggtgaaagcataggaaactgccccttttcccagaggctcttcatgattctttggctcaaaggagttgtatttagtgtgacgactgttgacctgaaa

SEQ ID NO: 29631 - DNA, 121 bp, Homo sapiens
  misc_feature 116: m=a or c
tacatcagtgtttgccaaatgttgtgttcctagtgttgaggcaagtagtctttgtactgggtaacattttggaggtgtgatgcaaaaatgcatttgtggacctaattcttaccgamccgca

SEQ ID NO: 29632 - DNA, 136 bp, Homo sapiens
acagctaataagtatgtgtgtagcgtggatattgccttgagattaaggagcctaacgcatccactgttaacaccatggctggtgtcctaactgcctcagaagagtccacattcaatactgacaatgacaagctaaa

SEQ ID NO: 29633 - DNA, 274 bp, Homo sapiens
  misc_feature 128: m=a or c
  misc_feature 129: s=g or c
  misc_feature 271: m=a or c
  misc_feature 272: n=a, g, c or t
  misc_feature 273: n=a, g, c or t
  misc_feature 274: s=g or c
cattttctcaatttttttaacctcgaaaactttttcctccctgagagaaatacatgggctatcttcagcatagaacacaaactctgccttcttttctcaagtccagtgattcaagtttgacacaccamsaccacggtggatgtgccttgtcatgacacatcttctcagcagcactagaagatacatccaaagtcctgtgagcaaggcttgggccttgttgtggactaagtgtctgtggctccccacaaaatgtatatattgaagccccacmnns

SEQ ID NO: 29634 - DNA, 77 bp, Homo sapiens
attgggaatgatagcagtctggtgaagattaagtgtatatagagagtgctaatatctccaaacttgcctctttctcc

SEQ ID NO: 29635 - DNA, 352 bp, Homo sapiens
  misc_feature 287: y=c or t
atgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtccycagaaaaaggaaccatcaaaggcagaaacagaagaaagagtttccatggtaaaaactcgggccgt

SEQ ID NO: 29636 - DNA, 156 bp, Homo sapiens
attataagaaacttcacctgtcttcatgtattaaataagatgaagtaaaaatgtaacctggtgtgaatgctaatgtcacattaataatgccattagttatattctctccccaccgtcatcttgaatgtctcagtgacacaataacatgggccccaa

SEQ ID NO: 29637 - DNA, 253 bp, Homo sapiens
  misc_feature 164: n=a, g, c or t
tttcttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcgggggcatcntgggctctctccagagttcttccattcgtctgcttcctgtctcggcagcccggccccggctccacggggtgtctcaccctccccaccgc

SEQ ID NO: 29638 - DNA, 198 bp, Homo sapiens
  misc_feature 112: m=a or c
gcctgcacgtacgtagccttcacgtgtgtgtggatacggagtgcatgtgtggagacagaggaatatgctccaacaaatttcggatagaggcgccgaagacaggacgtggggmaagctaaagaagtaaacaggtcatggcacgtttaacaaaaagacgacaggcggatacaaaagctatccagcatctttgggcagtcc

SEQ ID NO: 29639 - DNA, 436 bp, Homo sapiens
  misc_feature 436: r=a or g
tcccttatgttttattttagtagttgtattgttttaggtctcacatttaagtctttaattcatcttgagttggttttcggatatagcaagagaaaggagtccagtttgttcttctgcatgtggatatccaattttctcagcaccatttattgaagagggtatcctttccacaatgtatgttcttgatgcctttatcaaaaatcagttggctataaacacattgatttatttctgtattttccattctgttccattggtctatatgcctgtttttatacaaataccatcctgttttggttactatagctttgcaatatattttcaaaaagaataaagatgcaggcatcatactacctgacttgagtaaggtagtagtgggaggcctccagctttgttctttttgctcaggatttctttggctatgcagggctggggr

SEQ ID NO: 29640 - DNA, 258 bp, Homo sapiens
ttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccccc

SEQ ID NO: 29641 - DNA, 124 bp, Homo sapiens
gaatgcatgctaggatcttgcaaccgccataatcataaatatcaatttttaccatattgacacagctcaaaattgctagtagagaggaacttctgattgatggactaccaaatacgtaggctaa

SEQ ID NO: 29642 - DNA, 361 bp, Homo sapiens
  misc_feature 113: w=a or t
  misc_feature 147: r=a or g
  misc_feature 213: r=a or g
  misc_feature 218: w=a or t
  misc_feature 281: v=a or c or g
  misc_feature 296: m=a or c
  misc_feature 297: w=a or t
  misc_feature 309: s=g or c
tgtgattagcaagatattaatcatcagtaacagttgcagcaaaagctggttaccagcaatccttagaaacaggacgtgaagccagacaaccagttagaccagaaattctcagwagggagtatgctttaaccctaaagaggcctagartagctgtggcaagatgaggacatttatagccctatcttatccatatggacaggtgcccttcatgartccgwttataagctctccacaagggtcacattccattcccagagctgtgaacatctgcttttctgggvtaggaaccttggtgmwatgaaacctccsctgactgcatgtccatttataggttgtctgcaaggggaagcacatcacacgc

SEQ ID NO: 29643 - DNA, 296 bp, Homo sapiens
ttttaattttattaagctgtttttaagagtaaaaaatattccattgaaaccttactttatttattttaatctagcctcctttaatattgacagcatgcaaggctatacattttcctctaaggacagctttggataccacccttaaattctgatgtgaaatgtcatttcttttccaatcaggagagtatgcttttttaggaacgtgtatcaagatctcctgaaggatttttcagaccacataagcaatccctgaaagtctgatctttccctgcaccatccccccatcccagggcccc

SEQ ID NO: 29644 - DNA, 117 bp, Homo sapiens
  misc_feature 82: w=a or t
atatctacaaagccagatgctctgtcttcatatttgcagacatctagaccccttgctaaaaacccactgaagtttttttttwatgttctttgacccacaccatcaacactaccctct

SEQ ID NO: 29645 - DNA, 115 bp, Homo sapiens
catcttaaaagtagcaaatcctaggtcaccattacagacggtggtctaggtgaacattgagaaagccatctcacttcccaggcctcagtttcctcatcggtaaaatgaaagaagg

SEQ ID NO: 29646 - DNA, 95 bp, Homo sapiens
atataaatgacgctgctataaagacacacgcacacatatgtttatcgcggcagtactcacaatagtgctgcaataaacttatgtgtgcatgtgcg

SEQ ID NO: 29647 - DNA, 298 bp, Homo sapiens
  misc_feature 12: y=c or t
  misc_feature 254: m=a or c
cactaaagttgygttactctgaaaaagatatccacgttttgaaatgtgctaaacaacacaaaggcatttgttttacaaagccatgttttcaaaattataactaaatttagaatttatgaattatactttattttggtacataataggcactcaaattctttcggagtttttaatgtataacttacatacaataaaatgtattcatttaaagtgtacagtctgatgagttttgacaaatgtatatacttgtttamcctccactccagtctagacacagaatagttccattgccccaaac

SEQ ID NO: 29648 - DNA, 287 bp, Homo sapiens
  misc_feature 12: m=a or c
  misc_feature 107: w=a or t
  misc_feature 108: r=a or g
  misc_feature 110: r=a or g
  misc_feature 258: m=a or c
tgacaattaggmaggcaaggtcagaagcagggagactaattagaggtgacttttccagtaatccaggcatgagatgatggtggcttggaataaggtgggaagttgcwrgrttctggatatattctaagatggagacaacagaatttcctgagggactggatgtggaatgtgagagaaagaggagttaaagatgattctgagatttttgttctgaacagccagaatgatggagttgtcattaactgaggtggaaaaggmtgtgggaagggctagttctgatggggagg

SEQ ID NO: 29649 - DNA, 136 bp, Homo sapiens
  misc_feature 12: y=c or t
  misc_feature 13: y=c or t
  misc_feature 126: s=g or c
  misc_feature 127: h=a or c or t
atgatgagcatyyagcacaatttgagactgaaatttagtacactatgttctaggtcagtctaacagtttgcctgctgtatttatagtaaccattttcctttggactgttcaagcaaaaaaggtaashaactgcttc

SEQ ID NO: 29650 - DNA, 105 bp, Homo sapiens
  misc_feature 13: h=a or c or t
  misc_feature 14: r=a or g
  misc_feature 46: s=g or c
  misc_feature 47: k=g or t
  misc_feature 105: s=g or c
gaggaggaggaghrgcgcgagcagcaggagaggcgcgagcagcaaskaaggcgggagcaagaggagaggcgcgagcagcggctgaagcgccaggaggaggaatts

SEQ ID NO: 29651 - DNA, 190 bp, Homo sapiens
  misc_feature 10: n=a, g, c or t
attgggaaanatttttgtgttttatgtaagacagaggagaagtgctaaggacatagaaggaaagacagcataaggccatcacagttgttcaccatcttgtcaatatgtacaggtgcagctaccattgtatcacggaaatgacagaatgatgttcttactgtgttggaaagtagtgtattctgcatgggga

SEQ ID NO: 29652 - DNA, 412 bp, Homo sapiens
  misc_feature 11: n=a, g, c or t
  misc_feature 12: s=g or c
  misc_feature 222: n=a, g, c or t
  misc_feature 223: m=a or c
taaagtttgtnsaaaatacaaaattttcatagtctccaagtatttctcctaagatctttccccctatgagggggaaagatagtaactttacgatggagaaacccagcagaaacctgaaccaaatgaacaagttcaacatcatcagtaagaaaaactatcaatgccataactctgatggaatgcactgggaaggattccacatcatttttgagctgtaattgnmaaaagtgcgtaacttcagtccaatcatggaaatacatcagacaaacccaaatcgaagaacatttgacaaatagtgatcagtactggttcaaaatgtcacggttatgaaagataaggaaagattgaggaactgttattgcagtctacaaaacggcgagagactaagaaataactaaatgcagcgtgatcc

SEQ ID NO: 29653 - DNA, 437 bp, Homo sapiens
  misc_feature 246: r=a or g
  misc_feature 332: w=a or t
  misc_feature 334: n=a, g, c or t
  misc_feature 335: m=a or c
  misc_feature 336: n=a, g, c or t
  misc_feature 342: m=a or c
  misc_feature 382: m=a or c
  misc_feature 390: m=a or c
tagtcttggtagaagcattgcatacaggataggcgaacccatatccagagtaagtgtctatttgagtgaggacaatcctctgccctttccatgatggaagaggtccaatataatcaatccgccaccaggtagctggctgatcacccaaggaatggtgacatactgagggcttggtgtcggtctctgctgctggcaaattaggcactcagcagtggccgtagccaggtcagccttggtgagtggaartccatgttgctgagcccaagcattacttccatccctgccaccatggccactttgttggccatgggcgatggcaggggaaagaggcwanmnggtgtmcacaaaatgggtcatcctatccactagattattaaacccmtcctccgmtgaggtcacttgttggtgagcactcacatgggatacaaatatcttgt

SEQ ID NO: 29654 - DNA, 286 bp, Homo sapiens
cccagcatcaaatgcttgctgatttcaagacccagtttgtgaatggtctcacaagaatttatttaatggggctgggaagtgagggagttattgaaagcagaaataaattgctgttaattgctactgtttgcaatttgctattggaagtagcaaggtaaatgttagtgcacatacaattgtattgattggattgtctttttcaaggttattgttgcaattaaattgaccttttgctggtacagaaataacttgtttaatgaaaactgaacaaatgaattgggcaaca

SEQ ID NO: 29655 - DNA, 340 bp, Homo sapiens
  misc_feature 275: d=a or g or t
  misc_feature 276: n=a, g, c or t
  misc_feature 277: d=a or g or t
tagatagcagtatatacattgacctttcaaaggtttaacgatcttttataataagttagggttgatgtacattagatagactgattgttgagtatttattcaccccgactttcagcaagccttggttgattgattatagctttgcctaccttcccaaattgctcccttcaacatgatgtgcctaagcctctgtgaagaaaaaagaggaagctttagtttgcaaatttttagaatatggattaaaactcagatttcagagccagacctacatattdndcagaaacccaaatttaagataatgtccccagacccatcttatgtaacttaaagttgaacacta

SEQ ID NO: 29656 - DNA, 274 bp, Homo sapiens
  misc_feature 3: m=a or c
  misc_feature 4: m=a or c
gcmmaatcacccacaaaatgcacaaaaatgtgaaaaacgtggcactaaatatacttcgagtatacttatttacagtctgagagctgaaacaagaaggcagagtattgccttgttcagcctcagctgggaatgtgcataccgggcaactcaactttcaccgctctgcacatgtctgctaataactgcgaaagaagtgcctcaagtattaaggattacaaatgaatcttagcaagtaggcagtcacaaatgtggaatctacaagtaatgaaaatca

SEQ ID NO: 29657 - DNA, 155 bp, Homo sapiens
taaccatgactgtaaacattaaaaaaagaataaagatggcagcctcattggattcaaatgaatgtcgttcaaagtcaactctaaataactacatgtgcattgccttgcaaagtgttagacgttttcaggaatcattagcagtaaagtgaagcaga

SEQ ID NO: 29658 - DNA, 243 bp, Homo sapiens
  misc_feature 121: w=a or t
atgtgtgtgtgtgtgttttttttaaggtaaacattactacttgtaactttttttcttagtcatatttgaaaaagtagaaaattgagttacaatttgatttttttttccaaagatgtctgtwaaatctgttgtgcttttatatgaatatttgttttttatagtttaaaattgatcctttgggaatccagttgaagttcccaaatactttataagagtttatcagacatctctaatttggccacc

SEQ ID NO: 29659 - DNA, 183 bp, Homo sapiens
  misc_feature 96: k=g or t
aaatgctctggggctctccgcgctttcctgagtccgggctccgaggacccttaggtagtcccggtctcttttaaggctccccggcttccaaagggktgccacgtccctaaaccctgtctccagctcgcatacacacacgcacagacacgcacgttttctgttcctgcgtgacacccgccctat

SEQ ID NO: 29660 - DNA, 71 bp, Homo sapiens
  misc_feature 9: w=a or t
gtcccctcwtgtttgaagctccagtgagggagcagtggctggggtggcccagcttcaaagtctctgtcctc

SEQ ID NO: 29661 - DNA, 73 bp, Homo sapiens
agtccgcaggagccgctgctgcagccggcagctgggcgggattcccggggtagtcgctgggagcaaagctcgc

SEQ ID NO: 29662 - DNA, 144 bp, Homo sapiens
tgagatggagtctcgctctgtcacccaggctagagtgcagtggcgccatctcggctcactgcaacctctgcctcctgagttcaagcaattcttctgcctcagcctcccaaagtagctgaagattacaggtgcatgccaccacca

SEQ ID NO: 29663 - DNA, 305 bp, Homo sapiens
tataatcgaagaatttcactttttaactccaaataatgaagtgttttgttgtagggtattagatctttcatggaagaaagtagtcccgtaagtctaagtacaaatttcaaatgtaaaataaaactgatcaagccagagaccaggtttggcaaaaagtatcatttgatatgacttgtaaaatgtcaattattgtgaacaattttaaaaagacctcatcagaccatattgcatgttctcataaaggggaaaagaagtatataacagcatgtactgaatactgtatacccattatacatcgggcctgc

SEQ ID NO: 29664 - DNA, 196 bp, Homo sapiens
  misc_feature 158: k=g or t
  misc_feature 164: m=a or c
acacagggtgctgtgtatgattgaaactactgactttctgtggcccgtttgcagcccagctaacctgcccaaggggaaggtgttaatgctgtgaattggcagaggagagagctgtgctccatagggtgctgccggtgctgtgctccctagccttctgktctgtmttcctccttagccagaacgccacccccttccc

SEQ ID NO: 29665 - DNA, 174 bp, Homo sapiens
  misc_feature 122: w=a or t
  misc_feature 164: r=a or g
tttgatttttgctgtgttatcaaaaacttgaatactgtgagaagaagtgaattttcagttgacgaatcagcatcttgttcccatggtgataacactaattgaatatatctatgagggcatgwattagttaatggaaaaaaaaatacaacactaacaattacatrgctgcaattg

SEQ ID NO: 29666 - DNA, 259 bp, Homo sapiens
taaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaaggcaatcaaaattatatatcgaaccacttaggcatgttacggggtaaagtcctcacccctgcatttgagaaatattttattatttttattttaaggcaaaac

SEQ ID NO: 29667 - DNA, 397 bp, Homo sapiens
  misc_feature 135: w=a or t
  misc_feature 136: k=g or t
  misc_feature 250: y=c or t
  misc_feature 251: y=c or t
  misc_feature 306: n=a, g, c or t
  misc_feature 307: n=a, g, c or t
caaaggctctttgggaaagcttaatttgagatattgttgctaatttcatcagtattttaatggcctccaaggaaaattgtgaatgttttatgagtatttagaagtaatgtagatattccaaggaggaaaaatggwkataaaaagaaaagcgtgtaatgtcataattacttcattagtgtggagaagacattagcaagaaaattccaggtcaacttaaaatggtcttatggggagcaggcattttaatgayyatcacaagagggttgtcctgtcccaaaccaaagcctgtgtcagattccataaatnnattagaaagcaaatagcactttggtttacagtaaaatgaggatgtgtgaaaatgtttctttgcaaattcgcttttgataatcacgatata

SEQ ID NO: 29668 - DNA, 85 bp, Homo sapiens
agtttattaggaatgtctttatttaattaatttggtaaattactaggaatgtagtagtttacattactgctatgaactcccttct

SEQ ID NO: 29669 - DNA, 142 bp, Homo sapiens
cacggtgactattcagctatttggcgtgaataagaagaataaggttaatttcctgagattcataacaagggtcatttatcattgcatcatttatatgcctaggatgcccttttgtttttatccatatttaaacatccagctt

SEQ ID NO: 29670 - DNA, 178 bp, Homo sapiens
  misc_feature 104: r=a or g
  misc_feature 164: m=a or c
atctgtcaactgctgtttaaatttttgtgtttagaagttatgtagtacctgtcactattgtgacatggctcacatgtgtttagaagtgcagtttcaaatttgarcttgcaaagtcattttgctaaactttctgtcatttttcctaccaggtataaagcaatcamttctaaataggtca

SEQ ID NO: 29671 - DNA, 320 bp, Homo sapiens
  misc_feature 66: k=g or t
  misc_feature 67: k=g or t
  misc_feature 148: r=a or g
  misc_feature 149: r=a or g
  misc_feature 247: v=a or c or g
  misc_feature 248: w=a or t
  misc_feature 249: w=a or t
  misc_feature 250: h=a or c or t
tgagcctgtttcagaccctgacctttgtgccttcagggaacgtgctctcaggagacctcttgctgkkgatggggaggctgagacaggatcgcttcagagctgagtggagacacatgatattgactagagttccctcccagaggctcarrtggtctctgggagggaaacatgatccaataaatggggactgtgggaattacatttctcccatttccgtcatttctgggaggctccaggagagtgaagvwwhgtttaattagcccagggctttgttgactccggttgggaagctccctgtgtacctccaatgctccacccac

SEQ ID NO: 29672 - DNA, 245 bp, Homo sapiens
  misc_feature 137: n=a, g, c or t
gaagttaaaggtgagttactaatgtgtttgggaaaagaatgatgggtttctgcattcacatttcagattagttgtcacataatccccttttgggtatggtatccatgccctcaaccgtttggggtcccccagtttanagctactgttttatatttttattatagtatttatctccagacttcttttggtgtggaataggggcaatctccttgatggatttctcaaacagccttcacccaggcttc

SEQ ID NO: 29673 - DNA, 143 bp, Homo sapiens
agataagagagtacttacaccatctaagtcaaatggacagggtgtttttttctgtaaactgttcctggagaacacaaaagatggataattttattaatcacagctgtttaccaggattgtctatgtgcttcatctttccccac

SEQ ID NO: 29674 - DNA, 222 bp, Homo sapiens
  misc_feature 144: s=g or c
cgatgttgatgatattgcctttgacacttggatatgtgagcagtgggacctatacaaatgatttcaactcagtccctgtcctctagttggcttccgaccaagtggcagaagccaacacacacagtcacctgtgtgtaagcgtasaggaaagatgagctcaggatggtttaggaacacgcaggaggaagcgttggagcctagcttttggtggccggggggggt

SEQ ID NO: 29675 - DNA, 110 bp, Homo sapiens
gcatcactcgggtccccttcctgcacccagccgccacttgccggttgctaagcagttatcattgtttctgtggcgattgcagaggctgttgctaattggagaagccccaa

SEQ ID NO: 29676 - DNA, 138 bp, Homo sapiens
cttggtccacttctctacagattgatttaagagcctgggaagtcattccacaaacagacacacatgcacacacgcttctcaccttcagagcttcaagagcactgaggcgatcagtcccctacccctgttcccatcact

SEQ ID NO: 29677 - DNA, 141 bp, Homo sapiens
  misc_feature 109: r=a or g
gctaaagaattagattggtattggctgaaatgttgcagtaatcacatgatagggttaatacaacatgagttacatgctgagtgctctaaggtagaaagtaggtaacaargaataacaggtaggtaatgtaagtcgggagag

SEQ ID NO: 29678 - DNA, 337 bp, Homo sapiens
  misc_feature 115: r=a or g
aatgctaatagagttttgaaatcttaacccctagtgaatcaagagtctactgtgagtccctgatggggtcattcaaccaaggcagttatttctgaaattcttccaactctggcaratcctggtatttactttagccctgggtcatcagttttcctaatgaaccacattttttttttatgatgacgatgctggaaatgggttttaaatagggtaaattcttatttgttctcaatacctccggaatagctgaagagtgaacactttaaagactgattggcaatgctgactggctagtgtattcttaggtggtacaaaagcagtataattcactactttt

SEQ ID NO: 29679 - DNA, 247 bp, Homo sapiens
aaagcagagtaaggaactgatagtgactggtgcatgaaaggggtgccagtttaaatagcatggtcagatggaaaagcctgtgataaggtaaaattgagcagagacctaaatgagagagagtgaaccatgcgaataattaagtgaataatgttttaattatagggaacaatatgtgtgtgtctatatatatatatacacacaaaggtactgaggcagcagtatacttggcatgtttgaggaataacaa

SEQ ID NO: 29680 - DNA, 202 bp, Homo sapiens
  misc_feature 100: m=a or c
cacttagctgctgcttgtggctcttaaatcgacattctttctggcttccttgaagggaacaatcagatagactgtaggtggtcttgcttagacatttgamgctttattcttagacaaatactgccaggatatcctttgattcctgagagcagctagaacctttcaaggtgtgcgtgcatatgtgtgtgtatgtgtgtgtatc

SEQ ID NO: 29681 - DNA, 81 bp, Homo sapiens
cttggtatattcttgtgttaactgcccattggcctgaaaatactcattgtaagcctgaaaaaaaaaatctttcccactgta

SEQ ID NO: 29682 - DNA, 161 bp, Homo sapiens
agaattatggataattaatacagtaacagtatattttattttattttaaaaacctattttaattgaatttaatttttaggatagtaatacattcacatggttcagtatcaaacagcataaagaggtttacaataaaatgtattctacccttatcccccaat

SEQ ID NO: 29683 - DNA, 423 bp, Homo sapiens
  misc_feature 251: n=a, g, c or t
  misc_feature 361: r=a or g
  misc_feature 385: m=a or c
catagacaacgtaaacaaatggaaacacatcccatgcccatgaatgggtataatcaatattgtgaaaatgaccatgctgccaaaagcaatatacacattcaatgcaattcccatcaaactaccaccatcattcttcacagcactggaaaaaacaattctaaaattcatgtgaaactataaaagcccgcattaggcaaagcaagagtaagcaaaaagaacaaatctggaggcatcacgttacctgacttcanactatactacaaggctatagtcaccaaagcagcatggtacaggtataaaaataggtgcatagaccaatggaacagaataggaacccagaaataagcccaaatacttacarctaactgatttttgacaaagcaamcaaaaacataaaagtggggaaagacaccctaattcaac

SEQ ID NO: 29684 - DNA, 388 bp, Homo sapiens
taacagagacagaagcagaaaaccaggagaaaggatgaaacattcttaactccttcaatgtgtgtaaatgaggaaggaacatatcagttggttcataatatctatatatatatttaattcctcttgtttttggggatctttttttttctaatacttattaccactatacaaaatgcaggtgggaataaaggaataacgaaagaatataaattactgaatcgatcttgcaaatgtttatgtatggttcaaattatttacttctagaaaaggtcttaagaatcttactcagaacctttatactcttattttctcacaaagctagtgactgtatagtgtaaattaatggcttcttgcagaataaatgtagcaagtagttagtgtaggaggt

SEQ ID NO: 29685 - DNA, 287 bp, Homo sapiens
  misc_feature 217: k=g or t
caattgatacaaataaggtgtgcttggtatacattaatattttcttccaaagatatatctttggttagaaacacaaaaaaataaaactagtaatattgtatgtttatctatctctacatatttccagcatatgtagcgttaatagatctgtcctggtaactgtgtctttgggatttcattttggttccatcaaattaggaaaagaaatggcttagtkgtatatgattagctagagatttttggagccagacacctgctgtttagtagataacttagtacagacccaa

SEQ ID NO: 29686 - DNA, 154 bp, Homo sapiens
atcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcaaccac

SEQ ID NO: 29687 - DNA, 316 bp, Homo sapiens
  misc_feature 314: n=a, g, c or t
  misc_feature 315: n=a, g, c or t
tatattcgaagttaaaactaccacattacatttattttatatttgttctatttgtcctatttcattttcttctttcccactttaacaaattatttttatctttcaatgcccccctccagtagcttgttattatagtttttaaaattaaacttttactcttagttgcatattgtcatacagttgtaagaagcattacagagagacactgtgtctttaccccattttctccaatgacaatattttgcaaaactgtagtacagtatcataaccaggaattgacattgatacagtcaagatacagaacattcccatcnnc

SEQ ID NO: 29688 - DNA, 267 bp, Homo sapiens
  misc_feature 105: r=a or g
  misc_feature 106: m=a or c
  misc_feature 246: s=g or c
acgggacacctgcatctgccaacaagactggaagcagaaagggacagagacggcgaagtttgacggtctggaaagcagagaccagcagggctgactgcttgggarmgcctctcgggaggtccgagaagagaaccgcgatctgtttcagcaccggggctcaggacagttcccagcgggctccgtttcgtctccagaaccctggacagctcctccagtagagacggggtttcaccatgttggccaggstggtctcaaactcttgacctc

SEQ ID NO: 29689 - DNA, 157 bp, Homo sapiens
  misc_feature 43: k=g or t
  misc_feature 66: w=a or t
  misc_feature 114: r=a or g
  misc_feature 120: y=c or t
  misc_feature 127: m=a or c
  misc_feature 137: w=a or t
  misc_feature 138: m=a or c
  misc_feature 139: m=a or c
  misc_feature 145: w=a or t
  misc_feature 147: r=a or g
aggcagagtcgggcgtccgcgtcctcccggccagctcgaccgkcttctctattgggagtctctggwactcaggctggagtgcggtggtgtgatcttggctcactgtaaactcargctccygaactcmaagcaattcwmmtgcctwgrgccctccccc

SEQ ID NO: 29690 - DNA, 435 bp, Homo sapiens
  misc_feature 362: b=c or g or t
ctactgtgttacatgttttcattacaaatgggtgttcaattttatcaattttattttctgcatctaatgggatgatcataagattttttctcttttaatctgttagtgtgataacttacattttttgattttccagaaatgtctttggattcctagaataagccagatgtatcacaagtggattatctgtatcacatatatggctgttcttgagttactaatcttttatattttgtgtgtaaggaatgtttttaatctaggtgaaattttgaatctatgctcacaagtaagaatatcctttctcaaactatccttatctggccttagtactgagctttagattatcttggaggttccatctbccttcttgtaatgattcttatgcctcatggcacacacaaagttcccctttgtaaatttcatacgcgctcgagg

SEQ ID NO: 29691 - DNA, 104 bp, Homo sapiens
  misc_feature 28: s=g or c
  misc_feature 29: y=c or t
  misc_feature 30: s=g or c
  misc_feature 31: y=c or t
  misc_feature 54: w=a or t
  misc_feature 66: s=g or c
  misc_feature 67: b=c or g or t
  misc_feature 73: s=g or c
tttcgcttcacccaggctggttcagagsysyctgcattattgggccgaatcccwtctgctgtgggsbatcagsctaccctggccactgacatgggtactatgca

SEQ ID NO: 29692 - DNA, 161 bp, Homo sapiens
  misc_feature 149: n=a, g, c or t
aattagccaggtatggtggcacatacctgtagtcccagctactcgggagcctgaagtagaaggatcatttgagtccaggaggtcgaggctgcagtgagccgtgagccgtgatcatgccactgcactccagcctggacgacagagtgagngtatgtttcaga

SEQ ID NO: 29693 - DNA, 286 bp, Homo sapiens
tttgcgcggcccttactgttgctgtgtctgtcctgtcatctggaggtgcacaactaccccatgcttcacagtgaagccagtcggctgaaggaaagatgaacgggcactttctctttgtagagatttccggaatctcctgaggccacttttattgcttcccgtctttgtgaaaaaataggcttggaaatagagggcccaagacagggagtggaacagccagccccgtggaggggacctcagctgtggagtggagtggtcctgagccacagctggataacggacaccc

SEQ ID NO: 29694 - DNA, 373 bp, Homo sapiens
  misc_feature 323: s=g or c
  misc_feature 324: n=a, g, c or t
tcgtcgggtacggtatgatgttttgatccacgcacacattatgtaacgaccaaatcatggtaattgttgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaasnttaagagaatttctttacggtggagaaaaagtaactttatgaagcccct

SEQ ID NO: 29695 - DNA, 293 bp, Homo sapiens
acaaaatagcaggtcagaactcttgtaaactgggggcaaagaatgtcatctagccaaatgcaagactcttccatctctcttgaacacaaagggaaatctcaagctgttgtcattggtcaactccataggagcacaaacgagggcagagaagagagcagcagaagatgtatgatttagaacatagcataacccttccttttttaaaatcactccagctgcatagagagaaggagcaccatgctcacccttgcatcgggtttatatgacctttgactatacagtgaccctacccc

SEQ ID NO: 29696 - DNA, 100 bp, Homo sapiens
tgtcttgtgtagatcatgccgccagtagcggccctgactgccgaggaaacggtagcttaggacagttggctgttaagtgacactgattctcccctgccca

SEQ ID NO: 29697 - DNA, 151 bp, Homo sapiens
aaaccaataaacctgtattatgattatatagtatattattcacattagttcctagaagtgtggttgactcattaaaaatgtaatcctatattacaaaattcatacaactaaagtgtcaaaggaaattaatgttctctgtttccccccacgc

SEQ ID NO: 29698 - DNA, 158 bp, Homo sapiens
agacctgaaactatgaaactactagaagaaaacataaggcaacattggtctatgacattagtttaggcaatgattttttttatatatgaacacaaaagcacaagcaacaaaagcaaatgggactacatcaaactgaaaaccttttatgcagccaagca

SEQ ID NO: 29699 - DNA, 319 bp, Homo sapiens
  misc_feature 122: m=a or c
  misc_feature 131: w=a or t
  misc_feature 142: v=a or c or g
  misc_feature 143: m=a or c
  misc_feature 144: m=a or c
  misc_feature 149: w=a or t
  misc_feature 163: w=a or t
  misc_feature 267: r=a or g
  misc_feature 269: m=a or c
tgctagttgaaaaatttgtctctgatgttttgattttgcgtttcttgaattactagtaggttgaacatttttccatgtctttgtttactgtttggacaattttgaagacaagagaatattgmtgttgactwctccgcaaggvmmttacwtccactttctgtcwcctccccctgtcctactgcctgtgttgagtgctgcagaaggaggttgaagacatttcagtggagtccatgtctctcaggcagcttcgtttcctggaggggagaramgcagtgccctcagacatggggaatgaccacatgctgatgggggcacagcc

SEQ ID NO: 29700 - DNA, 417 bp, Homo sapiens
  misc_feature 189: n=a, g, c or t
  misc_feature 398: m=a or c
  misc_feature 404: m=a or c
  misc_feature 417: m=a or c
gcccgagccgccgctttggtcacagtgaccgccaccattgcccggggatgggtccctgagacttggcgaagtaggagccctgtgtgatcgtgcgtcagagtcggggctgagaccagccctggccagggcagttaccaggacggtctccggaggccgggattcgcggagggtccaccagcaggaagaaancccaggaggaagaaaactcagacagatcgccggggaggcagcgcgggatcccagcctcaggcgtgcgcggacggtgtgcggagtctagctttgtaccaggctgcagtgccagtagtgccatctcagctcactgcaacctctgcctcccgggttcaagcgattgtcctgcctcagcctcccgagtagctgggattacagccacatgccamccacamccagctaatgttm

SEQ ID NO: 29701 - DNA, 406 bp, Homo sapiens
  misc_feature 120: m=a or c
  misc_feature 319: h=a or c or t
  misc_feature 320: v=a or c or g
catttctacctccggagcaaggtgccagcgccagtactagagcctgcttatccacatttgccctggacaggagcaggaggaagtccacttctgtaccggcagacagagcatgtgaacacmaaacacaatttctatggcatagtcaactgaacttcatttttacatttaatctaacatgttaacacgttctaacagggtttctatgagcagctgctgtaacatactcatcaactatgatagacttaacacttgttacctaatgaacaaggaggatgtgcatttcgggtttcttttgatattcgtggaggtgattgtcaghvtttaaacaggactactttctccactatgaagatgacttggaaatcgcaacatcatggtacattgctaagtccatgcttgtgtgtgt

SEQ ID NO: 29702 - DNA, 432 bp, Homo sapiens
  misc_feature 431: n=a, g, c or t
ttaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcant

SEQ ID NO: 29703 - DNA, 290 bp, Homo sapiens
  misc_feature 139: m=a or c
  misc_feature 282: n=a, g, c or t
  misc_feature 283: b=c or g or t
tataaaggaaaagaacaggttcaatggaaggaaaaattagaattgttgatacatgaatggaagtaaatgacccggacttccaactctaaatctctgtctcatttcacctctttgtaaataatcattgctattatgttamatatcacaactactgtcatttcttgtttacccactacattctaagcttggtgctgacatctttgtatttattatataaaattctcaaaattactctgcccgttaggctttcttatcacttattccaaatgcaaaaataaggtnbagggtct

SEQ ID NO: 29704 - DNA, 118 bp, Homo sapiens
catgaattattctgtttaccatttgcagaatattaagttaccaattctaaagccacttcctccttggatgaccttaaggggaaaaaagaaaaaagataccctcacatcctcagctccc

SEQ ID NO: 29705 - DNA, 408 bp, Homo sapiens
  misc_feature 408: m=a or c
atctattaatacaatgttctttgtcattttacccattttaagagctttttcatgtattatggacaaaaaccctaaactaaattggttttctccagttagttgcattgcaattttgtttatcatagtgttgacattcaactatttagaaaatttattactgtaagtatcttggtctttgtgtgtgtgtgatttttactttgatgtaatgcaggagtccccaacccctgggccacagaatggtaccattaggaaccaggctgcacagcgggagatgagcagtgggcaagcaagagaagcttcatctgtatttgcagccactccccatcactcgcattactgcctgagctccatctcctgtcagatcagcagtggcattagattcttataggagcatgaaccctattgtgm

SEQ ID NO: 29706 - DNA, 344 bp, Homo sapiens
  misc_feature 247: y=c or t
cacctttaatttagcacaggccttccatttatttctaaacttttttttaactcaccatttgactttctgatattgtaaaatgtgtgtgctgttttttttgtgtaattgaagcctctgaaaaaataaatgaggtgggttttgctgtaatgtccctagtacttggctaaagctagtaaaataaatagatcccattcacaattgccacaaagagaataaaatacctaggaatccaaattacaaggaatgygaaggacctcttcaaggagaactacaaaccactgcttaaggaaataagagaggacacaaacaaatggaaaacattccatgcttatgaataagatgaa

SEQ ID NO: 29707 - DNA, 126 bp, Homo sapiens
gagtcgggcttcggtcgcaccagagacagcggactttcctccgatggttgcagcagagggatcatgacggggaaaaagtcctcccgggagaaacggcgcaaacgtagcagtcaggaggcggccaac

SEQ ID NO: 29708 - DNA, 391 bp, Homo sapiens
  misc_feature 339: n=a, g, c or t
  misc_feature 340: n=a, g, c or t
tagggaaaagttaaccattggatgccgccagctggttgagatggaatataccatgcagcagtgcaatgcatctgtttatatggaggccaaaaacaggggatggtgtgaagacatgctcaactataggatataagtactgatttgtaactttaaaggaattgcatttgtccttaagaataacagagtagttttcaatctggtcactcttttgggccaaacccaagagaattttaagaaatgtttcataggtataaaaaggtgatcgcctattactgacagtctcattgtagctctaaaaagcctaatgtatccactgtggaataaactccatagactcanntcttctggagttcacaatgcctccctacctctattcttgatagtgagcctt

SEQ ID NO: 29709 - DNA, 205 bp, Homo sapiens
gggagagagaggcttcaatacaatcacagtaggagacttaaacaccccactctcagcattggatagatcatctagacagaaaatcaacaaagaaacactggacttaaattggactttagaccaaatggatgtgacagacatttacagaacattttatccaatagctgctgaatacacattcttctcatcagtacatagaacgtca

SEQ ID NO: 29710 - DNA, 171 bp, Homo sapiens
tgagttggaatggaaactgtctgaatctggagcaattatgacagacctggaggaaaaccctaagaagccgattgaagacgtgttgctgtcctcagtgcggcgctctgtcctcatgaagagggacagcgattccgagggtgactgaggctacagcttctatcacatgccggc

SEQ ID NO: 29711 - DNA, 230 bp, Homo sapiens
gatcacatggaaaatatgagtgattataaatagtaaattttctagaaccatgtattgttcactgtaaggaacctagtcaatgaacattttttaatacttgctggttttgagtgccaggttgttgcaaaaagtcctcttccttcctcccaaagtatagagactcctctaggtagataaactttctgttaattggaggaagattggccctgtcatggaattaaatgaagcct

SEQ ID NO: 29712 - DNA, 234 bp, Homo sapiens
aggagaacctactgtggaatcattcaacctaggttttggttatagttctgccagagctggtggccacatgtctagctgtgagactctcactgtacagtgtcccttaatctctgcaagtccagagtttttcattttagtaacatgtgcaaattgtctggatcagagctcctcagtccttgacttgcttacatgttttggaactaaaagatctgcctaacatgtatctgcccccat

SEQ ID NO: 29713 - DNA, 159 bp, Homo sapiens
gaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgaggggtt

SEQ ID NO: 29714 - DNA, 63 bp, Homo sapiens
aatgatgaatatttaatgtgaagctcttaatatactacaagtgtcttgtttaccatttgtctt

SEQ ID NO: 29715 - DNA, 291 bp, Homo sapiens
  misc_feature 130: w=a or t
  misc_feature 213: w=a or t
  misc_feature 214: n=a, g, c or t
tagataaatagatagatagatgtagagatagagatatatgcagctctctgaattggagatgcagaacctaaggcagtctgctgtttgctctctgtctgcgctggcctttgagacaatataaaaagcaaawaagggtattcccaatagtaaaaagattattgaggattttttctggggagtgattaggctggaaaggtaggagctaaatattgwnttggcagcagcagcttttgcaacaataatagaatctgatgcagactgtagcaaaataaaatcacaccacttagggct

SEQ ID NO: 29716 - DNA, 117 bp, Homo sapiens
gtcttagacttacttttggtgataatttgaagatctcaggatccaagtgcatcactgaggttcagactcagaatgaggggcgattcacccagcccatatgtttgtcaaaaggaggca

SEQ ID NO: 29717 - DNA, 227 bp, Homo sapiens
  misc_feature 126: m=a or c
cgtggaaattgtcaccattgcagaggcagaattttatcggcaggtttctgcaagtctcttgttctcttgctccaaagacctggaagccttcaaccctgaaagtaaggagctgttagatctggtggmattccacgaacgaaattcagactctgctgggctcctctgtagagtggctccaccccagtgatctggcctcagacaactactggtgagcaagccggacccat

SEQ ID NO: 29718 - DNA, 453 bp, Homo sapiens
atataagatctacagaaatggaattcatcccatagtttgataatctgctttcagtaacaatgttaaaggaaagggcatgatttttaactataaaaacttatataatgtgaataaaatcttcataacgtaagcagtacctcaaagtaaataatgtaatgataagcactttataactattaactcatttaatacttaaaacacacaatgacatgtctcactgttgttctgttttattgttgagagaattgagacagagaaaggttatttgacttgcataggttccctcaggtggcttacgtcgagccaggatttggatccaaggtaatctgtagcattgggctgcagtgcatctggagggttaagtttagtaatccataaatcgtgtatttccatcacttattttactaagagcaaatcatgttcacccttatcctttaaagagaagtgcagcac

SEQ ID NO: 29719 - DNA, 164 bp, Homo sapiens
  misc_feature 142: w=a or t
  misc_feature 145: w=a or t
  misc_feature 155: r=a or g
cagtccctatggaaagatggcatcaaaaaagatagatctatatatatatataaatatatattctattacattttcagtgagtaattttggattttgcaaggtgcatttttactattgttacattatgtggaaaacttatgcwgawttatttaaarggggacgga

SEQ ID NO: 29720 - DNA, 287 bp, Homo sapiens
  misc_feature 146: m=a or c
  misc_feature 148: y=c or t
ggatgggtgagtgattattgtgacttcatccacaacccccgcaaatttcttgttccacaaatatttccccatgtgaatgagaaatatactactttccacttgtctagtgcttttgcatggctttgagaagaatgatttcatttgamtytcacaagaaatcttgtatgagttttacaaatgaggaagccaggttccagagaaatacacatagctatcggaagtagcatttgcaagctgcttatgtttcatgaagaatattctttatgggatatcacttgcccctactc

SEQ ID NO: 29721 - DNA, 129 bp, Homo sapiens
  misc_feature 45: m=a or c
  misc_feature 50: m=a or c
  misc_feature 98: w=a or t
aactctaaaatttactttttccaaattgctaagtaaaggaagtamaagamtaatctataatttctaagactaggtcagacacagtggcttacacctgwaatcccagcactttgggaggccaaagctgga

SEQ ID NO: 29722 - DNA, 170 bp, Homo sapiens
tatttccctttaataggaattgtattcagggaagtcatggtctccttgtaacagtgggccttgggcaaaagtgcggagacccagctgttaacacctgcttgaatctaattggtgagaaactcatttaatctctgctcagaaaaccaggaacatgggagatgataaggggt

SEQ ID NO: 29723 - DNA, 148 bp, Homo sapiens
tatgtatgtgcatttggtatcatgggccgtggaacagaatatatgttggacctctgaaaagttgtaaggggccaattctaagtattcttcacggcagccagaagttaatggtggtagcagctgaggtatggttgttggacgaggccgc

SEQ ID NO: 29724 - DNA, 328 bp, Homo sapiens
  misc_feature 128: y=c or t
  misc_feature 134: h=a or c or t
  misc_feature 227: d=a or g or t
  misc_feature 310: w=a or t
atggacaagtgataattttgatacaatgatatatgtggtaagtaatcagaacaaaaagttatgatctcttaactcatgaaaactacagaggtagaaattggatgccatgttgaaaaactatggaaaaytacaghgagaagtcaacattaagtatgtttaaagtgggcaacttctatttaaaagtttaaacacttaaaaatgaaaaagtttacattgcttcatagtadgaaaaaattacctgaatcagtaagatggttatgtgaaattaatatatacaggtcactataaataccaagtttttttgtttttwatttttcaattctgattt

SEQ ID NO: 29725 - DNA, 118 bp, Homo sapiens
caagaaaaaaacaatcccatcaacaagtgggcaaaggatatgaacaggcacttctcaaaagaagacatttatgcagccaacagacacatgaaaaaatgctcaccatcactgaccatac

SEQ ID NO: 29726 - DNA, 176 bp, Homo sapiens
  misc_feature 150: y=c or t
  misc_feature 151: w=a or t
agatacatcaagcaataataaactagatgtgcaataatcttgtcgagtagtatgtgctggttttggaaaggtgaaaagaaaattgttacatcaggctgcttttatcaagctaagcatgggcatgcctttccaaagggtatatttgattcywacagttaattttaacatcgggctgc

SEQ ID NO: 29727 - DNA, 206 bp, Homo sapiens
  misc_feature 149: y=c or t
  misc_feature 153: k=g or t
tatagaatctctttgacatatggttctattcagtaggatcaaattctgatggaacctccaccttgcctgctgtgctgtgcctgcagaaggccaactttcgagaacagaatgcttttacttattctactttattacccagctcttgcccytttkgggctttagaggagaagagggggagattgacaggacaagtggaaatggtgggc

SEQ ID NO: 29728 - DNA, 277 bp, Homo sapiens
  misc_feature 156: m=a or c
  misc_feature 158: m=a or c
  misc_feature 249: r=a or g
  misc_feature 250: k=g or t
tgtgtacattgcttctcaactctgtattgagtgacatcacgtttttaacttgaatttggccatggtgggaatatttacaccatggacattaacaaatactataagtcaaggttgtttttttctcacagccagttgctaaacatttaattagcatamcmactgcccgacatccattttcattttattttttctatatcagtcttttaatttcctggctaatctggctactgcctgccccataatttctarkgtctgttccattgctttaatggcccct

SEQ ID NO: 29729 - DNA, 182 bp, Homo sapiens
  misc_feature 139: s=g or c
  misc_feature 152: y=c or t
  misc_feature 154: y=c or t
ggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgsacctggcccagcygyaccgcagcctacctcagcccccggtcgc

SEQ ID NO: 29730 - DNA, 303 bp, Homo sapiens
atgaattgttactactttggggtatgtggtgtttaaagttctggtgggacatacatccttgtatgttaagttgcctttccttcttagctagcatttatttactttcctagtacttgagtttctcctccactttctctttgttttacctgtttttggttaaccttttacttaggctatggattatcactataagattaagactaaaagaaaaataggaggacagagctaacagggtggttagtaaattaataatgaagcttcccaggtcctcctctcccttcttccctccccgcgtcccaggca

SEQ ID NO: 29731 - DNA, 149 bp, Homo sapiens
  misc_feature 139: m=a or c
tttttccggtggtgggaaagtgaacgaatcccgaatcaaagcggcgcattgaggcaggtggggtgccagtggaagagggaaggcaggcgagtgtttacggcctgacttgggaggccggcggatcagcaattgcagaagmaggcagcggc

SEQ ID NO: 29732 - DNA, 161 bp, Homo sapiens
aaggagggtggatcacttgaggtcaggagttcgagaccagcctggccaacatggtgaaaccctgtctgcattaaaaatactagagattaggccaggcacagtgactcacacctgtaattccagcactttgggagaccgaggcgggtggctcacctgaggtc

SEQ ID NO: 29733 - DNA, 140 bp, Homo sapiens
gtgcagaacgtgcaggtttgttacacaggtatacatgtgccatggtgatttgttgcactcatcaacccgtcatctaggttttaagccctgcatgcactaggtattggtcctaatgctctccctccccttgcccctgccaa

SEQ ID NO: 29734 - DNA, 238 bp, Homo sapiens
aaaacgggaacttgtgaggtggtggcactccacagatgctgtaataagaacaagatagaagaacggtcacaaacagtcaagtgctcctgcttccctgggcaggtggcaggcaccacgcgaggctgctccatcatgtgtggatgcttcaatagtggaacagaaatggtggtgccatatgcagccatgtctagagggagaagaatgtaaagttcttccggatcggaaaggatggagcttt

SEQ ID NO: 29735 - DNA, 379 bp, Homo sapiens
  misc_feature 127: k=g or t
taacttagtgaccaatttgagaggtttgacaacagagtagaataggtcattatcttaccaagctagaacaataaaagagtgagtttggatgcctgcaaggataattgactaagttgtagacctgggkgtctgcgttttgtgggtgaccaggtagagaggtacagataatggaaacctgcagtttaggagggatgtcaagattaaaggcagaaagctagacttcattgttatatgtgtgcacttgtggctggtaggaatggatgagatctgctggggacgggaggtattcttagagaggaaagaactaaggacagagtctggtagacatcaacatttgagggctgaggtagaagtagaacaaaagtgaataatcagagac

SEQ ID NO: 29736 - DNA, 124 bp, Homo sapiens
ttgaatccgggaggcagaggttgcagtgagccgagatggcaccattgcacgccagcctgggcaacaagagcaaaactctgtctcaaaaaaacaaaattaaaaaaagtaaatgatttaggggaac

SEQ ID NO: 29737 - DNA, 436 bp, Homo sapiens
tataacttttatatcaactggcaaaattgtggtgccttgcctgtcagctgatagttaaatttaagcagagtcaccatattaataaaacactgcttgtatttgaatattttatggcatattggtcggaaacaaggaaaatgaagatgctgatactatttacaagcagctgtaggttctaaaaccggatgaattatggaagcatattatgagtttggatatcaattttttctttagtattttcagtgatgttacttatttgaaacccttagaattacattgaagaagtaaactttgcaacttgattccttgaccacagttatatttattatttatttatttatttattcatttattttgagacggaatcttgctctgttgcccagactggagtgcagtggcgtgatcttggctcactgcaacctctgcctcctaggtt

SEQ ID NO: 29738 - DNA, 191 bp, Homo sapiens
tgaggaggccctagagaagtatgggaaggacttcaatgatattcgccaggattttctaccctggaagtcacttgccagcatagtccagttttattacatgtggaaaaccacagaccggtatattcagcagaaaaggttgaaagctgctgaagcagacagcaaactgaaacaggtctacattcccacctttt

SEQ ID NO: 29739 - DNA, 140 bp, Homo sapiens
tttgtgcccggaaactgggcctagtttgacatccttggaatttgcttggcttgttcatgcaaatgtccaatctcttcccctttctttctgtccagtctgacttatgacttacgtatcttatgtttttctagcatgcagag

SEQ ID NO: 29740 - DNA, 215 bp, Homo sapiens
tctctcatatttggtattgacctctaagtctaatattgcagttggaattcttgctgtattattttttaagcaagtgttaggtgcatttaactgctttcttcatccatgacgacattcccaccatggggggtcttgacaaagcagagtaaaaatatgctgtttacattgtttacttacaagtaaggagcctgaaataacctgtagtttcgaatgca

SEQ ID NO: 29741 - DNA, 299 bp, Homo sapiens
  misc_feature 129: r=a or g
gattcttaggagcattttagtgtttattaaataactgaccatttgctgtagaaagatgagaaaacttaagctttgttttactacaacttgtacaaagttgtatgacagggcatattctttgcttccaaratttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggc

SEQ ID NO: 29742 - DNA, 414 bp, Homo sapiens
  misc_feature 117: r=a or g
  misc_feature 120: r=a or g
  misc_feature 122: k=g or t
  misc_feature 123: r=a or g
  misc_feature 129: d=a or g or t
  misc_feature 130: k=g or t
  misc_feature 132: w=a or t
  misc_feature 280: m=a or c
  misc_feature 335: m=a or c
  misc_feature 389: n=a, g, c or t
  misc_feature 390: s=g or c
  misc_feature 405: r=a or g
tggaagtacatgagtaccataggaaaaaaatacagcgaggtaagaggcatggggaatgcaagatgcaatcttaggtaggcttcactgagaaaatgacatttgagcaaatattggaargargkraaaggdktwagcctgtgctgacagctggggaaagagcattccaggcagagggaccaccaatgcagaaagacttttgtcttggaatgtgcttggtgtcttcagtgaacaagcagaaaggcctgtttggctggagtagtgagtaagggagtagtaatamaaattaggtggcaacacagcaaaagtatagtcagaacggtggagtgtctgaatcmcttaagttgtcctccaatgtgaaggtaatttcctattagctttaggtaaggttnsacagcttaactacarccgttaatt

SEQ ID NO: 29743 - DNA, 187 bp, Homo sapiens
ttatcacttacacctaatacattgtaaatgctatgtaatagttgtgatactgtattatttaaggtagtaataacaaggaaaaaagtttgtacgcattcagtacagatgcaactctttccctgaatatttttgatcctgtggttggttgaatccacagatgtggaacccacagatatggggggccaga

SEQ ID NO: 29744 - DNA, 452 bp, Homo sapiens
  misc_feature 186: d=a or g or t
  misc_feature 356: d=a or g or t
  misc_feature 357: n=a, g, c or t
  misc_feature 386: r=a or g
  misc_feature 392: r=a or g
  misc_feature 412: r=a or g
  misc_feature 439: m=a or c
  misc_feature 451: k=g or t
  misc_feature 452: v=a or c or g
acacctccctcctgtccttgctctcaggtagtgagcgttcgggtggtgccatgggagcactctccctcccccaggtaatgaaagagtggccaagtgagtgttctgtttctgctgtgccaaaaaacgggggggatgtgccatcaccaggttggacatgccaggtgttctgcgtcttagagacccttdgcccatgctccccaagctcggggagtaaaactgggctatcccccgtcagggcggcaccctggtcaccagccaaacctcagtatactccctcccctccttccctgtctgaacgctaggatctgctcctgaagctccaggatgcctgcacttccactgagaagctgctggcdnatgttggactagaggaaagaagaaggcarggtggractgatgggctcagtggggragcagggccaggcacactgagccagamatgtcatgtctkv

SEQ ID NO: 29745 - DNA, 143 bp, Homo sapiens
cgatgttggttattcctggggtgtcgcttagcaggtggtggtctggatgggggcacagagcctgccacggtgaggcaggttctgctttaggtgatcagttactaaagccgtgtgtctggacccatttgtgctgctgagcttca

SEQ ID NO: 29746 - DNA, 123 bp, Homo sapiens
tttaaaaccttagccattttctggaacttaaatatcaaagagaaaatgtccacatatgatgttaattgaggtttgtctcactggtgatttgtgctgattcaattcctgtttcttttttttttt

SEQ ID NO: 29747 - DNA, 178 bp, Homo sapiens
  misc_feature 59: w=a or t
  misc_feature 155: m=a or c
  misc_feature 165: r=a or g
  misc_feature 177: s=g or c
gtccagcgacctgctggctctgtcgggagggtggagtgaaagaccagagttctccctgwgcgttaacccacagcctctcttctttgggtgtgaaatcagttcctcgttcagaagcaaattaggtggaaaaccatgtggtgcccaaaacattcaamaaggctgcarggggtggccagsc

SEQ ID NO: 29748 - DNA, 61 bp, Homo sapiens
  misc_feature 16: m=a or c
caatctggtgatgacmgtggtcatggaaagatgaatttacttccccaaagtgacttactat

SEQ ID NO: 29749 - DNA, 118 bp, Homo sapiens
taaatgtaaatgtcctgtcttttgcctttcctcattgtctgcgacttacctttctaggttcctttctcccatgtgcatccccttccttccaaagcactcattgattctagcctgcagt

SEQ ID NO: 29750 - DNA, 202 bp, Homo sapiens
tttgaatctaggattttatggaagaccttgggttatggaacagagaaaagaactctttagaaggtaaatcttcattatatgaaggagagaggagaaccttaaactcttaacattttcttttgtttgaagaaatactaacagtgaatagcccaggtgcattttgatggtttctcaattgcagaagttattttaccctggtccc

SEQ ID NO: 29751 - DNA, 104 bp, Homo sapiens
attaagtggatggggtctaatgtggatttgctttagattaggggtgtccaatcttttgacttccctacaccacattggaagaagaagaattgtcttgggccgat

SEQ ID NO: 29752 - DNA, 225 bp, Homo sapiens
aactttatttaaattgttagtggctgtgattctaaaagcatgaatctgtaatagattttaagaaccaatcttgtctgtccttttgcttttagatgggtacattttttaggacatattcaagacaggtcgtttttaaatctctctttgacagtctccagaaagtaggggtagaccctccccaggcatcctactctaatgttttatcctatgataatcccacagtta

SEQ ID NO: 29753 - DNA, 148 bp, Homo sapiens
  misc_feature 122: m=a or c
cccattctttttgcttctttcccctggctctgccagatgtgttactttgccctgcaatatttaagcaggagaattttacctgggagctgccatgcccatcgagtcgtagcttagtccatggmcccctatcatgaaacctaagaaaggc

SEQ ID NO: 29754 - DNA, 173 bp, Homo sapiens
  misc_feature 124: m=a or c
  misc_feature 141: r=a or g
  misc_feature 145: m=a or c
  misc_feature 151: s=g or c
  misc_feature 153: m=a or c
ttttattatatttactttttgagacaaggtgtctcactgtgtcgcccaggatggagtgcagtggcgcagtcacagctcactgcagcctcaacttcctgggctcaagcaattctcccacctcaamctctcgagtagctgggrccamaggtgsamaccatcatgcctggctaatg

SEQ ID NO: 29755 - DNA, 148 bp, Homo sapiens
ctatttatttagagatggtgtctcactctgttgccaggctggagtgcagtggcagcgatctaagctcactgcaacctctgcctcctgggttcaagcgattctcctgcctcagcctcctgagtagctgggactacaggcacgcaccaca

SEQ ID NO: 29756 - DNA, 311 bp, Homo sapiens
tggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaaga

SEQ ID NO: 29757 - DNA, 158 bp, Homo sapiens
  misc_feature 105: s=g or c
ccccagagcacgtcaggcggcgccatgctcagcgcccaggagcgcgcccaaatcgcgcaggtctgggacctgattgcgggccacgaggcgcaattcggggcggastgctgctcaggctcttcacggtgtaccccagcaccaaggtctacttcccgccc

SEQ ID NO: 29758 - DNA, 373 bp, Homo sapiens
ttctgtgagagctctacatagttaccatttgatttttcactataaaaaattaaaagttgttatgaggccgggcgtggtggctcacacctgtaatcccagcactttgggaggccaaggcaagaggattgcttgagtcgaggagttcgagaccaatctgggcaacatagtaaaactccatctctacaaaaatacaaaagttagccaggcatggtagtgcacacctgtagtctcagctactttggaggctgaggtgggaggattgcttgaacccgggtagccgaggttgcggtgagctgagatcacaccactgcactccagcctgagcgacagagtgagaccctgtttcaaaacaaaatatgttggtatggcagat

SEQ ID NO: 29759 - DNA, 216 bp, Homo sapiens
  misc_feature 172: d=a or g or t
  misc_feature 173: m=a or c
tcagaggtgtaaataatctatgtatagtttttctccttttagattattttgtatttgtttaaaagaagttttgtcaaaatacaaaaatataaagaaatgactgaaagttgttgacaggctttttaagaaataattattctaattgtttttgtttgtttgtttttgccttgtdmactagcgccaaggaactgcagcaaataaactccaactctaccc

SEQ ID NO: 29760 - DNA, 56 bp, Homo sapiens
cacaatgtttaaaagtgacagtaattcattttgtaaactaaaaaaaaaaaaaaaaa

SEQ ID NO: 29761 - DNA, 156 bp, Homo sapiens
  misc_feature 125: w=a or t
gtgactgtgtaaaatttttctttcagtggcaacctctataatctttaaaatatggtgagcatcttgtctgttttgaaggggatatgacaataaatctatcagatggaaaatcctgttacaaaagwagaaaagctttagtaatttactcagtgtggt

SEQ ID NO: 29762 - DNA, 169 bp, Homo sapiens
taaaatgggcaaaggggccgtgcacggtggctcacacccagaatcccaacattttgggaggccaaggtggggcagatcacttgagcccaagaggtcgaggctacagtaagctgtgattgcactgctgcgctccggggacagagtgagactctatcaaaaaaaaaaaaaa

SEQ ID NO: 29763 - DNA, 175 bp, Homo sapiens
tggatgtaacagaggaaagtgtcagtgaactagaagatagatcattagaaattattgtgtctgaaaagtagagataaaagattgagaaaaaatgaacagagtttcatggacctgctgaataatatcaaaatttatgatgttaatataattagactcttagagaagagaaactgac

SEQ ID NO: 29764 - DNA, 233 bp, Homo sapiens
aatgttttgtgtttttggtggagacggggtttcatcatgttggccaggatggtcttgatctcctgaccttgtgatccgcccacctcagcctcccaaggtgctgggattataggtgtgagccaccgcacccagccagaaactcctgtttttaaaactatcagatctggtgagactccttcactatcataacagcgcaggaaagaccctgccccataattcagtcaccccccacc

SEQ ID NO: 29765 - DNA, 192 bp, Homo sapiens
cgaagatatttgcagatcaactgggcttccttagaagcagtgagtttcccatcactggagtgtcgaagcatagtcaggaaaattaggtagagatgtggtagagagactaactctcatacagagggttgtaccagaagatcatcttccagctctgagattttgtgataatctccatcataacatgctgcaacc

SEQ ID NO: 29766 - DNA, 130 bp, Homo sapiens
cctacacctcataccctgcctgcctcctccaggaggaatctccggggccccttcctgactctccccaccttcgccacttgtctctaggctatgggacaatcatcccattcaccacttgacatccttgact

SEQ ID NO: 29767 - DNA, 202 bp, Homo sapiens
  misc_feature 146: w=a or t
  misc_feature 150: w=a or t
ttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagwagawatgaattggtagaacagaggaaattcagttcaaacatagaaaaaggaagcct

SEQ ID NO: 29768 - DNA, 208 bp, Homo sapiens
taaattgggttgttagaattggaacaagacattcacattccatgatcccttgtcctgctgggtctattggtggaatctgaacttgggttcagagtaggcaatttttcaaaagccctgtttcccaaatgtaaattccatcatcatcttgatcatgatggggttcactcctgggaaagggagtttttaaaaaagagagagagagagagct

SEQ ID NO: 29769 - DNA, 104 bp, Homo sapiens
aagagaaaagctttagagaagagtttagctgccaggggcttttttctgtaactcacagtgatgaggcaagggaaggctagcgcagaccaggagacaggcccccc

SEQ ID NO: 29770 - DNA, 122 bp, Homo sapiens
acatctcaattcaaatcaagcaatatagttcttataaagagttccaataaaacatttcagaagaaaaagtatgaaacaagctaaaagtaagtttcacttagaaaacttctcctcactcacac

SEQ ID NO: 29771 - DNA, 108 bp, Homo sapiens
ccgcgctcccatgtacgccttttactcgttgctcatctacatcttctacagcctcttccgcagggatggtggcgccgcggcggccgcggagcccggggaccccgccca

SEQ ID NO: 29772 - DNA, 102 bp, Homo sapiens
agttgagaacactaggttctgtgctatgttacctgtattcagtagaagtgtttctggagtcaggttttaagtcatgatcctgaagcttccttcccctcctca

SEQ ID NO: 29773 - DNA, 451 bp, Homo sapiens
  misc_feature 206: n=a, g, c or t
  misc_feature 315: n=a, g, c or t
  misc_feature 316: n=a, g, c or t
ctttaaaatagaatgatatatttctttggttatatacccagtaatgggattgctgggtccagtagtatttccaggtaggtgcactacataagtacttaccttccctcctccatctgctatttatcatttaataagtccagattttatagagctgttttaaaatatggcaaacctgtcttgccattgtgtttagttttgaaaatgcnttcctcctaactcattttctcttacattagtttaaaatactataataggaataatatgaattaaacaaatacagagggggtaaaaatcccactcacaattacttgtctnntatcaccctttgttgattacatttacactgcgaattgttattttcacattggtattattaatgtgcattttgaaactataacattaatttgatgaatcaaattttattagttcaggtcattatcttttttcccct

SEQ ID NO: 29774 - DNA, 271 bp, Homo sapiens
  misc_feature 3: y=c or t
ctytggtttgttttgttggtatataggattattttaggtggtacaagtctgtagcattgaatctcttttcagctgtcttagtccttctgattccatcaaagggaaagtttcagcttggtgctagtgtatgtttaacacctttttaaatatgtggtaaatctccctcttttattttttagacaggggctcactctatcacccaggctgaagtgcagtgaagtgctcactcatagctcactgcagccttgaactcctgggctcaagggatccc

SEQ ID NO: 29775 - DNA, 201 bp, Homo sapiens
ttatgttgaggaattaatgagcttctgccagctgaaagcttttgacagatagatgtttggttcctgaggcgatggggccatcacggtgcctaagtcagttacactaccatcttctagccttgaacattctgtgatctattctgaaagatatgacaatttctattctctaattttcttgcctagagtgtgacaggtgcaacg

SEQ ID NO: 29776 - DNA, 268 bp, Homo sapiens
cctgcaaaggatatgatctcattcttttttatggctgcatagtattccatgttgcatatgtaccatattttctttattcagtctatcattgttgggcatttgggttgattccgtttcttttctattatgaatactgctgccatgaacatacacctgaatgtgtctttataatagaaaaatttatattctgttcggtatatacccagtaatgggattgctgggtcaagtgatatttctgtctttaggtctctgaggaatcgccacaccc

SEQ ID NO: 29777 - DNA, 293 bp, Homo sapiens
ccagattagactctaaaattgtggccattggaatctcatttataaatggaccttttaagtatattaattcctcttcagaattgagctggacacatttggcattcttagtttgtcatataaccaggtttatccttagtctaactgcaagggatagaacctgccctaggtcacaatcattctgtccaatccagccaaggttccctccacatatgaagatggaccatggcaggatacaactgattgtgtggcaccatgtattagcagtgggaatatgtatcacatatgatgcagct

SEQ ID NO: 29778 - DNA, 365 bp, Homo sapiens
aaaatggatgtgatgggcaggtcacctccttttctgcagaagtgtacttgcatcaacaaatctttttcctctcaggttttgaggaaatgggatcaaacattccaacacagagaaataggaggcgtgggcagtagctctcctggatctctctctttccttgaggagatcaacttgtaaaagattacaaaatgtaccctaagtggtcctagagcaccctcctatcttctttcccaagcttgtcatgtggttgcagtggacatggaaagtaaacactgctataaacagagaataataaattgtaagaaagcaccagaatatccttcttgcttgaactttgaatcattagatccaaacattccccctca

SEQ ID NO: 29779 - DNA, 227 bp, Homo sapiens
  misc_feature 120: d=a or g or t
ctgtatgtcttctattaccctaagaccagagttattttggttggttgttttgttttattttttgtttttgtatccatggctggcactttactcattgcacttgagtttattgccccatadctaaaggatcaggatgatggtagaacggagatctgggtttcagagctttcccatttaagaaaaatagatcttgagattctgattcttttccaaacagtcccctgtta

SEQ ID NO: 29780 - DNA, 216 bp, Homo sapiens
tgttcaatttcagtatacagatatagtgatttcagaattgttaacctgtaccaccatggaaaacaactttatcaactagggtagagtgcctgtcttttctttctttagtcttacatattccactcatttccaaaggtcagcaccttattcctacgtcccctgtgatgaggttgtttcatacatttggaatatagttagactttttgtcgcagtctg

SEQ ID NO: 29781 - DNA, 332 bp, Homo sapiens
cactaatttttattttttgtttaagattgctgatatgctttattcacttttacaggccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttaggtatgatttttattgtcttaaccacttttctcccattttgccaaatggaaaagtaccagtaagtataatgaatccccccaa

SEQ ID NO: 29782 - DNA, 152 bp, Homo sapiens
ttcatgtgcttgctagccatctgtatatatcttccttggttaagtgaccattaagatcttttgcctattttatttattatttttttttagagttggggaggtcttgctgttgcctaagctggagtgcagcattgcaatcctagttcaccacc

SEQ ID NO: 29783 - DNA, 286 bp, Homo sapiens
cgagaccaacctagccaacatggtgaaacttcatgccgggcgtggtggcagacgcctgtaatcccagctacttgggaggctgaggcaggagaatcgcttgaacccgggaggcaaaggttgcattgagccgagattgtgccattgccctccagcatgggggacaagtatgagactctgtctcaaaagtaaataaataattaatttaattaattaaaataaaggtagtgtcagggtactcatacatagagaataacataaatgtatacatctcaaccttaccccgaat

SEQ ID NO: 29784 - DNA, 403 bp, Homo sapiens
  misc_feature 374: d=a or g or t
  misc_feature 375: n=a, g, c or t
  misc_feature 376: n=a, g, c or t
aattatcaaacactgtgaaattattattatttttccctttccccatagaatgtttcagaacaaagtcactaacacaacacacattcaagaagtgggggtcatgggccaagcaccatggctcatgcctgtaatcccagcactgttggaggctgagacaggcagatcatctgaggtcaggagttcgagaccagtctggccaacatggcgaaacctcatctctactaaaaatacaaaaattagctaggcacagtggtcgtgcctgtactcccagctactcgggaggctgaggcaggagaatcacttgaacctgggaggcagaagttgcggagagctgagatcacaccactgccctgcagcctgggcaacaaagcgadnntgcagactccatctcaaaaaaaaaaaa

SEQ ID NO: 29785 - DNA, 258 bp, Homo sapiens
  misc_feature 226: n=a, g, c or t
gacaaggtctgtgcttccagcctcccagacagctcctgcatccgtctgtgatagcgagggcttgggggaagacacgaaggcaggagaggcttacatcctctggatttccccgtcttatcccagaagacaaagccaggtgagggctggaagcgggctagggggatcaagctgcctccctcccttgtgtgccaggggtggtccccagaaggagctgatctgaacaggncggagagtaggaccggccgtcacaccccctgc

SEQ ID NO: 29786 - DNA, 301 bp, Homo sapiens
  misc_feature 76: w=a or t
  misc_feature 112: m=a or c
  misc_feature 151: s=g or c
  misc_feature 154: d=a or g or t
  misc_feature 165: r=a or g
  misc_feature 212: r=a or g
  misc_feature 213: r=a or g
  misc_feature 260: w=a or t
gcgccgtgggaactgcaagtgcagatatgggtgggtgaagtaagtggctcagggagggaaaggctgctcgtgcggwggaggaggaagctgagggtcgggtagatctgcccamggttgagggaaatgaaaaggtactgctaatgtgggcgascgdccagccctgaraggccatctgacgaagaggaaaagggatttgagtccggagggcgctrrcctgggtgcccaagcaaggaaagaaataatgaagagacacatgtgtwagctgcagccttttgaaacacgcaagaaggaaatcaatagt

SEQ ID NO: 29787 - DNA, 262 bp, Homo sapiens
  misc_feature 73: n=a, g, c or t
  misc_feature 147: k=g or t
  misc_feature 224: w=a or t
  misc_feature 229: d=a or g or t
  misc_feature 243: m=a or c
  misc_feature 244: w=a or t
agttaattcacagttacagataatgcttttatttacataaatataccaagtagtaccctcttattgtattcanttcatctattttcttagaatacttgcaattactaatgaccccttccctttccctcctgctgccctgtccaccckctttccccttctaacatccttagagggatgaaatctcagcatatgttgcaggacaccaaaaggaagaaaacaatcawgcaadtaaaataaacagtmwaacaaaccaggagtttaa

SEQ ID NO: 29788 - DNA, 321 bp, Homo sapiens
aaggagtctaagtcttcccctcgacctacagcagagaaaaagaaatataagtcaacaagtaaatcttcccagaaatcaagggaaatcatagaaacagatacctcatcctcagattcagatgaaagtgagagccttcctccttcctcacaaactcctaagtaccctgagagcaataggactcctgttaaaccctcctcagtggaggaagaagatagcttttttcggcaacgaatgttctctcctatggaagagaaggaacttctttcacccctcagtgagcctgatgacaggtacccacttattgtgaagattgacctgagc

SEQ ID NO: 29789 - DNA, 186 bp, Homo sapiens
atcccagctacttgggaggctgaggcagaagaatctcttgaacctggggtggggtggagattgcagtgagctaagatcacaccactgcactgcactccagactgcgcaacagagtgagactccgcctcaaaatatatacatataaaataaaataaaaaataaagcttatgagaaattaaccctccc

SEQ ID NO: 29790 - DNA, 348 bp, Homo sapiens
  misc_feature 156: m=a or c
  misc_feature 157: w=a or t
  misc_feature 166: s=g or c
  misc_feature 212: y=c or t
  misc_feature 307: r=a or g
  misc_feature 311: r=a or g
attagctgtgtgtagttgcccgggactaggagcttaagtgaagaggtacgccttgttcggtggaaatcagccgtagccatgagtttctgccggggctagccctagagtacggagcaggcggacttttcggttccccgccccgccaggtggcgggcmwaactaggcstccgggcatccccggtctcaagtaggcctcatctgccggcaagggygcccgaaacgcgggaggcgccatgtcgctggttgcttacgccagcagcgatgagagcgagccggatgaggctgagcccgagccggaggaaagagraggrcggtggctcctacatctgggcccgctttagggggctt

SEQ ID NO: 29791 - DNA, 260 bp, Homo sapiens
  misc_feature 15: k=g or t
cttaccttcatccgkagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagt

SEQ ID NO: 29792 - DNA, 142 bp, Homo sapiens
catttacaaacaaactgggctagacagcaccaggaggtagatggctcttgcaacaagacccatcatctgggtcagccagtgcaactattgacccgacactaggaagaccagaatactctcaaacctcttcacaccctggctc

SEQ ID NO: 29793 - DNA, 389 bp, Homo sapiens
  misc_feature 126: w=a or t
  misc_feature 150: r=a or g
  misc_feature 247: s=g or c
  misc_feature 307: y=c or t
  misc_feature 308: n=a, g, c or t
  misc_feature 348: m=a or c
atgcggtgaagggcgagcggcgcggcggctgcgatgagtgcctctgcggccaccggggtcttcgtgctgtccctctcggccatcccggtcacctatgtcttcaaccacctggcggcccagcatgawtcctgggactattgtaggggttgrctgccctcatcctgttcctggtagcactgctggctcgtgtcctcgtcaaaagaaaaccaccccgggacccactgttctatgtgtatgcagtttttgsatttaccagcgtggtgaacctcatcataggactggagcaagatggaatcattgacgggtynatgacacactacttgagagagggtgaaaccgtatctgaamaccgcatatgggcacatgatctgctactgggatggctctgc

SEQ ID NO: 29794 - DNA, 94 bp, Homo sapiens
aaaaaccaaacactgcatgttctcactcatagggggaagttgaacaataaaagcacatgcacacaggaaggggatcatcacacaccggggcctt

SEQ ID NO: 29795 - DNA, 262 bp, Homo sapiens
ctttaatatttaatgtgcaataattttaaatgcctcgtcctaattcatccaaaagcactttctatatacacaatcttatctgatcttaaaaaatttgaggtatatattttccagtccattttgtagaattaaggacctaaagcctaatgaagttggcaataaacagtgcagtgtggctgccaagagtttgctattagaaagtctgtgttcaggttccgccttgtgcatttggatcagctatttcacttttctaggcccttac

SEQ ID NO: 29796 - DNA, 258 bp, Homo sapiens
  misc_feature 125: y=c or t
  misc_feature 208: b=c or g or t
  misc_feature 210: y=c or t
ttaaagaaaaccgtccaaagataaactgcttcgggaaggcgctgcctccgctggcagcgctccgctcctcgccggatagggctggggagagacggttagggctcggattccagggaaaggactcytttaaaaaaagaagggggagaagaaagattgcaaccactccctgttggagaggcgtcaacagttcggtccccgcgagctgtcbcyaaatctcttaagttaacccctttcctttcctccccgctccgcctccga

SEQ ID NO: 29797 - DNA, 416 bp, Homo sapiens
  misc_feature 140: w=a or t
  misc_feature 398: y=c or t
caatggttgtaacagctaaggaagtgaatgtaatattgtcatacggtggaagcatgactttaatgctctactgagttgggggagaaatgggaagctggacctaattttccctgcttctgattttacttgctgtaggagawgccagtggcacctaggtgctttgctgctgttaacgctgctatagtattagaatagcagcagcttctgttgtggcagtgcaaaggcgaaaggtagctgaaggccctgaacagtcagggagctaacaaactgtagctcactgtccagcttctctaatagaagtctctggtggtttgttgagcctgtaagggcaaattcaacaatgtttgtgataaatatcagattgaaattatttgaggaagctttagttctgcaaagtyagtgttgtggcaaaggta

SEQ ID NO: 29798 - DNA, 168 bp, Homo sapiens
aattatatcgatacatgaatttaacttactttaatgtaggcaaactatcaattttttgtccattttcctgtttgttaaaataacatacctctcctacgtattattttcttgacccaaatgaaatattaacctaagggtcaagctgggagagagaaatgactgagaact

SEQ ID NO: 29799 - DNA, 385 bp, Homo sapiens
  misc_feature 32: s=g or c
  misc_feature 114: m=a or c
  misc_feature 134: w=a or t
  misc_feature 165: y=c or t
  misc_feature 183: n=a, g, c or t
  misc_feature 306: v=a or c or g
  misc_feature 319: m=a or c
  misc_feature 320: m=a or c
  misc_feature 333: m=a or c
  misc_feature 334: h=a or c or t
cctttgggctttggctctggactggagcgcasatccttcgaggctgcagccgccacggctgttgccgtaagcaatcctcctgcctcagcctcccgagtagctgggactcgggamcagcctccccgagtattggwcaggcctggtggcatcacgtttttcacatcyccgcatctggaccctgcncaagcgaaggctgatctaggcagtctcattgctggagatgactgtcagctgctttctctgcatagccaccatcacatgcctcaccactggagcctgggaagcctgaccacaaaccggcatctvcaaggcatgaatmmttaggtaggcatmhtggaaggcactcattgtaccctccaattgcataagcccattacggagctct

SEQ ID NO: 29800 - DNA, 171 bp, Homo sapiens
cacggttctggccaatggactcttgcaagaaaggcattaatccattcatgagagttacaccctcatgacccagtcacgtcttaaagaccccacctcttaataccgttacattggcaattacgttttccaacacgtgaactttgggggacatgttcaaaccacagcaccacc

SEQ ID NO: 29801 - DNA, 204 bp, Homo sapiens
tacttagcagagagaagtcaccagccacaaaccaatctttgagtttgcaggccctgattccagaatatatgcatccagctcccgggttctcagctggttttgcccacttccctttgactgtccaaatccaaagccagtctctcaagttgtaatggctcaaagagcagtgaccacaatgggtcatacagtagggacccacctcct

SEQ ID NO: 29802 - DNA, 410 bp, Homo sapiens
  misc_feature 125: r=a or g
  misc_feature 129: w=a or t
  misc_feature 339: n=a, g, c or t
  misc_feature 340: k=g or t
  misc_feature 343: y=c or t
  misc_feature 344: b=c or g or t
  misc_feature 349: n=a, g, c or t
  misc_feature 383: r=a or g
gatgaagctatgttggatgagatcagccttatggacctggccattgaagaaggctttaaccctgtgcaggcctcccagctggaggaggaatttgactctgactcaggcctttccttagactcggrgccwtagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgankaaybaaggnatccagctcagctctcatgcctgccctacctggragcacgtgggccacaaccacacataca

SEQ ID NO: 29803 - DNA, 447 bp, Homo sapiens
  misc_feature 136: w=a or t
cactccctcgtaagcattggaaggtcaaattattttgaagtgatttttttaaaaaaaagtcttctgtttattaacaggaaaatttatttatttgacaggattttgagtaatgtaggaataacaaaagggtaaaatwagcagcacatataatttttttttaatttatgatccattttgtatggtctcaaagttggatgacctcattactaatatttgttgtaaaagtgaaacttgtttgccaaccaataaacaactgattgagatttagaagatattgtattgatgtatgtactatatgattaatcagtctttttatttttctcgcctttctttctttctgttttcaatacataaactttgctaatcctctgtggcccaaatgagccatgcaaaagaaatcaatctgcctagatgaataagctaagcacaaaatcatacaggtttgca

SEQ ID NO: 29804 - DNA, 201 bp, Homo sapiens
  misc_feature 112: m=a or c
  misc_feature 123: r=a or g
  misc_feature 127: w=a or t
gttcacagacactgccagggaccagcttgtggaacgcagcaccttggcacccatcataggaggggaaactgaggccaggagtggggccgtctcctgcctggcacctcccggmaagtccccaargtgwgagactccatgccccgtctacccaggacccgggaaagctctcagccccagctggagggcctggctcccgacgtt

SEQ ID NO: 29805 - DNA, 191 bp, Homo sapiens
caaggtgtcatgttgaaagaacctgtttttaggcttttgaaagctcatataaacagggcttatcaccaataagaccgagtcactgttggaaggtccttaccaacagggggctcaacttcatgctgcccaaatttcgatgagtctcttttgaaagtacatacatctcaagccttgagattagagaagtgagg

SEQ ID NO: 29806 - DNA, 228 bp, Homo sapiens
agttcgaatgagaaaatgcattttaataaaatcccattgatttttgtggatgtaagtcaaggaacaggcacctaaagagtcttccatcccctgccgtctcccgcctctctcctgacctacaccggggcggtcatacatcgattggcttcctagataatagatcgtgccacccggtagggacctctggggacgcgccgggagctggaagagtcgcacgcagcagccctc

SEQ ID NO: 29807 - DNA, 79 bp, Homo sapiens
tcagaaatgttttgccacctgagacctatgaggaggtaagcatcatggtccaatctgtaattagtattgtggcggggtt

SEQ ID NO: 29808 - DNA, 59 bp, Homo sapiens
  misc_feature 6: w=a or t
  misc_feature 27: s=g or c
tctgtwagatgtggctgttttgcgtasatcgtgtgccacccctgcccctccccgatccc

SEQ ID NO: 29809 - DNA, 104 bp, Homo sapiens
tgttcactatgatggcatcttagaattaaacaaaacttttactagggctgaaaagagaagactgatttaatgtggtgtgattattctgaagataaatgtctggc

SEQ ID NO: 29810 - DNA, 316 bp, Homo sapiens
  misc_feature 114: w=a or t
gtcagtaacttgaaggaatcagccttattatccttcatttcgttagcttctaacaccattcagtgaacattcactaaatgctgtaggtttgctgatggcttcgtttacattctwaaaattttacatcttatccagtgtaaacattttagttaataatatctacattacttcatcttatacttatttactaacagtgtttagtgaaaggtcatctttactgtaaaatttccctccaaaaacaggggcttttatgcaagctgcagattgtttagcaccttcttaagagattttacacccctgttcctttcacccacca

SEQ ID NO: 29811 - DNA, 415 bp, Homo sapiens
  misc_feature 15: w=a or t
  misc_feature 16: w=a or t
  misc_feature 387: k=g or t
  misc_feature 388: r=a or g
cagcacttcaaggawwtagattggaagcaaaagaaggagggaaaagagtagagaggtcaggtggagttgagggagaggttctgccactgaaggaatgtttgtgatggttgtaacaccaagacacaggcacacagagacttattcaaaagatcatagaacactctcccctatgtcttacgaccccaccagcagtgttctgtgtaatagtagattacagttgaaatagctgtaagacaccaattctctcagaggagtacttagggaagtcctaagtcaagagcagaaacaaaagacactagaggaatttggcatttctggtgcctctagtaacagcaaaacattaaacaaagcccaattcctcatcagatttctgtaaaatagcattckraagctccatttacctcagtacttacta

SEQ ID NO: 29812 - DNA, 217 bp, Homo sapiens
atattttgggagtagtaagcattggtatggattagtaatatactggatgtggggatgcagaaaaaaatattaaaaattacttctgaaattctggctggaatagaagtgccacttaccaggtaaggaaggttggagacataacatatttgagggtgtggtcaaaagatgagtttgacattatgctatgtcatataaaagacatataaaagactaccaa

SEQ ID NO: 29813 - DNA, 217 bp, Homo sapiens
  misc_feature 15: d=a or g or t
  misc_feature 107: k=g or t
  misc_feature 112: y=c or t
  misc_feature 118: y=c or t
  misc_feature 121: h=a or c or t
  misc_feature 124: w=a or t
  misc_feature 150: w=a or t
  misc_feature 185: m=a or c
gtattaagaactcadatgtcaattagataacaggtagatatacaaaacatactatattcagcaaaggaatattattcagccataatatagaatgaacattgattcakcctayagcacyaghtgwagcacgatgcttctgaaagaaccggwcaaaaagtccacacgctgtgtgattccattcatamcaacgtccagactaggccagtccgtacagaca

SEQ ID NO: 29814 - DNA, 83 bp, Homo sapiens
  misc_feature 22: w=a or t
  misc_feature 26: y=c or t
  misc_feature 27: y=c or t
  misc_feature 47: w=a or t
  misc_feature 58: w=a or t
tacacgtgtattggaaatatcwagtyytttaaatttttaattaattwatttataattwactgtgtgttcccagctaactctat

SEQ ID NO: 29815 - DNA, 335 bp, Homo sapiens
  misc_feature 126: h=a or c or t
  misc_feature 129: w=a or t
ttacaggcatgagccaccatacatggtctatattataaacttcttaatttaaaaaaaattttaacttttataataacacagcttaaaacacacattgtacatatttacaaatttttctttcataghgtwactctgtaagctatgtctattttaatttttaatttttatttattattatttgagatggagtctcgctttgttgcccaggctggagtgcagtggtacagtctcaactcactgcaacctctgcctcccaggttcaagcgattctcctgcctcagcctccagagtagctgggattacaggcacttggccaccacgcccggctaattttt

SEQ ID NO: 29816 - DNA, 252 bp, Homo sapiens
catgggaatttgtatagtttagtaaataggtaaaaaagaaaaacaaaaacaaaaaccgtattgaagcttttttccatacaccctaatctttacaacttaattatttttttcccttttgatcctgggggaattcacccaaacttgccatcctgaaatggtctccagagtagagtgactcccagtagagtgaccaactatcccaatttgcctaaactgaggaagttccctggatgtgagagttttggggccagt

SEQ ID NO: 29817 - DNA, 331 bp, Homo sapiens
  misc_feature 119: w=a or t
  misc_feature 129: w=a or t
caaacacacctcattgtaaaccttgacctcctgggcacaagctatccttctgcctcacctcctgaatagctgggaccacagacatgtgccaccatgccctgctaatgtttttctttttwgttttttgtwttgttgttgttgttgttgttgttgtttagtttttgtagataaagggtcataccatgttatccaggctgatcttgaactcttgggctcaagcaatcctcccatctcagcctcccaaagtgcaaggattacaggcatgagccaccacatttggcttgtctctttaaaaagtcatccatcaacacctgtgaaaagaaggggggta

SEQ ID NO: 29818 - DNA, 256 bp, Homo sapiens
  misc_feature 93: m=a or c
  misc_feature 100: r=a or g
  misc_feature 107: y=c or t
  misc_feature 119: r=a or g
  misc_feature 120: m=a or c
  misc_feature 133: r=a or g
  misc_feature 134: m=a or c
  misc_feature 144: m=a or c
  misc_feature 148: m=a or c
  misc_feature 149: m=a or c
tttcaagcctggctactggattggtgtccgctatgatgagccactggggaaaaatgcatggcagtgtgaatgggaaacgctacttcgaatgcmaggccargtatggygcctttgtcaarmccagcagtcgtgrmggtgggggamttcmmggaaggaggactacgggttggacgagatatgacacctaaggaattcccctgcttcagctcctagctcagccactgactgcccctcctgtgtgtgcccatggccctgt

SEQ ID NO: 29819 - DNA, 185 bp, Homo sapiens
taaataaacagaaccaaaaggacctaactgtatatcaaattgatgacaaaatcttacagataaattaatcaatacacataatatttgaacacagtactctggtactttagtagatcatgtcctttttaaaaatcaaccttccccccttttagtggaatatattctaaggacaaaaagaactgcat

SEQ ID NO: 29820 - DNA, 104 bp, Homo sapiens
tatcacatgtagattcatgtaaccactaccactatcaagatacaaactgtttcatcacctggaaggaactcccctggtaccctttaaaattacacacccccata

SEQ ID NO: 29821 - DNA, 86 bp, Homo sapiens
  misc_feature 40: w=a or t
gtacaatattaatgcatgcgattccataatgcttagtgawctgtatgaatattactcaaagttatgttagtctttttttccgactt

SEQ ID NO: 29822 - DNA, 156 bp, Homo sapiens
  misc_feature 143: r=a or g
ttagcataaaattccagcgctggatgaatgcagatctagtttggtctgtggctagtttaaatatgtttctaaccacagagaatttcatatatatatacatatatatatacacatacatatatatatatatatgtatgtataaratttcacagggcg

SEQ ID NO: 29823 - DNA, 54 bp, Homo sapiens
attgtgagatcatgagtgacggaggggactgtgagtgtgtgcgtgaggttctat

SEQ ID NO: 29824 - DNA, 333 bp, Homo sapiens
  misc_feature 105: d=a or g or t
  misc_feature 128: w=a or t
  misc_feature 310: w=a or t
  misc_feature 311: r=a or g
  misc_feature 321: k=g or t
atacagtgctaggtttgggaattaaagtactatatctcaatgtcaaaataatcttgggcatgtatgtgaacaattggggactataccatgttcctcccctttaadgcacacttattcagaattgtgawcctttgtaaacgacttttcattggcatatctgtagcgttggttaatacagttggctccacattatctcaagtttaaattaattggactgttgtagtaaaacgactggaattattggaattgtttaagccagctgattgagattcacattcactttccaaaatactgctattttcttcaaggwrtttttttttkgacatctacttt

SEQ ID NO: 29825 - DNA, 103 bp, Homo sapiens
tgtatttttagtagagacgggggtttcaccatgttggccagggtggtctgaaactcctgacctcgtgatccgcctgcctcagcctcccaaagtgctgagatta

SEQ ID NO: 29826 - DNA, 145 bp, Homo sapiens
aatgaatattgtcggctttctagctcaaggtcctgtgtaggtgtgtgctcaacccagccacaggacaggttggaagtgctgagtggttaggactcagggacaaatctttaacccatgaaggattgcatttagagtttcagcaccc

SEQ ID NO: 29827 - DNA, 169 bp, Homo sapiens
  misc_feature 125: w=a or t
  misc_feature 127: k=g or t
  misc_feature 136: r=a or g
cagttgaacagtgaaattattttactcaagttatgttttatccaaaaataaccattttgacagttagcttgcagccaaatgtccaggtggtttagtttcgtttggatacacactgtaaaatgaawgktggaagccrgggctcaaaacagcctagggaattagggcctat

SEQ ID NO: 29828 - DNA, 177 bp, Homo sapiens
  misc_feature 157: s=g or c
agctgccattagaatcaaggtaatctctgggttctactaatgtaaacattttattgtttatttacacttatgcattttaaaagctaacttgtcctctctaccccttttttccattgttagtaaagtagataaaataaaaacaataaaaccttttatsattcagtttagtttttctac

SEQ ID NO: 29829 - DNA, 166 bp, Homo sapiens
  misc_feature 129: k=g or t
  misc_feature 140: k=g or t
  misc_feature 143: s=g or c
  misc_feature 149: w=a or t
  misc_feature 150: k=g or t
  misc_feature 151: w=a or t
agaacttctcccaagtaggagaaagcaatcaatcctggtttgttcagatggtcctggttttagcactgaaaatcctgcatcccaggaaaccgttctgccccatcaaaccaggatggttggtgattcggkttcttgatgckctsatggcwkwgattcatgggctcgg

SEQ ID NO: 29830 - DNA, 103 bp, Homo sapiens
ttcatttctggcattaggaaactcgtgcagggccactgaaaagtcaggggaggctcagatgttatttcccacggattcctgtttttccagaaacgttgtcacc

SEQ ID NO: 29831 - DNA, 157 bp, Homo sapiens
taatttcaaattccagttatttatgcaggcatataggaaggtgattgacttttgtatattaatcttgtatcatgcaacctcgctgtaattgcttattggtttcagtttttttgttcattcttttggaatttccacatcgacagttacgtcatctgca

SEQ ID NO: 29832 - DNA, 125 bp, Homo sapiens
taaatatttatcaagaacatgaaaatattttattttgtatttgcagtgcagtttggcacctctcttccaggccttcctaagtttttgttagttgtgtcttcgaatttattgtagttcaccgcgct

SEQ ID NO: 29833 - DNA, 200 bp, Homo sapiens
cacttttatattataacataagcctaaaataatacattgtgtttgttttacagtcctcatgatatgaatgaagttgggtatggtctaaatatttccagactatctttttatgctttttgtcattgaagaagagcattgtacaagaagcatttaacccttctctcaaattttgcgtcttcagaggcaaggactgctccacc

SEQ ID NO: 29834 - DNA, 183 bp, Homo sapiens
ctagattaaataatcactcaccaaaagaaagtgtcgtctaattgttagtggtttctatcacttgttttctttgatgcaggaagggttgtatttgaatggttctattaagttgatggattttacgctatcagtaagattctccagtgctggatgaaacgtgaaaaagtatatatagcaccggcc

SEQ ID NO: 29835 - DNA, 71 bp, Homo sapiens
taaaaaaaaaaattcttggccaggcgcggtggctcatgcctgtgatcccagcactttgggaggtagaggca

SEQ ID NO: 29836 - DNA, 398 bp, Homo sapiens
  misc_feature 119: m=a or c
  misc_feature 121: w=a or t
  misc_feature 124: w=a or t
  misc_feature 125: w=a or t
  misc_feature 130: k=g or t
  misc_feature 136: h=a or c or t
  misc_feature 138: s=g or c
  misc_feature 252: s=g or c
tgctaactcctttgccagtaaaattctgggaaacagggactgaggccacacatcatttccagtcatctgtgtgtttttaaggccagccacttgtccctgttgaggcctggctatggaamtwaawwccagkgtggghcsttgcctgtccttcaaaatcaacaacagattgtctctcggctccagggaggtgtcatttctatagaaattagaagctttctgatttctagatgaggttttacaattgtttcttasagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgc

SEQ ID NO: 29837 - DNA, 77 bp, Homo sapiens
  misc_feature 17: w=a or t
cattttttgtagagacwgctctcgctgtgttaccaggctggtctgaaactcctggcctaggtgatccccctgcctat

SEQ ID NO: 29838 - DNA, 204 bp, Homo sapiens
  misc_feature 127: s=g or c
caagtaagaaagaaatagcaagggtcttagatggattccctctgaaaaacgcaccacatttcgtgtggtaggtaaaagaaggtgctgactccggattcccaaactgactcagctgttttatcaaaascaaagcaaatcattctggaaagttattgggaacagggcaacagaggggcatcgaagaagaggcgcagaggggtggcg

SEQ ID NO: 29839 - DNA, 100 bp, Homo sapiens
  misc_feature 15: w=a or t
  misc_feature 16: w=a or t
  misc_feature 21: w=a or t
  misc_feature 95: w=a or t
cttatcaaacttccwwtattwtggaaaggagaaggccaagtaaggtaaagacttagtagatgttccagagtttattttataaggaagaggtgcawctctc

SEQ ID NO: 29840 - DNA, 239 bp, Homo sapiens
  misc_feature 115: m=a or c
  misc_feature 119: y=c or t
  misc_feature 129: r=a or g
tttttaccataaatatatttcagaactctcttccattaatgtagtcattgttttcaagctggtgcatattttgtttgtcttattaaaatgattgtgctaaaaataaacccatcamtgcytgattaggargtcccaaaatttaaaaactataaagattttgtaacttcaaaagacagaaaaataatgatttatggcaaaaattggcaaaatgtctgctggctaaatccagctcaccacct

SEQ ID NO: 29841 - DNA, 306 bp, Homo sapiens
  misc_feature 106: d=a or g or t
  misc_feature 130: r=a or g
  misc_feature 137: r=a or g
  misc_feature 142: m=a or c
  misc_feature 274: b=c or g or t
  misc_feature 275: d=a or g or t
catttcaaactactttacaagattgaaaacctttggtcaccatattgtgtgtgtattgttagttttttcactttgaggtactctgtaactggacttaagattactdacctgctaatagtactacttttgragacatrtaagmttacagataataataaatgtgactagtctcttggtagtaaaagtttgagtataaatcctcatttcttcctcggttctattttggttcattatgatgtatcttgtctcttcagattttcagttgttaagaaabdtttttctaacctgaatcacttggaacaaaaa

SEQ ID NO: 29842 - DNA, 94 bp, Homo sapiens
  misc_feature 43: m=a or c
agtcagtcggcgacagtctggtggtgggtgcggagtctgcggmcgttcccgcggcctcctcctcctccccgttcccttcacccccaccccgccc

SEQ ID NO: 29843 - DNA, 99 bp, Homo sapiens
ccagccatttgttaacagtccaggtgtatatcctttcatatttttattttcattatttaatacaaatggtatacaagatattctgtgtcttgctttcct

SEQ ID NO: 29844 - DNA, 204 bp, Homo sapiens
  misc_feature 116: y=c or t
  misc_feature 123: w=a or t
tgtgttcttttctgggttttgatgatgctgagctatgtttttgcaaggatcacacgtgcccatagcagggagaagcccctttgcgacttcaacatcttgacactctcagcagagcytcgctgwcgaagttgagagacttttgcgtttgttttggcagaagctgagtttcagtcctaggacggcctcagcacacttgatcccagt

SEQ ID NO: 29845 - DNA, 241 bp, Homo sapiens
tggataacagttgtatttaaaaatgcttattttagtagtatcttctttcataatttaattttatttccaaattggttcattagatgatacagaagcgttaaaacaacttatgtgttccaataatgttgaaagatgctaggaaaaacacttttagaataagaagaaacgtttcctaacaaaataaaacagtttattgaaaacataattaaccttgaatctctgcattctttgagtatacgac

SEQ ID NO: 29846 - DNA, 121 bp, Homo sapiens
  misc_feature 108: y=c or t
  misc_feature 121: m=a or c
tactgtttacttttatagaaaggtttgctgaccactgttctatacacatcctaggtttctttgataccttctctgccctgaagagatttatgttccttctgttggttyccaaagaccccam

SEQ ID NO: 29847 - DNA, 425 bp, Homo sapiens
  misc_feature 125: r=a or g
  misc_feature 371: w=a or t
  misc_feature 384: n=a, g, c or t
atatgagctttcttagatgtgccttacttgtcttgttgcttcttagtttgattgttatttttagcatactgataagtaaatagcacttacatagtgcctactttttgtcaggcaatgtcctaaargccttctatttttagtagagattatatgattttcataataaacatagcccatctggctttacatctttaacaaatttgtgtcatatcagtttttcagatttaagcacttttttgcttaacttgccaaacttaaaacaagtctagttgaaaaactttgtgagaaagaactgggcaaaatgtcagttgatttccacaagctagttttccttgtacacttacaaagaccataaaaattaaagaagtagwtgtcactatgtanggctgaaatgtttactaaacttcagggctcctattttgact

SEQ ID NO: 29848 - DNA, 241 bp, Homo sapiens
  misc_feature 104: w=a or t
cataatataaatatcaaaatgagtgttgttccattcaatagcatggctcttgttatactatgacactcacaacccaattttgaaagttcttccagagccacttwatgagccatcagtgaaaaggagagtcctcaattatgtttcagtcccaacacatttttgatgaagaatgtataagctctgctttgttcataccatgttctctacagtgggctttaaatgatttcaggctatttcctaa

SEQ ID NO: 29849 - DNA, 297 bp, Homo sapiens
  misc_feature 5: m=a or c
  misc_feature 57: m=a or c
  misc_feature 58: w=a or t
  misc_feature 125: y=c or t
  misc_feature 133: r=a or g
  misc_feature 137: r=a or g
  misc_feature 142: w=a or t
  misc_feature 191: b=c or g or t
  misc_feature 192: v=a or c or g
  misc_feature 200: m=a or c
  misc_feature 216: w=a or t
taaamaaagttctgacctttgtgataagagctgtgagtgaagtcaaagctgataggmwgctgggttcttgggtaatgaatcctgttacaacaaaagaaatgaaagcatgacaacttgggtaactyagggaaargaargccgwtttctccatttcatgtggacttcgtatcaggtggagcatttacttaaabvggtgccamgccacctttttctgtwctttccctgagtcatactgctgctgtaggatttaaatccctcgatggtgtgttgagactttgggcaaacatcacttgacca

SEQ ID NO: 29850 - DNA, 280 bp, Homo sapiens
  misc_feature 118: y=c or t
  misc_feature 122: r=a or g
  misc_feature 140: b=c or g or t
  misc_feature 210: b=c or g or t
  misc_feature 211: r=a or g
tttaatacagagtcccactctgcaacccaggctggagtgcagtggtatgatctcaggtcactgcaaactccatctcccaagttcaagtgattcttgtgcctcagcctctggagcagcygggractacaggcatgtgccabtatgaacggctaatttttgtctttttggtagagacagggttttgccatgttgactggtctcgaattcctbrcctcaagtgatctacccaccttggcctcccaaagtgctgggattacacgtgtgagccactgcccctcgc

SEQ ID NO: 29851 - DNA, 151 bp, Homo sapiens
tttttaaagaaataaagtagcttattttactagtggattgcttattttatatatagtatcataaactgacttaatctgctgaagatttcttttgaaatgttagataatgttgcttctaatttaaaatagaagtattccattttccccctgc

SEQ ID NO: 29852 - DNA, 78 bp, Homo sapiens
  misc_feature 4: y=c or t
  misc_feature 11: r=a or g
  misc_feature 49: y=c or t
cacyaattggrcataagcattcatatgttggacaagaggagaataagcyaatatgtcttccttctatcaatataaggc

SEQ ID NO: 29853 - DNA, 120 bp, Homo sapiens
  misc_feature 13: m=a or c
  misc_feature 16: y=c or t
  misc_feature 34: m=a or c
  misc_feature 67: m=a or c
cccaggttcaagmaaytctcctgccttggcctcmccagtagctgagactactggcccgcgccaccamccctggctaatttttgtatttttagtagagacggggtttcaccatgttggcca

SEQ ID NO: 29854 - DNA, 269 bp, Homo sapiens
attcctgatggacctcctagtgcctcctggacctaaggggcctccctcaatgtttcaagatgccaccaaggcagggatcagctcgtgcattcctgagaacatccacgatgaagtgaggctctggaaaaatgcaagagtttccacataatcccaaaaaaccctaaaggtgaactggatgccacagaaagaggagtggtctttgtcacaacaaaatcaacaaaattatttcgaagtcaattaggaaactcagaaatcactcttgctgccaa

SEQ ID NO: 29855 - DNA, 202 bp, Homo sapiens
  misc_feature 173: m=a or c
  misc_feature 189: r=a or g
  misc_feature 197: m=a or c
aatgtctctctatccacagagaaactagtattacttgaagatgtgaaagttcctgtggtagccataccttgaagcacagtgtttgtacataagtaaatatcttgattctaaattaaatccagatttaactaatatatattattttatatctttgttgtattaaaatgtttaamaacactaaaaataaarcatttgamagtct

SEQ ID NO: 29856 - DNA, 372 bp, Homo sapiens
gccaagttcagttcaaatattatcttatttagttccccaaacagtccttagagataggcatgatcttgcccattttacagggaagtatgctgaagtttagaaagagtacatgacttgcccagggtgagccactggactcttgccagaactacggtgcaagccccattgtgtggctgcagattgtagtctgttaaccggaccctccactgcccttgctgtgtgaagagtaactctatgaatgaacatagtgagttttttattttgtttagaagaaatacataagaaccagccaagcctggtagctgaggccactttctgggttggaaacatttctaggctttagcttaatcagaagtaaaacagagaggagcg

SEQ ID NO: 29857 - DNA, 106 bp, Homo sapiens
  misc_feature 24: v=a or c or g
  misc_feature 46: m=a or c
  misc_feature 90: s=g or c
acttttgttcgcctctcttcggcvctctactcaagagctccgtctmcgtctcgccctcctcgaagtcctcgtcgcgcgcccgcgacccasgtcgccctgaaatcta

SEQ ID NO: 29858 - DNA, 269 bp, Homo sapiens
  misc_feature 68: y=c or t
  misc_feature 127: k=g or t
caaattgtaattctcagtgttgcaggaggggccaggtgggaagtgattggatcaccggtggggcggayttcccctttgctgttctcatgatagtgagttctcatgagatctgtttgtttaaaagtgkgtaacacttcccccttcactctctttcttcttctctggccatataagacatgcctgcttccccttcaccttctgccatggttgtaagtttcctgaagcctcccagtcatgcttcctgtatagcctgcagaactgtgactcgt

SEQ ID NO: 29859 - DNA, 186 bp, Homo sapiens
  misc_feature 141: w=a or t
agttggctgaatcttagactaattaatggacatatatcatctgctatccttgtaatcccctattttaactgcttggccttctgaattttgtttcatttacttgttacactgcatcaaagttgtgccctgtagatctttttwgaaatattttctcttaatatattaaatttttatattttccgactc

SEQ ID NO: 29860 - DNA, 124 bp, Homo sapiens
aaatatagatcattcagtaaaaattgtagcagtctgcaacaaaaacataaaattactgttggattgttatcttgagccacacaccagcatagattacaaacaaatcaaagcttataatgtaaaa

SEQ ID NO: 29861 - DNA, 95 bp, Homo sapiens
tgttcgcatttccatatacgtttttaaaatcaggttgtcaatttctagaaaacatgcttgttgggattttgatattgagttaaatttgtagatga

SEQ ID NO: 29862 - DNA, 155 bp, Homo sapiens
  misc_feature 116: w=a or t
  misc_feature 126: m=a or c
cattatttaatgaatctcagagtggctcttttctcccattttacatagatgaagaaattgaggtttagaaaggctaagttgagctaatacatggcagaagtagaactagaatctawgtcttctgamccaagattctttgaaactataccacgtac

SEQ ID NO: 29863 - DNA, 244 bp, Homo sapiens
aacaatgcagtaacttcattcctatacagacttctttgcatttaggtgtttttgcatttaggtgtttttccctaaactgacataaagaagtagaattgctggatcagagaatgtgcagagttaaaattttgataaatgcattgaaaacctttcaagaaaaattataccaattgacatccctaccaacgcagtatgaggaaacgcattcctcgtgtcctcccaaccatgacttatcctgcatgcg

SEQ ID NO: 29864 - DNA, 121 bp, Homo sapiens
attgtttcttgtagaaacatgcgggaagacattttttgctcatttctttgtacttccaaaaaaaaaggaaaaaaaagacaaaagcaagtccccccgtaccccagaaagcagagaaggcgtc

SEQ ID NO: 29865 - DNA, 260 bp, Homo sapiens
tcacagttacttctaaaccagatttcatttcttttattgttttatgtgccaaaccacgaagtgcattgggcttcaatctctgaacactgtagacccattagaagactgttccgattgttacaaattgtagtgcctgaaaacactcttaagctgattgtcttaacaaaatgaaagttctccaaagacaaaacagaacaattattataataaaataattatggttgaaatgtctgtggttccttggaaatgctgcgctcttc

SEQ ID NO: 29866 - DNA, 252 bp, Homo sapiens
aagaaaaatgcggatgcctacagttaacagattgcaaaatgtatcttaaaatggttctaaaaattgcattcaaacataatttacataggaaatgtactgtgggaactattctatggatatatggtaaagttgttttggacttgtttttgctcagcatgaagttttatatgctgcattttactaattccatatttaaccatatttttaatacaaaagaacattagagtatagatcatgtgaaatgaagggcgc

SEQ ID NO: 29867 - DNA, 205 bp, Homo sapiens
  misc_feature 129: r=a or g
  misc_feature 130: r=a or g
  misc_feature 136: k=g or t
  misc_feature 139: y=c or t
tgtaaaaaaagattacgttttcattttttgatttctaattgaaatttagaacttctattttgaatgtaggtaacaaaccacagaagcactagaagtttttgtgactttgtcaccaataaatacctcagrrcatttkcaygttacttgtaggtatcataaaatatcacacttgtcaccaccttgaaaatatagtagacttgcacat

SEQ ID NO: 29868 - DNA, 180 bp, Homo sapiens
tatggctctatttaagacagcataggcccaactggcagaagtaggtgatggctggatattgagaaataatgttttctttgcatgatccttaaggaagctgacctggttacaactcatgaattgggacataattttggagcagaacatgatccggatggtctagcagaatgtgccccggta

SEQ ID NO: 29869 - DNA, 438 bp, Homo sapiens
ttttcttttttttgagatgtagtcgcgctctgttgcccaggccagagtgcagtggcgcagtctcggctcactgcaacctccgcctctcaggttcaagcgattcttctgccttggcctcccaagtggctggggactacaggtgcgtgccaccatacctggctagtttttgtatttttagtagagacgggatttcaccatattggccaggctggtctcgaactcccgatctcgtgatctgcccgccttggcctcccaaagtgttgggattataggcgggagccaccgcacccagtctaattattttctttagaggaactggttattatttagtcaaaacttgctatcaaaatagtttttcatccaagtttaatgataaaaataacagatatccattgtctgttttctgtcttgtctgcttttacagtgcctcaatttcct

SEQ ID NO: 29870 - DNA, 252 bp, Homo sapiens
ttgaaaagaatctggtttaaatggcattgtggtccgaggtagctgctctccccactgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggccc

SEQ ID NO: 29871 - DNA, 342 bp, Homo sapiens
  misc_feature 229: d=a or g or t
cctacattctcggccaggaggaaggcactgctacatacccagtcttccccagcagagcctgagcagctctgttttccttctacttcccctcttctttcacatctcatgaccaagcacttcctattctgtctcccaaatgatcacagactttttcctccacttttgtcactgccactgcccttagcattactctgcctttagagaaagtctcttaattggtttggttgcdtccttcagtctttattatacagaccactacacgcacatctgacagagacttttcacctttttatggttgaatgactgaaattcccagaataaaattaaaaccaccccagcgca

SEQ ID NO: 29872 - DNA, 177 bp, Homo sapiens
taaccatttcccaaggaaccatttgattaataatactaaaaaagaatggtcatacagtatcacttatgatcttcttgggtcaggttccatagaagcagagcctgagatggtggaggtccttgtggagatgatatactgaaggataactcccaggagaagggagcaagggaagcagct

SEQ ID NO: 29873 - DNA, 129 bp, Homo sapiens
  misc_feature 56: r=a or g
catcccacgatcggccttggtaaccgccgcggtagatcatttttatcccgccaggragtgtgatgcaggaagaccacatgcgctcctggcttttaaacctgttcctgactgttctcttactgccgaacg

SEQ ID NO: 29874 - DNA, 143 bp, Homo sapiens
  misc_feature 121: m=a or c
tagtttggatggaaaatacctgcttgaaattttaaaaatgatttctttagtgcatctatttagctagtttctgataggtggtatgtaatattttccctttttctttccttctgtagacacmaataagtcattctccctcttct

SEQ ID NO: 29875 - DNA, 367 bp, Homo sapiens
  misc_feature 304: n=a, g, c or t
  misc_feature 305: n=a, g, c or t
  misc_feature 322: m=a or c
acagttgagttgatagaaataggtctctttgctagtcacatttacgagtgtattttgggatgaacactttttcttaaatgactgagaatgtcaagttaaatcaagttaatttgacttcttaaaatgctttatgcacattatatttctgttaatgcttcactagtcactgtcgctgtcctggagctgattgaaattggtcagtttcccataagagcaaatggtttttggtttcctttttcagggaaatagatttctgtgatgaaagaagtgaagtataataaaaccctcatgctttgacctggcnntcaccgaagcatgattmagattctttttttgaggccaatatacttagacatgtaagggcttt

SEQ ID NO: 29876 - DNA, 130 bp, Homo sapiens
aaggaatggagggaatccaatatttctgcctctgacataatttgggagaacctaactgtgtcagaatgcaaatcattgcatggagagtatgttggacgggcctgtggccatgatcacccatatgttccca

SEQ ID NO: 29877 - DNA, 302 bp, Homo sapiens
ttttaacatgttcataattaaaagtattttccagcagtccaaagatgtaagttatcttacacataaaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggatgatgaacctgcttatacctaagggcaggagcaagcccctcga

SEQ ID NO: 29878 - DNA, 150 bp, Homo sapiens
  misc_feature 105: k=g or t
cattctaaatcaaactgcatccctgcctattaggcctctgaatcagttcctacgcagttggatggcaaagacaataaacaagagccatctaagacatggaatgtkattatgacctatttgttaaagaaagtaagaaatttccctgatgac

SEQ ID NO: 29879 - DNA, 121 bp, Homo sapiens
ctggtaattttaggtaaaatccaagtagtcaatttcaaaaactggaagatttttgcttttgggtaatgattatcaataattcccacaaaatcagcaagaccaatctgccctgcaccagagt

SEQ ID NO: 29880 - DNA, 315 bp, Homo sapiens
tgctgtggttttgccctggtcttcagttcttggccagatggtcagcatgtgtgtttctcaggtcggcgcgtcatcacatagtcgtagcggctgagcccacacgccgtggcttgagggactatctggtaataaaatatcaaaaggaaacttcaaaggaacatctgatcacatggtggcctgttaaaacctataccaagtaattcctgaagatttggaagaatggattatgatccttcacagtaaaaacaaaatacaggaagataacacagcaatcataattaacagaaagaaagaaattcaacctctccaatgaat

SEQ ID NO: 29881 - DNA, 364 bp, Homo sapiens
aacatgaaaatagattttcttttccctatcagttaaggaaggcttctctttaacacaaatgaccactgtcttttgcttggtctccacttctttaagggaaatatctttggaaatggcaatccatgggaacgtttcacaaatactctgtcatcgcttatgtttcttgaaccacctaggtctgtacttgagttcatactctatctggtagttgagcgcttaggagtgcttagctaaatagatgctctgttgtttgaaaagtccacctacccctatttctgtggcgggctggtcactgttttgtgtctatgttttacactgactgtgccatctctaatgttctccaattcctggacttttaggatca

SEQ ID NO: 29882 - DNA, 117 bp, Homo sapiens
tattaaattcatcatctgcttctatatgtctatatatttggcattatataaacaatcgattttcttctaaaaatcgccttcatggttgtttttctttggtgattctcaaccctacca

SEQ ID NO: 29883 - DNA, 83 bp, Homo sapiens
caaaaactgatagaactgaagggagaaataagcaattcaacaatattaggcagagatttaaatactctactttttctttttct

SEQ ID NO: 29884 - DNA, 167 bp, Homo sapiens
  misc_feature 15: k=g or t
  misc_feature 114: s=g or c
aaccccatctctackaaaaatacaaaaaattagccgggcgtggtggcaggcgcctgtagtcccagctacctgggaggctgaggcaggagaatggcgtgaacccgggaggcggasttgccagtgatccgagatggcgccaccgtactccagcctgggcaacagagcga

SEQ ID NO: 29885 - DNA, 137 bp, Homo sapiens
  misc_feature 129: m=a or c
  misc_feature 130: m=a or c
cagatgctgtagaagggtcaaggagaatgaggcctgaaaggaggcctttgtggtttgcatttatgagatcagtaattaatcctgagagaactctgaccatgggatgtttggaatggaagccagattgammaggggca

SEQ ID NO: 29886 - DNA, 425 bp, Homo sapiens
  misc_feature 199: r=a or g
  misc_feature 200: k=g or t
  misc_feature 299: n=a, g, c or t
  misc_feature 300: n=a, g, c or t
  misc_feature 301: n=a, g, c or t
  misc_feature 392: w=a or t
taagctggcttgggatactgttgtggagaggggtgatcatttaggttggttggacaggaagtcctctccacaacaaaatagtattggggcaaatacttggatgaggtgacagcatgagccattttcatacctggagccattttcatacctggagggaaggagttacaagcagagggaacagtgtgcacaggtctgaggrkgaagcacacctacatgtcttgagtggaatgagaacgtggaaacatgtagaagatgctgtcagaggagtgaccaaatcaggttctcctaggccatggttnnngatttgtgtttttattcttagtgacataggaggcattagcgagttttgagcatagctgtgctataatatgacaggtaaaatgatctgtctwgttactatgtggagaacaaacaggtgggggtat

SEQ ID NO: 29887 - DNA, 123 bp, Homo sapiens
accatcataagctgcagactgtgcattttatattgaaaagttaatatttttaatttttaatgcagagaagtacccaaagcataaaaacacaacacgttttcacaaagcgaacacagccatgga

SEQ ID NO: 29888 - DNA, 223 bp, Homo sapiens
ttttcttatttctcatttgttaaaaaaaaacaggaggggccaagcgctgtggctcatgcctgtgatcccagtactttgggaggccaaggtggggtggaggtcgggagttcgagaccagcctggccggcatggaggagtcccatctctactaaaaatacagaattagccaagtatggtggcccatgcctgtaattccagccacttgggaggctgagggaggatt

SEQ ID NO: 29889 - DNA, 141 bp, Homo sapiens
  misc_feature 126: r=a or g
  misc_feature 136: m=a or c
cgccctcctaattgttgtattttagtagagacaggatttcaccatgttggccaggctggtctcgatctcctgacctcattatctgcacacgtcggcctcccaaagtactgagattacaggcgtgarcaactgcggmggccc

SEQ ID NO: 29890 - DNA, 204 bp, Homo sapiens
  misc_feature 14: r=a or g
  misc_feature 15: r=a or g
  misc_feature 193: w=a or t
ttacaaagatctarracagtgaaattaatccaaagttgctcaaagaagctctaaaatctcaagcccatgtatacgagtgccagtattgccagcccacctatatgctgggaataacattagaagccacactctcttctacacacaaattcctcctctctgagtttaaaaaaataccagtattatttcgcatccwaaatcattcaa

SEQ ID NO: 29891 - DNA, 230 bp, Homo sapiens
  misc_feature 15: b=c or g or t
  misc_feature 132: b=c or g or t
  misc_feature 149: n=a, g, c or t
cctcgcagccgtagbtgcagccgcagcagatctgccagcccctccaccgctgtcaaggtcaggagaccgtccccaaaccgctccaagctgtccaatgtggcgcgcaaggctgccctcttgtcccggttcagbgattcctattcccaggnccgcctggacgcgcagtgcctgctgcggcgctgcatcgacaaggctgagaccgttcagcggatcatctacatcgccacagt

SEQ ID NO: 29892 - DNA, 423 bp, Homo sapiens
  misc_feature 341: n=a, g, c or t
atgatggattctggagtatagggtgtccttttaggaaggcacttagatttctccacattcaattaaaatttcaccctaaaatgtgctaaaatttcagcactcagccagccagagctcacccagctgggctggttctggtggctttgagctttgtctctgtcgtggagccgcctcctggcagtgacactgagaggccaaggctgggagggaccagtgcttggtgtgatcagctcctgccccgagtccaggtgttgggccgctgtctgctgtgcctgtgccttgtactaaatgagtgctttaccaaaagggcgggcaagagaggctgagtgagcctgacacangtgtcagtggtaacatttcctgattctcgcgggcttggtccccagagacaaagcaggtctagttcacagcaccccaggctga

SEQ ID NO: 29893 - DNA, 346 bp, Homo sapiens
  misc_feature 119: r=a or g
  misc_feature 146: w=a or t
  misc_feature 155: k=g or t
  misc_feature 156: v=a or c or g
  misc_feature 163: w=a or t
  misc_feature 223: n=a, g, c or t
  misc_feature 274: b=c or g or t
  misc_feature 275: n=a, g, c or t
  misc_feature 276: n=a, g, c or t
  misc_feature 277: n=a, g, c or t
  misc_feature 310: m=a or c
  misc_feature 311: w=a or t
  misc_feature 335: r=a or g
  misc_feature 336: w=a or t
cattttgttttttagacagagtcttgctctgtcagcaggctggagtgcagtggggcgatatcggcccactgcaacctctgcctcccaggttcaagcaattctcctgcctcagcctcctrggtagctgggattacaggtgcacaccwctaagcctkvctaattwttgtatttttagtagagacggggtttcaccgtgttgaccaggctggtctcgaactcctgncctcaggtgatctgcccgcctcggcctcccaaagtgctgggattccaggtbnnngccaccatgcccacctatcctttaataacagamwattagggagactaaataagacatrwaacccaaagc

SEQ ID NO: 29894 - DNA, 304 bp, Homo sapiens
  misc_feature 230: m=a or c
  misc_feature 231: n=a, g, c or t
  misc_feature 268: w=a or t
agataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtgagccagamnaaaaaataaaactctcattatttgtgtggctaattawaattcagcgttatttaagcacataaagaccaaaaaa

SEQ ID NO: 29895 - DNA, 271 bp, Homo sapiens
  misc_feature 127: k=g or t
  misc_feature 128: y=c or t
  misc_feature 140: r=a or g
  misc_feature 141: k=g or t
ctttttcagaaaatatgttttcctgaatttctgatgaccctcttgtttagaacaatatattagggaaaaaagtggattgaactaagttagatttacagtgaagttttccagtgtacaaacatatatkyttatatttatarkcagtaaatgtatacttaatcagctttttttcacttgatattttcttgcatcccaaaactaatgacacttgatcaggccactagctttcacctaactgctctcacctgatccaaacttgattccctgcttc

SEQ ID NO: 29896 - DNA, 370 bp, Homo sapiens
  misc_feature 182: y=c or t
  misc_feature 184: n=a, g, c or t
  misc_feature 349: y=c or t
  misc_feature 350: m=a or c
tgaaggagtatagggagatggattaagttgataatgacatttagggcaacttaagacctttgatcccaggttctaactcaaagaggctgaccttcccccagctaagatagcatgaggacgttgtattccaatatacgtatgattggggctacaaagctgaactaaagcaagattggtgaagygncagggtttatagagagaagcccaggctgagttcagcttttgttggaagtgagaatccctgacatatagctttcttggagatcccaactctcattcttggtgcaactggcttccagctctccagcagtcactctcctaggtgcatgattcagtgcgtgccatgtgymattagcttttactgataacc

SEQ ID NO: 29897 - DNA, 157 bp, Homo sapiens
  misc_feature 104: r=a or g
  misc_feature 125: w=a or t
  misc_feature 140: n=a, g, c or t
  misc_feature 141: w=a or t
  misc_feature 145: d=a or g or t
  misc_feature 149: w=a or t
  misc_feature 157: k=g or t
cagcacaatgcccataaaagtattgactgtttatcccagataaaatcttatgttcacataaaaacctgcacataaatgttcataacagctttatttgtaacagrcaaaactggaaacccagatgwcctttcaatagatgnwtgadaaawcacaccak

SEQ ID NO: 29898 - DNA, 79 bp, Homo sapiens
  misc_feature 78: d=a or g or t
  misc_feature 79: v=a or c or g
cataaagttactgtcactcttcgacagacattcccaaatattggttttatgagtcctaacggctcctaggcagccggdv

SEQ ID NO: 29899 - DNA, 229 bp, Homo sapiens
gtttttctgttaatgatgctaatgtgttgtaaacaagattctaaatttaaaaaggaaaacaaaacaaacttgttctttgcagcttatcaccttgtgaatgtcggtaacttacttttccataatattgcaaataacataaaatcttaaaataattccaagctgagtcttctagattgagcagaaatggtgaaaggagtattgataacttggcgtatgtgatgggccccaa

SEQ ID NO: 29900 - DNA, 447 bp, Homo sapiens
  misc_feature 130: h=a or c or t
  misc_feature 241: b=c or g or t
  misc_feature 242: n=a, g, c or t
  misc_feature 349: r=a or g
  misc_feature 366: n=a, g, c or t
  misc_feature 367: n=a, g, c or t
  misc_feature 368: b=c or g or t
  misc_feature 379: w=a or t
  misc_feature 398: r=a or g
  misc_feature 447: w=a or t
gcagatcgtacactccagacccgcttctcacaactctgtcaatttccactcattgctgagcttggtttaggatctgtttttttcttcctgggacgatacaaaaagatccatccagccttccctttatgghaggcactctgcaaatgcaacttaccaaacctaggggaagctgtcagccttggtttctttctccctattgagttcctttctctccagttccatctcagaggtaaggtgcatbnttgactctccacaggagagtatagattgttagccattggatggatgggtgaatggatgggtagttgggtggccaggtgagtagatacataggacactcaggcactarcctgtttactgctctgnnbctagtaagtawggtttgggaggccaaggaracagttacttaccactggttttatgtacatcataatgttctttgagtaw

SEQ ID NO: 29901 - DNA, 256 bp, Homo sapiens
gtctttctcaaggcacgaactgagctgatccttgccccaggctggagtgcaatggcgtgatctcagctcactgcaacctccaccttccgggttcaagcgattctcctgcctcagcctcccgagtagctgggattacaggcgcctgccaccacgcccggcaatttttttgtatttttagtagaaatggggtttcaccatgttggccaggctggtcttgaactcctgacctcaggtgatccaccctccttggcctcac

SEQ ID NO: 29902 - DNA, 185 bp, Homo sapiens
  misc_feature 154: k=g or t
  misc_feature 161: k=g or t
  misc_feature 175: n=a, g, c or t
  misc_feature 182: s=g or c
taggtcatatatatagatatagatctatctatatatatagatctatatctatgtctatatatatctagagaatcactagtgaaggtcacaacctcgagacagcccaccaaagaactgagattaaatcataagattataaaatacttcttctcckgcacackgtaccaccgcgccncagggcscat

SEQ ID NO: 29903 - DNA, 202 bp, Homo sapiens
aattgtgaagatttcatggacatttatcacttccctaatcaatactcttataatttcctatgcctatctttactttaatctcttaatcccgtcatcttcgtaagctgagggtatgtcgcctcaggacactgtgatgattgcgttaactacacaaattgtttgtaaagcatctgtgtttaaacaatatgaaatctgggcagcg

SEQ ID NO: 29904 - DNA, 201 bp, Homo sapiens
  misc_feature 37: y=c or t
tacttttaaaaagattagcttggcaacaagtctagcytgaaatgggtgctattttgactagtctgagtgaaaagtgaggatttaaatgaagtaacccctaaactcagccagtcccatgtttttttaacacttggaatatctaattccatttacactgcattcttcaaatgtaattttcaaagatgccttttgcctcatccg

SEQ ID NO: 29905 - DNA, 201 bp, Homo sapiens
  misc_feature 141: w=a or t
  misc_feature 148: r=a or g
  misc_feature 151: y=c or t
  misc_feature 164: r=a or g
aagaagaactaactatcctaaatttatatgcacccaatacatgagaacccagattcataaagcaagttcttagagacctacaaagagacttagactccctcacgataatactggaagactttaacaccccactgtcaatawtagacargaycaatgagacagaraattaacaaggctattcaggacttgaactcagctctg

SEQ ID NO: 29906 - DNA, 195 bp, Homo sapiens
  misc_feature 140: r=a or g
agactcaaggctgactaaactggaggctgaataccgtggaggtccacatgcagcttccctggagggcaggccggagggctcccgcccctgggcttgaggatgctgcaccccgtgggcttccaggcctgcccagatgatgrccttcaggcctctgtccctggcggccatcctcaaggccgattttgaccagctgtg

SEQ ID NO: 29907 - DNA, 205 bp, Homo sapiens
  misc_feature 135: r=a or g
  misc_feature 142: m=a or c
  misc_feature 145: r=a or g
  misc_feature 149: m=a or c
  misc_feature 166: m=a or c
  misc_feature 172: r=a or g
  misc_feature 201: k=g or t
taggtattagtctctacagttaagtacatttacttcagatatttgtaaaaatataaaatcgattttttagtattaaaaattaaggtatactggccaggcgtggtggctctgcctgtaatcccagcactttgcgargcgaggmggraggmtcatgagggtcaggagmtcaggrccatcctggctagcatggtgacaccccakccca

SEQ ID NO: 29908 - DNA, 186 bp, Homo sapiens
cattggacattctcttgtgcacagagcccatttgccgggaaatatttctgaatacatgttgtcttccctttatagtaagacattgtcactcaataataatatgcaagataacttcgtgatagtaattgttgttttgtctttgtaattacagacatatcaagtggatttgaagcccaatgggtcagc

SEQ ID NO: 29909 - DNA, 205 bp, Homo sapiens
  misc_feature 188: r=a or g
  misc_feature 189: n=a, g, c or t
tattttacaggggagaacactgaggcacaaggaagttaagtaacttccctaagttagtattaagtattgtaataagtattggaaccaggatttatctctttctggaacctataactattgttttaactgccttctgattttttcttaattcataaaagattggtatggaaaactatgctaatttattrncttaaaagggagtgcc

SEQ ID NO: 29910 - DNA, 83 bp, Homo sapiens
atgagtaacaacaacaaaaacttaaattattcttaagtattgaaaattaaaccacacacttctaaataacccatgaaaaacag

SEQ ID NO: 29911 - DNA, 420 bp, Homo sapiens
  misc_feature 282: n=a, g, c or t
  misc_feature 283: n=a, g, c or t
caaatatgactctccttagctttcttcatttttatctcggactacctgtagcatcaaatcctttctcctctttctatttcaaagggggtggggtggagaaggtggttttctttttctagaggctgaacatgtgggcttgaatttgggtacttccccgctctggaatgatactggatcctgtgttaagaatctttactgaatctttgatcttgccctctccactgggcccttttcacttctgaatacacacattttggtttacctgctcctaggttaatatannaaaccaacaagcaaaccaaactcctaccacttattcaacatatcttttctgtgttctttttgttgttgttagttttttttagcactaaacttcttaaaagtagacctcacttgctttcacttcttcatgcttctcaa

SEQ ID NO: 29912 - DNA, 229 bp, Homo sapiens
  misc_feature 152: n=a, g, c or t
ccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataatanataatgcttaataaactagagatatgagatgtgtaggaaatttggttaaacttttttcagatactttctggcccaat

SEQ ID NO: 29913 - DNA, 110 bp, Homo sapiens
cacaaatgctattggctgattatagggttgtttaaattgtttgtttcctatggaggaaaaatggcaagaaaatgtgttaacatttccagtagtttttttttttttttttt

SEQ ID NO: 29914 - DNA, 443 bp, Homo sapiens
  misc_feature 284: n=a, g, c or t
  misc_feature 285: n=a, g, c or t
  misc_feature 363: n=a, g, c or t
  misc_feature 364: y=c or t
ttttgagctttaatctttgttttcctctttcttcaagccattgttgcttgacattatttttcctgtgccttggaggagaaagtctattctaagtttaggcttaaagacaggaagctgttgtgggagccattgctcctaaatctttcctgtcagccactgcatctcccataccaaactgtcccagagaactattttgccaagcttgtgtcatactagttagctgcactcagcaccaggaaaagtctcatatgccttccaggcatagggtaatgtaaatatgaagnngccttcaaaaaaatcactgagagaatggaatgactgcttcaaataagaatgatgaaaataataattggaggtgcaagnyaggcaagatcatgattcatttcatttctctggaaggaagtgtctggagactctctttaagaggaggcgggggatccact

SEQ ID NO: 29915 - DNA, 440 bp, Homo sapiens
  misc_feature 160: n=a, g, c or t
  misc_feature 386: n=a, g, c or t
  misc_feature 387: n=a, g, c or t
  misc_feature 388: n=a, g, c or t
gatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaganacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggaannnctggattcagccagtgcggattttccatataatccaggacaaggcaagctat

SEQ ID NO: 29916 - DNA, 443 bp, Homo sapiens
  misc_feature 180: n=a, g, c or t
  misc_feature 389: n=a, g, c or t
  misc_feature 390: k=g or t
  misc_feature 437: w=a or t
  misc_feature 443: w=a or t
tgacacatgctgattcagcctcacgtgcacatctttggaatgtgggggagactggaacacttggagagacccatgcagatatggggagaatgtgcagactccacacggacagttgccctggctggcaattgatttttttctcatcaacattatatgaaacagcattgagtgaaactgtgngatttgaagacctgttgtagttccttgggaaactgactcaatgtcatgaccttactttatcaatttctaacctgcatttcctgtatccgacagctctcaaggctaaacagtacaaaaatggaaaaagagaagtggattaagttaaccagagtatcattgtatcaagtctcacttacaaattagaaaaagtttaaaaaatacaatatgcnkaaattgtgtaactcgaaacattttcccatgtattcatagcattacawtctgaw

SEQ ID NO: 29917 - DNA, 294 bp, Homo sapiens
tgcttattgttgagaagatgcttgaagtctttcatgctattaaatctgtcaagatttaccgaggagcattatggatcctgggagaatactgtagtaccaaggaagacattcagagtgtgatgactgagatccgcagtcccttggagagatcccaattgtagagtcagaaataaagaaagaagctggtgaattaaaacctgaagaagaaataactgtagggccagttcagaaattggttactgaaatgggtacctatgcaactcagagtgcccttagcagttctagacccaccga

SEQ ID NO: 29918 - DNA, 434 bp, Homo sapiens
  misc_feature 247: y=c or t
  misc_feature 401: r=a or g
gagagagttctagaacttcgatgtccagtgcagtagccactacccatatgtagctgttgagcatttgaaatatggttagtccaaattgagatgtgctctaaaggacaataaaaggttaaatatctcctaattttttgtattgattacatgttgaaatgttaacattggaaatattgggttaaagaaaaatacacaattaaaatgaatcttggccaggcgcagtggctcacgcctctaatcccagcaytttgagaggccagggtgggcaggtcacctgaggtcaggagttcgagaccagcctggccagtgtggcaaaaccctgcctactaaaaatacaaaaattagccaggcatggtggtgcgcacctgtagtcccagctacttgggaggctgaggcaggaraattgcttgaacccaggaggaggaggctgcagt

SEQ ID NO: 29919 - DNA, 417 bp, Homo sapiens
  misc_feature 202: n=a, g, c or t
tgcaaagggacaatggaactaaattgcctcaggctgtgtaaatcaaagttatagtttagaggcagttacaaaaccagaaatttgtatgaactgttaaaacttttcatttttgaaacataaccatatcttttgtcttttggctcttctctctctctctccctccctccctccctctcttcccttcctttttctctcaaactcnagcaattttcattttctgctggaacaatgatacgttacatcaaatttcttggtcacacccagaaagaagtagcaaggttgtaaaataatcagccattggctcacttaattagtggaaaattgtgctgtttcctccaccactagaaagaaaaataaaaataaaaatctattgatctaatctaagccctagacggagattttttttttaattaagta

SEQ ID NO: 29920 - DNA, 341 bp, Homo sapiens
  misc_feature 12: y=c or t
  misc_feature 143: s=g or c
  misc_feature 145: m=a or c
  misc_feature 236: y=c or t
  misc_feature 250: s=g or c
  misc_feature 286: w=a or t
  misc_feature 287: s=g or c
  misc_feature 296: s=g or c
  misc_feature 318: m=a or c
taaatggttgtyattttaaggcactaaaatttggaataatttgttatattggaaaagctaactaatacagtctcagatcttaaggaatttacaacagagagaacagagaaaataagcaacaataacaaaatcatatatatatstmgtatatcagatggcaatctggaaaatgaaataagctgaagtaagatgtatagggggtgctaaggtgaaggggaaaggatgttgctattttycattggtgtttaastgactgctcactgataaggtgacatttggatagtgwstcgaaagasttatcagaggcaactgtttggmgcttggtgaaaatgagccccgca

SEQ ID NO: 29921 - DNA, 207 bp, Homo sapiens
tcttaattgtgtttgtatagtctgggatgactagccatttaattcctgttttgtttccatagtgccagaacagggcacagtacctggcatataataggtgccaaaagttattcttctactgtgttactgtgttatgaatgaattagtgtagtcacttcccagattctggaagtttttctactattaagtttttatcctgaaggcggc

SEQ ID NO: 29922 - DNA, 321 bp, Homo sapiens
  misc_feature 306: b=c or g or t
  misc_feature 307: n=a, g, c or t
  misc_feature 319: h=a or c or t
  misc_feature 320: v=a or c or g
catagtgatgtgtttccacagacattacaatttacagttgacaaccacaaagacactagactaaggttcctgagggctccagaaggctgggtccccagtgcctgcacttggcaggcctttaatcagtctttgttcagtagtgagggcagaataggaaaatggcaactctgtgaaaagttgaggtaaaaccagtgtaaaatagtattctgtaactgcaataatttaaaagtgtttgttttgggataaaagctgaaaataataagccatagtgaaaatagtagttgtgtttgcagtgtttctcaatcbngttggcacctchva

SEQ ID NO: 29923 - DNA, 183 bp, Homo sapiens
ggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagtg

SEQ ID NO: 29924 - DNA, 169 bp, Homo sapiens
ccaggctgtttcttcattaaactctagtcattccaggtctcatgggaatgatcaccatagcaaggaacatcaacgctccaaatcacctcgggaccctgatgcaaactgggattctccttcccgtgtacctttttcaagtgggcagcactcaactcaatctttcccaccc

SEQ ID NO: 29925 - DNA, 166 bp, Homo sapiens
gagcggcggccgaggcggcggtgtgggcgcgtcaggccgcgacgagggcgctgagatctcacattcttgaaggtggcattgaagagcactaagatcggaagatgagtgagcttgaccagttacggcaggaggccgagcaacttaagaaccagattcgagacgccga

SEQ ID NO: 29926 - DNA, 181 bp, Homo sapiens
aagcatgtagaaatagtgcagatataacagaacccatataccccttcccagatttaatgtttatattttgccatgttggtttcagttttatctttcttaagaaagaaaatgttgtagatactgttgaaacccaccctatatgtaaatatgagccctttcccttatctctccaaaagcagcc

SEQ ID NO: 29927 - DNA, 208 bp, Homo sapiens
caaaccataatattgaactgttccccttaccagtacgaggtaattgtgatagtcttactttgtaactgctgctgtctacagaatgctcagggagattaaagataattcagaggcaaatggtactaacccttctaacctcagccctgtaaagtgtagtatgatttcaaactctttcctgtatacacatacacacacacacacacacact

SEQ ID NO: 29928 - DNA, 110 bp, Homo sapiens
atattttgattctgcctgacatttggcagatcatttgtttccaggttgttgccttgcattcataatgaccacttttgttgttgtttttattattaaaaaaaattatcttt

SEQ ID NO: 29929 - DNA, 158 bp, Homo sapiens
ttaattaatgtcctttcgtagttctcagagtaaaatagtattttctgagtgtagtcaaatgtgttatccagaaatgacatttggaagattcccaggagttcttgcatattgcctgttttgtatttgtctcattgaaacatatttttgaaaggagcggc

SEQ ID NO: 29930 - DNA, 299 bp, Homo sapiens
  misc_feature 141: w=a or t
cagtgtatctttgttgttttgagatgacgaatctatctggaagagcagaagaaactgaattggaataacataattattacaagaactacttattaagtacccacaaaataacaggtaatttctgaatattgtgtatttgtwatcatatttcattttcataaaaattcttggagaaacttgttgtgttctcttttatagataaagaaactaaggtacagagagctgaagagacatgcccatgatcacatggttataagtggcagagccttccatgcctctgactttttttaactgcccaa

SEQ ID NO: 29931 - DNA, 199 bp, Homo sapiens
  misc_feature 134: y=c or t
  misc_feature 145: m=a or c
  misc_feature 165: r=a or g
  misc_feature 166: r=a or g
agttcccgagcctgggagcaaccgcagcttctagtatccagactccagcgccgccccgggcgcggaccccaaccccgacccagagcttctccagcggcggcgcagcgagcagggctccccgccttaacttcctycgcgggggccmagccaccttcgggagtccgrrttgcccacctgcaaactctccgccttccgcacc

SEQ ID NO: 29932 - DNA, 398 bp, Homo sapiens
  misc_feature 193: v=a or c or g
cactctacctctgacagcatgtatattgcaccagtagctaacaaaaactggtctagtcaaaccaaatgggcacaaaagaaccaggataccaaaagttaagctcatacagctgcaaaccatatcacttcttggtaacaatgcaagacctcataaacctaaagaagagaaagaaaagaaaacttttgttactttvcttttttgcttgtcacttatatacaggctatgtgagaatataatttgtaggtataacacattaagaaaaagttatcttcattggatagaattgaatggtggtcgctgataggaatagggcgtcctctagctcttatctctgtctcttactcttttctctttctctttttctctgtcatgagactgtgtgtgacagggccacctgt

SEQ ID NO: 29933 - DNA, 129 bp, Homo sapiens
ccatttatataagctgtgtttttaaaacttatctgcatgttattggaagctttccatgttctatatacagttgactcttcaacaacatggatttgaactgcgttggtccacttatacacatttttttct

SEQ ID NO: 29934 - DNA, 203 bp, Homo sapiens
ccaccacgcccagctaattttggtatcttttgaagagatggggttttgccgtgttggctaggctggtcttgaactcctgacctcaagtgatctgcccacctcagcctcccaaagtgctgggattacaggcatgaaccactgtgcccggctggttgaacattcttatatagaatttatatttattttctaaacaaatggacgaa

SEQ ID NO: 29935 - DNA, 105 bp, Homo sapiens
caggatttcaccatgttggccaggctggtctcgaacccctgaccgcaggtgatccgcccacctgagcttcccaaagtgctgggattacaggtgtgagccaccact

SEQ ID NO: 29936 - DNA, 204 bp, Homo sapiens
tatttagaggtactggggacaatgtgtccagaaagtggaatcccagctccttctcaccccggctattgatttttggccttgcaattactgcagaggtgctgcctctgtgaacactgttagtgctagttagaaaggcttgagcttttgaagcttagctgtttgagctacctacgggtttggaaaaaaaaagaatcttaccatgtt

SEQ ID NO: 29937 - DNA, 203 bp, Homo sapiens
  misc_feature 16: r=a or g
  misc_feature 126: m=a or c
  misc_feature 156: w=a or t
  misc_feature 157: w=a or t
  misc_feature 160: k=g or t
  misc_feature 161: k=g or t
  misc_feature 166: k=g or t
  misc_feature 172: w=a or t
  misc_feature 184: k=g or t
ccaccacgcccagctrattttggtatcttttgaagagatggggttttgccgtgttggctaggctggtcttgaactcctgacctcaagtgatctgcccacctcagcctcccaaagtgctgggattamaggcatgaaccactgtgcccggctggttgwwcakkcttakatagawtttatatttatkttctaaacaaatggacgaa

SEQ ID NO: 29938 - DNA, 110 bp, Homo sapiens
  misc_feature 16: k=g or t
  misc_feature 54: k=g or t
ttttaaataaagaackggcaaatgtgagagatggataagcccctcattgctgtktttctccctttcgtcgtggatctggaatctttagaaggatggaggaatacccaagt

SEQ ID NO: 29939 - DNA, 381 bp, Homo sapiens
  misc_feature 100: k=g or t
  misc_feature 204: s=g or c
  misc_feature 308: n=a, g, c or t
tgtttctaggtgctaactgccaaagaaaggaaaactcaaattgatgatagaaacaaattgactgaacattttattattacacttcctatgttactgtcakaggtacagtttcatttacagttttgttatgtcactgagtttgctttcattgtactattaaagtagttactgtctttttctttgcttctccttctagtattctgsagatgcagagaaggtagcaaacttgctacaaatcccacagtattttgatttagaaatctacagcacaggtagaatggaaaaggtaatgatattatgaaattganattcagctgttatagttttattaactgaattattttcatgtactcttatagacttgttatttgacagatgctg

SEQ ID NO: 29940 - DNA, 295 bp, Homo sapiens
  misc_feature 291: n=a, g, c or t
aaatatatctttttatcattttttctcctaacttctttaaaggatgtaagtgtgtataaagcaataataataatagtaatgtattgggtacaaaacatctatagatgtgatatgtatgataatagcacaaactgttaaagtagaggaggaagggccaggtgtggtggctcacacctgtaatcctagcactttgggaggccaaggtgggtagatcacgaggtcaggagatcaagaccatcgtggataacacagtgaaaccccgtctttactaaaatacaaaaaattagccgngcac

SEQ ID NO: 29941 - DNA, 73 bp, Homo sapiens
  misc_feature 12: m=a or c
  misc_feature 35: h=a or c or t
  misc_feature 36: m=a or c
gaaatttagtamtatatatatgttattaactatghmatattaaaacacatgtcctcaaacaaaacaaaattta

SEQ ID NO: 29942 - DNA, 107 bp, Homo sapiens
cactacatgggtcattccatagtgcagatgtattgaaaatggatgattttggtgccgtgccctttacagaacttgtggtgcaaagcatcactccacatcagtcccgt

SEQ ID NO: 29943 - DNA, 215 bp, Homo sapiens
  misc_feature 67: w=a or t
  misc_feature 127: r=a or g
  misc_feature 132: m=a or c
  misc_feature 138: s=g or c
  misc_feature 149: r=a or g
  misc_feature 150: h=a or c or t
  misc_feature 190: r=a or g
agcagtgacaaaagttattgtaatgacctctgaacagagaaacactgccattgaagaggcttctggwatagaaaacatggtacattcaggagctgtgaatatagctctaggtgtgctcctgaatcartttcmtggtasattatgctgarhaacagtgagatgttattggaggtgtggatgagggagtttrttgttgcagtccttctttgcacccc

SEQ ID NO: 29944 - DNA, 117 bp, Homo sapiens
agtttacctcaaaagaaaatattgaacgccagttaaaggtacgcctgtaatctgacttctttgggaggccaaggcgggaggatcacttgaggccaggagtttgagactaccctgggc

SEQ ID NO: 29945 - DNA, 180 bp, Homo sapiens
  misc_feature 140: r=a or g
catcctaggggaacagcagctaccatttactgggggctaccacgcttgggtcctgtggggcacttcgcattccttaccttgtttacttctcacagcagccttgtgtggtctccattttacagatgagcaaatggaggcaraaatggtgcccagaaagtcaccaaggtgtcaccgctactt

SEQ ID NO: 29946 - DNA, 69 bp, Homo sapiens
agtgggagcgtgtgcatgggggtgtgtggaagtcaaacagatccctgaggcctgcgagcctatcgcgct

SEQ ID NO: 29947 - DNA, 141 bp, Homo sapiens
accgctgttgttttatgggaagtcgtgtcatcctaggggttggggctgggcagagcctgtcccctccccccttctccaggagccagggggtgactggagagacagacccacccccaagcagggctcctctccccagggatc

SEQ ID NO: 29948 - DNA, 289 bp, Homo sapiens
  misc_feature 159: d=a or g or t
actagtgttttctaataactctattatagttactagactatgatttctaaaacctatcatttacaaaaggaatatagaaaaatctttctgctaaaaacttgtgggggaggtgttcacctttgctaggtattattttatatcataattattaattattcdaagattcatattactatgtattaatttgtgtcaatcagtttgttcacattcacaatactgtatacgtaatacagtttccaatttctccaagtagattttgaaattttgttagtaacataatcaagaacca

SEQ ID NO: 29949 - DNA, 88 bp, Homo sapiens
  misc_feature 76: m=a or c
caatctcagtgttgtttcttaacattttttttttacttctctttaattagatcttgcatttgagtttggtctctamaccattggagat

SEQ ID NO: 29950 - DNA, 241 bp, Homo sapiens
ctttattacaacaataactgaagttattcttttaggttctcgtgaaattctcactgaaagccacattcttagcctaaggcatttcatcttttatgatataaaatgatggctatcaaatgattttccatacattgtactgatcaagttatacacccaggggtatatacactttcttcatgtttcttctttgtatatttggtgactgtatcgtcatagatgtacatattgtgtcgatagggca

SEQ ID NO: 29951 - DNA, 311 bp, Homo sapiens
  misc_feature 157: r=a or g
  misc_feature 158: d=a or g or t
  misc_feature 293: m=a or c
  misc_feature 294: h=a or c or t
ggtaccagttcagacatgggtacacgttgacaggccgccggccgtcgactggcatgttgtgaccattcctggtgctggtcttggtactgttctttcctaccataacttattggaagagggtggcattcctgccttgcagccttttctccagtgaggrdtgaacagtgggcacctgagatcctggcccacgctactatgctttcaggctacaaccacacacggctgacgatggccctttctgcggagaccgagtcacacatctaccgagctctgcgtactgcttctggcgctgmhgcccaccttgtggccct

SEQ ID NO: 29952 - DNA, 133 bp, Homo sapiens
atcaacaccaagcttaaaactagagtcaggaagctgttgaaggccaaggtacttggcctgctgcttcatttccaccagagttctgaagggtatagccagccctgggttatgttggagttgtaaagtgacatgt

SEQ ID NO: 29953 - DNA, 375 bp, Homo sapiens
  misc_feature 144: n=a, g, c or t
  misc_feature 145: n=a, g, c or t
  misc_feature 165: k=g or t
  misc_feature 202: n=a, g, c or t
  misc_feature 275: h=a or c or t
  misc_feature 276: n=a, g, c or t
  misc_feature 277: n=a, g, c or t
  misc_feature 278: s=g or c
ttctatttctgtgaagaatgtcacagaatgcagtctacatattgcatagaatctgtagattgcattgggtagcatggacattttaacaatattgattcttccaattcatgaacatgaaatatctttccattttttgaggtctanncaatctcttttatcagtgtktcctaattctgattatagagatctttcacatctttgnttcaagttgattcctacgtatttcactttatttgtggctgttgtaaatgggattactttttgcatttctttchnnsaattgttcagtcagcatacaggaatgatactgatttttgtatgttgattttacatcttgcaactttactaaatttgtttatcagttctaacagtttt

SEQ ID NO: 29954 - DNA, 122 bp, Homo sapiens
cccttttacctattgattgatagtctgtgtttctaggctcagcttgtcaatcggaaacagaaattagagtctgtggaactttctagccaatcagaaattcaacacttaagcagtaaactgga

SEQ ID NO: 29955 - DNA, 300 bp, Homo sapiens
  misc_feature 110: n=a, g, c or t
  misc_feature 140: y=c or t
  misc_feature 141: k=g or t
  misc_feature 143: w=a or t
  misc_feature 289: d=a or g or t
  misc_feature 290: v=a or c or g
tttcttttagtatgtttttccataattaaagatccatcttattttcacctcttcagttaaggatgatttctcctgcttctgagttcctagagttttcatccctttgatgnaaatgcttactaatagtaaatataattgcyktwttaaaatttccttcatatccatgttttttaaaggtctaatttttaaattatttaataaggtgaaatagtatggtttaatggctaaaaacatgggctttgaagtcaaacaaagctgagtgtaaatatctctgtatatttatgtactdvacttgccctc

SEQ ID NO: 29956 - DNA, 375 bp, Homo sapiens
  misc_feature 313: n=a, g, c or t
  misc_feature 314: n=a, g, c or t
  misc_feature 368: n=a, g, c or t
  misc_feature 373: n=a, g, c or t
  misc_feature 374: n=a, g, c or t
  misc_feature 375: k=g or t
ctcaccaacactaacctttcatctttgtttgtaatagcaggtgtctaacaggtgcacggtaatatctcactgtggtttttttgggggggatggagtctcgcactgtcgcccaggctggagtgcagtgatgcaatctcggctcactgcaatctccacctcctgggttcaagcgattctcctgcctcagcctcccaagtatctgggacgacaggtgcgtaccaccatgcctggttaattttttgtatttttattagagacggggtttcaccatcttggccaggatggtctcgatctcctgacctcatgatctgcnnagctcggcctcccaaagtgctgggattgcaggcgtgagcaccgcgctcggcccntcaannk

SEQ ID NO: 29957 - DNA, 80 bp, Homo sapiens
aggaaaatgttcatgttcatatgtacttgtttgctatgactacattttgaggttttgtaaaactgttatttttttttttt

SEQ ID NO: 29958 - DNA, 140 bp, Homo sapiens
ataatggacgtgtaggttgtttccagttttttaccacgataactaactctgagattgatacctttgtacattattgttgcttattagtccagttttttccttgagataaatatttgtaaatgaaattttccaagtcagtg

SEQ ID NO: 29959 - DNA, 374 bp, Homo sapiens
  misc_feature 131: w=a or t
  misc_feature 132: w=a or t
  misc_feature 358: d=a or g or t
  misc_feature 359: h=a or c or t
ccagtgactgttttttttcagcccatgaattaaaccttcttttctctttgttacctatggttttatacgttttcctcctctttaacgcatccacagaatagaaatgaagaaaattaataggactttattcwwtccttacaataaatcatcttgcttctgggtgtatttggggttggaggttgggtagttgtcagaaaatgacaatggtatattttcaagtagtgctgaaggtgtttttagaacagaagaaacttggtggaactgtcttgctacagagtaggcatgctaggctttgtttttgcattacattctgatgaggtctgtgacattttatggtacactgttagcatagtggtgdhgaacattagcccgac

SEQ ID NO: 29960 - DNA, 127 bp, Homo sapiens
  misc_feature 15: k=g or t
ttaatgtagtttggkacatagtttaaaaatatgtcagtgtaatattatgagggatttaaagttgaaccagatctttattctgaaaattgctattttactttgtaaaacatatacatttaacagaatt

SEQ ID NO: 29961 - DNA, 111 bp, Homo sapiens
aacataagtattggggaaatgtggacctgtaagtgatgaaaattagattagggaatgagttcaggcctatcaagttttctacaattctttctgttggaacatcggaccgaa

SEQ ID NO: 29962 - DNA, 200 bp, Homo sapiens
  misc_feature 41: s=g or c
  misc_feature 128: m=a or c
  misc_feature 150: d=a or g or t
  misc_feature 182: w=a or t
attgctccaagatggcggcggcggcggcagcgggagcgcastcagctgggctggaactgccctcctggaactcccccagcctacaacctaggaggtgcagggactgaggctcaggccaaaatcgcaamtcagaccccagtgaacccaagdcctgaagagaatttggattcatttaccttgtwttgtggggactggagaga

SEQ ID NO: 29963 - DNA, 85 bp, Homo sapiens
taataggaaggaaattgttttgttcttcaagtcaagacctttctcactttgatttctcaaaatgaaagaataactggcctgacat

SEQ ID NO: 29964 - DNA, 127 bp, Homo sapiens
ctacctgtatcagcccacatagtcttcataatcacctaagaagcaggtacggtgacctccctctttttatggatgcagaaagtgaagcacagacagggtaaataactttctcaaaatcacagaacga

SEQ ID NO: 29965 - DNA, 264 bp, Homo sapiens
  misc_feature 139: m=a or c
  misc_feature 264: m=a or c
ataaacatcgaaaaggcgttcctcacgttagctgaagatatccttcgaaagacccctgtaaaagagcccaacagtgaaaatgtagatatcagcagtggaggaggcgtgacaggctggaaagagcaaatgctgctgagcmattctcctgttccatcagttgccatccactaccccgttttctcttcttgctgcaaaataaaccactctgtccatttttaactctaaacagatatttttgtttctcatcttaactatccaagccam

SEQ ID NO: 29966 - DNA, 203 bp, Homo sapiens
  misc_feature 155: n=a, g, c or t
  misc_feature 156: m=a or c
ctgtcccctaaggcactaaggtccgttagtgatttcccttgtcccggagataaagcagaattatttagtataaccctccctgacaattcaccccaggttgtcccacatccctccacatccatttgccccgccatcctttggccctttcccctgtnmccttaacaccatctttctttctgtctgggatcccgctcccctgccct

SEQ ID NO: 29967 - DNA, 369 bp, Homo sapiens
  misc_feature 98: k=g or t
  misc_feature 115: y=c or t
  misc_feature 159: y=c or t
  misc_feature 301: w=a or t
  misc_feature 302: r=a or g
  misc_feature 303: k=g or t
  misc_feature 312: n=a, g, c or t
  misc_feature 313: n=a, g, c or t
  misc_feature 314: b=c or g or t
gaaggatgaagccctggaacaaaacattcaggctctggaagagaaccaccaaactcaggagcaggagagcctagtgcaggaggaccatttgagcccakaagtttgagaccagtgygggcaacatagtgagaccctatctctatttaaaaaataaatttyaaaaaataaaaattttaaaaagtaagtcattcctgtcccaacaaggagaaattggaaggaacaaaggggtcaccattccaagcaagcttgaaatccagcaggggaaattccattaggtttcaaggcctgagaataatcctcwrkggctcacgnnbcctgccctctgggaccacagagactccatcagcccctgcctctaggcctgcctaa

SEQ ID NO: 29968 - DNA, 155 bp, Homo sapiens
  misc_feature 127: w=a or t
  misc_feature 128: m=a or c
  misc_feature 134: w=a or t
  misc_feature 155: r=a or g
cattaaatagaaatgttgaaaaattgcttttggaataattgacttatggatatttcatcaaatttacagttggctatgctttcttattgtgcatactatgaaatgtttttcttcaaaaagtgtttawmagtggwaagtttaagaatggggaccgr

SEQ ID NO: 29969 - DNA, 99 bp, Homo sapiens
  misc_feature 4: y=c or t
  misc_feature 30: h=a or c or t
  misc_feature 36: n=a, g, c or t
  misc_feature 37: h=a or c or t
  misc_feature 41: y=c or t
  misc_feature 43: y=c or t
  misc_feature 66: y=c or t
  misc_feature 71: w=a or t
  misc_feature 74: r=a or g
  misc_feature 75: w=a or t
  misc_feature 83: m=a or c
agcyaaactttccctccttggaaaacagghgattgnhgagyayttaacgtgaatcgatgtaaaccygtgtwtgrwgcttagamagggggcccccgggta

SEQ ID NO: 29970 - DNA, 195 bp, Homo sapiens
  misc_feature 73: r=a or g
  misc_feature 74: r=a or g
  misc_feature 125: r=a or g
  misc_feature 130: k=g or t
  misc_feature 131: d=a or g or t
tggtttcattcaccacaactgcaccccagagttccaggccaacgaggtgcggaaggtcaagaagtttgaacarrgcttcatcacggaccctgtggtgctgagcccctcgcacactgtgggcgatrgtgckdgaggccaaagatgcggcatggcttctctggcatccccatcactgagacgggcaccacgggcagc

SEQ ID NO: 29971 - DNA, 89 bp, Homo sapiens
  misc_feature 5: w=a or t
  misc_feature 16: n=a, g, c or t
  misc_feature 34: w=a or t
  misc_feature 58: w=a or t
aggcwtcgccggctangattgcggcccccatctwctgacttttcctcgtgtgacccawcttttcaaattcccttacctgaggaaggagc

SEQ ID NO: 29972 - DNA, 55 bp, Homo sapiens
  misc_feature 12: w=a or t
  misc_feature 31: h=a or c or t
ctcctttgaccwcgatttcaagccatgcgchgagcttcggttggcccggcttcct

SEQ ID NO: 29973 - DNA, 286 bp, Homo sapiens
  misc_feature 10: w=a or t
  misc_feature 11: w=a or t
  misc_feature 111: m=a or c
  misc_feature 150: r=a or g
cagaaggggwwgacctccatttgcttctctgagtagtttcctctgctgacattccaaatcccaccatcgattgtgcagcgctttggatttccttcagttctccaggtccamctggaaagtatagttggccagtttgaagtctctcaaatraaggggctactgggagtgctcttggtaacaatcatgatgtgaatgggtgtgaacgatacttggctatgttaagtgccttgtccgcaccttgcttttatctctagagacatgaagttattattaatttttttttttt

SEQ ID NO: 29974 - DNA, 200 bp, Homo sapiens
  misc_feature 131: h=a or c or t
  misc_feature 132: s=g or c
caagtctttactggatggaacctattatgttttcattaaattttctctcccctttcctttcattttagggaaattttaaaaagagaatactttaattgggcttccctcaaaagtcacagagatttctaaghscaccaaggttgcggtggtctgcgtatggtgcgtcgctaaacttgattgcctcaagtccacaatcagca

SEQ ID NO: 29975 - DNA, 178 bp, Homo sapiens
  misc_feature 125: y=c or t
  misc_feature 126: s=g or c
  misc_feature 127: h=a or c or t
  misc_feature 130: y=c or t
  misc_feature 142: s=g or c
  misc_feature 143: m=a or c
actcctagaggaagggagcaccgcgaggctcacggcagggccctggcgccgggcagggcgagcctcggaagccgcctggaggacgtgctgtggctgcaggaggtctccaacctgtcagagtggcyshagycccaggcctggsmcctgagccgggtccccttccgcaagcgcccgccga

SEQ ID NO: 29976 - DNA, 208 bp, Homo sapiens
aacaattccttagtttcaccacttcaaaaaatttattctagtgtcaaatcccacattttaaataaatacagaaatgattttgatgattctccatttctcccacaagaacaaatagcacaaataagggaaaaaccgtgtgaatgtaatgagcatggcaaagcctttagagtgtcttcaagccttgctaaccatcaagtaatccacactg

SEQ ID NO: 29977 - DNA, 188 bp, Homo sapiens
tttctttgtcatgactatctggtttaatcttgaaggttgcttttattaatttattctttgaatgaattgtgaatatatataagaataaatttttgtaagtgtacattatttcataaacttgaagaaaaggtttttattacattttatgttagtattatttttattttcctacactatatagacgtcag

SEQ ID NO: 29978 - DNA, 146 bp, Homo sapiens
aactgtgcaatggagaacgggagcctgagcctcgggaagacagggttgcaaccgcaggctaggtgcgcgctctcccctagctcgcggcgtggagctgggtctccgcggcgggcgccggctactgcaggtgctggcacctgggctcc

SEQ ID NO: 29979 - DNA, 120 bp, Homo sapiens
  misc_feature 42: k=g or t
  misc_feature 63: k=g or t
cacaccagaaagaagacaaatttcttggtcttgagcccagakgcttcagaatgttgaaggcaktggatttattaatgttgaaggtgatggactcttgaagtgtgtaatgtggcgtacccc

SEQ ID NO: 29980 - DNA, 136 bp, Homo sapiens
  misc_feature 19: m=a or c
  misc_feature 96: w=a or t
  misc_feature 98: m=a or c
  misc_feature 102: m=a or c
  misc_feature 113: m=a or c
tacagcaacagttcttcamcgtaaaagaatagaccgatggtgtggaggcagagtcattgtttgcataacaattcactttgtttttttaaatttatwcmttamatatttattgmgtgcctactctatgccttatact

SEQ ID NO: 29981 - DNA, 94 bp, Homo sapiens
ttgttgctgcaagctatctgcccaagttaatgcaaatggacacattttttatgtcagaaaaacacacacacacacacacacacacacacacaca

SEQ ID NO: 29982 - DNA, 401 bp, Homo sapiens
  misc_feature 142: b=c or g or t
  misc_feature 162: k=g or t
  misc_feature 271: v=a or c or g
  misc_feature 272: n=a, g, c or t
  misc_feature 342: n=a, g, c or t
  misc_feature 343: n=a, g, c or t
  misc_feature 344: n=a, g, c or t
gtgttgtcatggttaatagctcctgaaattgtggtatccctcagcctaaccgagattggcctgctggtgctcaaaggctcataatgcagtcatggccaggctcttggagggcccaagggcatcactggaaggtggatgtggbttgctatagtttgaatattkgtcctttacaaatatttgaatatctgtcttctccagaatttgtgttaaaatttaacccctaatatgacagtattgagaggtgggacctttgaaggccaactgggtcatvngggctctgccctcatgaatgctttaatctattcatggattaatggatcaataggatatcatgggaatgtnnntgataacttgataagaagaggaagagaggcctgaagcagcaccttcaggcccctccc

SEQ ID NO: 29983 - DNA, 321 bp, Homo sapiens
  misc_feature 131: w=a or t
ttcaactttttcgttattattataccggttatggtgacctatgatcagtgatctttgatgttactgttgtaattgttttggggcaccacgaaccattacccatgtgaggtgatgaacttaataaaatgtgwatgttcttaatgatccagcaactggctgtacccctgtctctctcactcctgagacacaacaatattgaaattagtccagtcagtaaccctaaaatggcctctacatgttcaagtgaaaggaacaatcacacgtctctctggaaatgaaaagctagaaatgatgaagcatagtgaggaagctatgttgaaa

SEQ ID NO: 29984 - DNA, 214 bp, Homo sapiens
actaggcccaaggatgcacaatgaacacctttttcatctcctttgtcgctggtttatttgagagttaatctataacatttaaaaatgcttggcacccttctgtcagtttgcacaaccttctgaatattgtgaaaatggcagtaatcatagctgttgattattatttgtcaaatgcccccactgacgttatggcacacaaccctactttaattta

SEQ ID NO: 29985 - DNA, 74 bp, Homo sapiens
atgctggtcagatgtaagtgtgttgtctgcaattcatcaggattaaattatgtagataacttaagggatatctc

SEQ ID NO: 29986 - DNA, 439 bp, Homo sapiens
  misc_feature 143: w=a or t
  misc_feature 144: k=g or t
  misc_feature 147: y=c or t
  misc_feature 196: k=g or t
  misc_feature 278: w=a or t
  misc_feature 279: n=a, g, c or t
  misc_feature 280: n=a, g, c or t
  misc_feature 282: m=a or c
  misc_feature 299: m=a or c
  misc_feature 368: r=a or g
  misc_feature 400: w=a or t
  misc_feature 411: d=a or g or t
  misc_feature 412: v=a or c or g
ttgcaaatacatgccaataacacagatcaaataatatctcctcatgagaaatttatgatcttttaagtttctatacatgtattcttataagacgacccaggatctactatattagaatagatgaagcaggtagcttctttttwkctyaaaatgtaattcagcaaaataatacagtactgccaccagattttttatkacatcatttgaaaattagcagtatgcttaatgaaaatttgttcaggtataaatgagcagttaagatataaacaatttatgcwnngmgtgacttagtctatggmtttattccaaaattgcttagtcaccatgcagtgtctgtaatttttatatatgtgttcatatatacatartgattataatacataataaagaatgaggtggwattacattatdvctaataatagggataatgctgtttatt

SEQ ID NO: 29987 - DNA, 253 bp, Homo sapiens
  misc_feature 125: d=a or g or t
  misc_feature 126: y=c or t
  misc_feature 132: r=a or g
  misc_feature 137: w=a or t
  misc_feature 138: w=a or t
  misc_feature 142: w=a or t
  misc_feature 157: s=g or c
aaaggattgaggtgtgttgatttgaaaaaaaaaaatgcaagtcaaggaaaactgcaaagtataatgtgtatgaaataagctaccagtggttttgattgggtacagacaagcctgtacttgcatgdyccaagrgaatwwtatwattggacctgtttasccttgataatgacctttcttataaacttcggtagcatcatactgcttcattattttttgcaaaaggttaagtagcatctcacaagccaagatcatt

SEQ ID NO: 29988 - DNA, 144 bp, Homo sapiens
  misc_feature 120: m=a or c
acataggtaaaaccagcagtttccagtaatatagggggtttttgagcaaggcccctggagcagcggagagacaagatggagcacatgtagtctgtgtgcctggtcacacacaggcctgcmtgcaagtagcaaagcagctctcaa

SEQ ID NO: 29989 - DNA, 129 bp, Homo sapiens
  misc_feature 44: s=g or c
  misc_feature 46: r=a or g
agcacgcgcgccggagacggttagaaatggcggttggggcggasarggggctggcgcgggaagcggggctgtctggctcggttacgcccccacctcgccaggaatctaggagtcggtttgttttccgaa

SEQ ID NO: 29990 - DNA, 123 bp, Homo sapiens
  misc_feature 16: s=g or c
  misc_feature 17: s=g or c
  misc_feature 18: v=a or c or g
  misc_feature 86: k=g or t
gccgggcgcggtggcssvtgcctgtagtcccagctactcgggaggctgaggtgggaggatcgcttgagcccaggagttctgggctktagtgcgctatgccgatcgggtgtccgcactaagttc

SEQ ID NO: 29991 - DNA, 309 bp, Homo sapiens
  misc_feature 148: d=a or g or t
  misc_feature 159: w=a or t
  misc_feature 233: m=a or c
  misc_feature 234: m=a or c
  misc_feature 282: n=a, g, c or t
  misc_feature 283: n=a, g, c or t
caaaaatgtttcaattcacaaaggctaattgttgaactggtgtcgtagaagaaattgtctacaggagccaaggtgaaagtctctgatgacggcggaactggctccattagaccatggttcatcctcttttaaaaccaaattttttttdcttctggcctwcaagtattttttttttaaaaaagaaaaaaagcctacattggcatcaagttctgtatcaatccatcttacattgmmatccatgatttaacagactgtagaatcttgaataatctatatcacttnnacaaataaatgttttactatgacaga

SEQ ID NO: 29992 - DNA, 376 bp, Homo sapiens
  misc_feature 162: w=a or t
  misc_feature 169: m=a or c
  misc_feature 278: h=a or c or t
  misc_feature 279: k=g or t
cacttctttgtctcatttcttccctttgttccttagtcatccaaataagcctgaaaaccataagagatattactttattgaatatggttggcattaaatttagcatttcattatctaacaaaattaatataaattccaggacatggtaaaatgtgttttaawaaccccmagacccaaatgaaaatttcaaagtcaataccagcagattcatgaaagtaaatttagtcctataattttcagcttaattataaacaaaggaacaaataagtggaagggchkctattaccattcgcttagtcaaaacattcggttactgccctttaatacactcctatcatcagcacttccaccatgtattacaagtcttgaacccgtc

SEQ ID NO: 29993 - DNA, 135 bp, Homo sapiens
aggttcttatattagccctctgagcatataaaggcccaaagaaacagacaccaattcctctgctgcacagacttttaaacctggaaagctgtaaatgcagaaacttaagtatctgggaggtgcgtgcttagcagc

SEQ ID NO: 29994 - DNA, 184 bp, Homo sapiens
  misc_feature 178: k=g or t
  misc_feature 180: y=c or t
caactaagtttatgtaatattctaaatcctctcttgtcatttcaacaacgttcacggcttcttcaccaggtgtggattctatctcatgaaaccactttctttgctcatccataaaaagcaacccctcatctgttttagtttgatcatttagtttgcagcaattcagccacatcttcakgytcca

SEQ ID NO: 29995 - DNA, 154 bp, Homo sapiens
  misc_feature 150: b=c or g or t
  misc_feature 152: n=a, g, c or t
  misc_feature 154: r=a or g
gacttggaaaaacaagccactctttatttttcatttttttgaatcctgcacacttgtctgaatggttcaaaatataacattgcatggggatggtttatttacattgtaaactgagtatcactggccctgtgtagctgtgtgccaaaaggbangr

SEQ ID NO: 29996 - DNA, 117 bp, Homo sapiens
  misc_feature 96: m=a or c
  misc_feature 97: m=a or c
atcttggaaggccttttttgccggttcttcccgctgaggaagtgtcgctcaagacgctggcctatgagttgtgatttctgccttttccccttcctmmttgggctaagccagaccaga

SEQ ID NO: 29997 - DNA, 154 bp, Homo sapiens
  misc_feature 103: n=a, g, c or t
  misc_feature 154: r=a or g
aatacccttcagataagtggtgtattaatcagggttctccatagaaacagaaccaataggttgtgtgtatatatatatatggaaagagatttgttttaagganctcacgtgaacatcgagacaggcaagttcaaaatactcagggaggggcggr

SEQ ID NO: 29998 - DNA, 168 bp, Homo sapiens
  misc_feature 123: y=c or t
  misc_feature 126: y=c or t
  misc_feature 128: w=a or t
  misc_feature 150: y=c or t
gggaagcatgggtgctggaaagggcccccaaggccctggaggaggaggcattaatgtccaagagatcctcacctccatcatggtacgcaccctccttccccttttccaccttctgtggagccytcytwaaggctcgctctcctcactgtytcccattcgcccttaacc

SEQ ID NO: 29999 - DNA, 118 bp, Homo sapiens
aatgcgtgcagtttgtaagaagcttcaattgtacatttgaaatggatgaattatattatatgtaaaatatgcatcccatagagttctattttaaaaggtcaataaagatttctgtttc

SEQ ID NO: 30000 - DNA, 123 bp, Homo sapiens
cagaaatactgtgtcaaggccgggcgtggtggctcacacctgtaatcccagcattttgggaggccgaggcgggcggatcatgaggtcaggagatcgagaccatcctggctaacacggtgaaac

SEQ ID NO: 30001 - DNA, 149 bp, Homo sapiens
  misc_feature 134: y=c or t
ggctttttatactgttttaaggctttggtgagatttctagcttaggagcctaattactatttataccagttcttgtgaatacatgtgattctcataaaaaagaaatgtattataattgccttttaggaaaatgyctttcaaaattgcca

SEQ ID NO: 30002 - DNA, 76 bp, Homo sapiens
ggatgtgagggcgatctggctgcgacatctgtcaccccattgatcgccagggttgattcggctgatctggctggac

SEQ ID NO: 30003 - DNA, 193 bp, Homo sapiens
  misc_feature 136: r=a or g
gctttcggtgatgaggaaaagaaaatggcggcgggaaaagcgagcggcgagagcgaggaggcgtcccccagcctgacagccgaggagagggaggcgctcggcggactggacagccgcctctttggggttcggtgargatttcatgaagatggcgccaggacgaaggccctactgggcaaggtaaggcagcgct

SEQ ID NO: 30004 - DNA, 216 bp, Homo sapiens
  misc_feature 126: n=a, g, c or t
  misc_feature 134: w=a or t
  misc_feature 137: w=a or t
  misc_feature 138: r=a or g
  misc_feature 140: n=a, g, c or t
  misc_feature 147: r=a or g
  misc_feature 149: w=a or t
ctcctatgatatttgtttactaataatttacctcaatggaaaggaagatcccagggtctattctattctctcctctcttcttatcatttggaattgtgctgtctaaatcttatttactttaccatnaagggaawgcwrancaaacarawcaaaggtgcattgtaaatgtgcagacctgtatcctgtccctaaggaaagttaattaattccccagcc

SEQ ID NO: 30005 - DNA, 322 bp, Homo sapiens
  misc_feature 123: d=a or g or t
  misc_feature 128: d=a or g or t
  misc_feature 140: w=a or t
  misc_feature 169: r=a or g
  misc_feature 280: s=g or c
  misc_feature 281: s=g or c
  misc_feature 312: m=a or c
  misc_feature 313: m=a or c
  misc_feature 314: m=a or c
tgataacatgcttctacctgtatttctagtgaccctttagcggcaggtatttatacctggtatttatgatgcagtatataagtggtgaacaataactgacagtattgtgcttgctgtacatgdctggdccttttgaaacwgattttagtaaagcattttccagaggtaraactgtgtccttattctaattttattcctagggcaaagtagacagggattatttccttgaatctatttccaaattaatatttttttctttggtatttctacactttaaggssatttggttgcaatttagaaagtgttggcctmmmttccgcct

SEQ ID NO: 30006 - DNA, 73 bp, Homo sapiens
  misc_feature 38: r=a or g
  misc_feature 55: w=a or t
ttagggcgaaatgtctgggcaaaaatggctgctagtgracctcggatgtttggawatgctgtggttgcagtca

SEQ ID NO: 30007 - DNA, 321 bp, Homo sapiens
  misc_feature 252: n=a, g, c or t
  misc_feature 253: n=a, g, c or t
  misc_feature 254: b=c or g or t
tgtagagaatatgtttcattcatttattcagcatgtaaataaaattgatcctgttgagttatcataattgcagttcaactatctgccatgattattcttttcacgtatcattcattctgtacatttgtgtacattgagaagtatagcaatctatgtaaatgtaatcctcagtgaggttcctcagtgctaggtcccataggattgtcgttgcccttgttaatgaggtttctctgttcagcggcttcaattttnnbtctctttgtacatctagttttgaagatttacttcaagtttgaatcttctagaatgcttgtaagtccg

SEQ ID NO: 30008 - DNA, 119 bp, Homo sapiens
  misc_feature 19: y=c or t
gcatccccatctccgtggytgagggcctagggaggagggaaaatccatcctcagacacactagatcctcagcgagacctgctgtggagagcatcaaacggaccgcacgcggacccaact

SEQ ID NO: 30009 - DNA, 282 bp, Homo sapiens
  misc_feature 123: r=a or g
  misc_feature 130: m=a or c
  misc_feature 141: m=a or c
  misc_feature 185: r=a or g
  misc_feature 187: k=g or t
  misc_feature 191: k=g or t
  misc_feature 198: k=g or t
  misc_feature 262: n=a, g, c or t
  misc_feature 263: b=c or g or t
  misc_feature 264: n=a, g, c or t
aagattttgttttttctcagtgttacttgataactataaacgacagacgttcatacaagagatctttcacctttactacttaggaatcaaaaattatttttgaaaagataagaatcattggtractggcmaggcaggggamcacctgatctttggtgttaaaagacctgaataacattcctgtarckatckgttattkacttgggccagttacaatcgccattatcttccaattaaaattaagatttaaaagacttctcttnbnagagataggatcccccat

SEQ ID NO: 30010 - DNA, 236 bp, Homo sapiens
  misc_feature 115: h=a or c or t
  misc_feature 122: r=a or g
  misc_feature 123: d=a or g or t
  misc_feature 125: d=a or g or t
  misc_feature 131: h=a or c or t
  misc_feature 139: k=g or t
caacctacttttatataagtatgaaactgaataatataaataaagcacttggcatgtagtgtgcattcaaatgatactaatttttgtgttatgattttgattattacaaaggathaagaagrdadggcaahtcgatcakatgtatttcatgggcagactctggctgagaatgtgctgtgtcctttggaaagaggagagcagagcaaactacttctctcccttccctctccccctct

SEQ ID NO: 30011 - DNA, 64 bp, Homo sapiens
tactatactatacttttgatcattgttttagactgtatttcttctacttatttaaaaaaaaaaa

SEQ ID NO: 30012 - DNA, 114 bp, Homo sapiens
cagatctatgtacttcaaaatgttagattgaattttaaaacctcagagtcacagactgggcttcccagaatcttgtaaccattaacttttacgtctgtagtacacagagccagc

SEQ ID NO: 30013 - DNA, 210 bp, Homo sapiens
  misc_feature 121: w=a or t
  misc_feature 136: r=a or g
aacatatacctttattacttcatttttgtaagagcttcagggaataggcttttttaaagggaatagacttatagatcaattttaatatttgacttatagaattttatgacactaaatggawaattgtaaagttttragttgggacccattttgtaagacattcaggctataaacaaggtaataaatcacactcttccagttctactccca

SEQ ID NO: 30014 - DNA, 95 bp, Homo sapiens
ctgttatctcattgtctgtgtgattgggggagctgcggcggggaggatgctgtggtcccttcctccggcgttccccacccccatcccccagcccc

SEQ ID NO: 30015 - DNA, 333 bp, Homo sapiens
  misc_feature 16: b=c or g or t
  misc_feature 127: w=a or t
  misc_feature 130: y=c or t
  misc_feature 134: y=c or t
  misc_feature 318: r=a or g
atgctgatttcatttbctttgggtaaatactacagacgtgcgattgctgggtcatatggtagttctatttttaattttttgaggagtctccatactgtttttccataatgattgtgccatgtcccawtcytaaycaaccaatataggctgggcatggtggctcacgcctgtaatcccagcactttgggaggctgaggcaggcggattaccagaggttgggagttcgggaccagcctgaccaacatggagaagccctgtctctgctagaaatgcgaaattggccgggcgtggtggcacatgcctgtagtcccagttccrgctgctcgggagaca

SEQ ID NO: 30016 - DNA, 321 bp, Homo sapiens
ttagctcacttaactcaggttgagttagttctgtaggggctttgagtgggtttgagctcacaataatagctgtgctaatgataagagctatgtgtttgtgtgggcttcacctgaattgcctcactttaccttccctatccaagtgtttgaagttgggagggaaggcattataggtgcttaatcaatgacggctggataatattaataataaaagaatgaaaacaggaatggtgagcccatgcttgctgggcacattctttggggttcagaggctccgtgctgggtcactggtccagtcttatttaacactaagggacgcca

SEQ ID NO: 30017 - DNA, 103 bp, Homo sapiens
  misc_feature 12: s=g or c
cttttggtcgcsccctccccaacccagcactaaggagcaccctgctctggtctccgccaccacccagcgcctcctggacccatccccccaaacccttgaacgt

SEQ ID NO: 30018 - DNA, 120 bp, Homo sapiens
ttatccctttagctcctcagttcgagtttcccgacgcggcccccacccttaacccctagcctccagggatcccagacatcctcccggctccctagagccctcccctgttctcagccccgc

SEQ ID NO: 30019 - DNA, 151 bp, Homo sapiens
  misc_feature 121: d=a or g or t
  misc_feature 123: s=g or c
  misc_feature 132: k=g or t
  misc_feature 136: y=c or t
  misc_feature 140: w=a or t
  misc_feature 141: w=a or t
  misc_feature 144: r=a or g
tacagaacagaaatccttgcctctttcaccagccacacctgccataccaggggtacagctttgtactattgaagacacagacaggatttttaaatgtaaatctatttttgtaactttgttdcsggattaaakttcycctwwatrtagcact

SEQ ID NO: 30020 - DNA, 448 bp, Homo sapiens
  misc_feature 137: k=g or t
  misc_feature 139: m=a or c
  misc_feature 304: n=a, g, c or t
  misc_feature 305: n=a, g, c or t
  misc_feature 339: y=c or t
  misc_feature 340: n=a, g, c or t
  misc_feature 341: n=a, g, c or t
  misc_feature 347: d=a or g or t
  misc_feature 350: w=a or t
tatttagtgcttccttcaagagctcttgtaaggcaggcctggtagtgacaaaacctctcagcatttgcttgtctgtaaaggattttatttcttcttcacttatgatgcttagtttggctggatatgaaattctgggktmgaaaattcttttctttaagcatgttgaatattggtccccactctcttctggcttgtagtctgatgggcttcgctttgtgggttacctgaccttttctctctggctgcccttaacattgtttccttcatttcaaccttggtgaatctgacaattatgtgtcttggnnttgctcttcttgaggagtatctttgtggtgttcynngtattdccwgaatttgaatgttgtcctgtcttgctaggttggggaagttctcctggataatatcctgaagagtattttccaacttggttccattctccctgtcactt

SEQ ID NO: 30021 - DNA, 129 bp, Homo sapiens
  misc_feature 86: b=c or g or t
  misc_feature 107: b=c or g or t
  misc_feature 124: y=c or t
  misc_feature 126: k=g or t
  misc_feature 128: v=a or c or g
  misc_feature 129: s=g or c
aagagaatgttctgggatagcagactgcctggctttctgcccacctgctgaatgccctgcacgtgttcgtgatgaagatgtttgcbtcggggcctgcccccattgcbcagggtaccaaatagcytkgvs

SEQ ID NO: 30022 - DNA, 355 bp, Homo sapiens
  misc_feature 121: y=c or t
  misc_feature 125: w=a or t
  misc_feature 127: k=g or t
  misc_feature 131: y=c or t
  misc_feature 133: k=g or t
  misc_feature 137: m=a or c
  misc_feature 138: v=a or c or g
  misc_feature 144: s=g or c
  misc_feature 148: r=a or g
  misc_feature 158: m=a or c
  misc_feature 295: n=a, g, c or t
  misc_feature 296: n=a, g, c or t
  misc_feature 297: n=a, g, c or t
ctttcagaagctgtagagagaaggtgctagaactgtgtacgatcatgactggaaagcaggatccctcagtgactgccgaatcttcccagcacaagatagagaggcagttcagcacaagccyacawtkggtyckaggmvagaaasgatratcctaccgmagatctcaaataaaattaaattgagaaagcagatctttcaagggaatgaggcggaggctcgcttttatgttaaaagccaccagcatcctccttgctagacatggacatgacatttttaaaggaattatctggttacnnngttttaagcaaactgttctaaggagtctgtacattgcattattttttctattcttttt

SEQ ID NO: 30023 - DNA, 99 bp, Homo sapiens
ttttctcttcttaaccactttatttcctcccaattattattattattattattatttattattatacttcaagttttagggtacatgtgcacaacgtgc

SEQ ID NO: 30024 - DNA, 149 bp, Homo sapiens
  misc_feature 133: s=g or c
taataaagaaacaaggctgggcgcagtggctcatgcctgtaatcccagcactttgggaggccaaggagggcagatcacttgagcccaggagtttcagaccaccctggccaacatggtgaagctcgatctctasctgatgccccccccgt

SEQ ID NO: 30025 - DNA, 240 bp, Homo sapiens
  misc_feature 134: w=a or t
  misc_feature 140: v=a or c or g
  misc_feature 141: h=a or c or t
  misc_feature 163: w=a or t
gtgtcaccatcatgggtcatggcagccttcaactcctgggctcaagcagtcctcctgcctcagtctcccaagtagctgggaagctgggactataggcacatgctacttcacctagctaatttttaaatttcctwtagagvhccgtaacctggctagttatttwactttttgtagagacggggtctcactttgttgcccaagccagtctcaaactcctgtgctcaaactgtcctccgcacc

SEQ ID NO: 30026 - DNA, 110 bp, Homo sapiens
tcttaaccatcattaagcatactacagttcagtggtattaatacatttacgtagttgtgcaaccatcaccaccatccatctccagatcccttttcacctggtaaaactga

SEQ ID NO: 30027 - DNA, 248 bp, Homo sapiens
  misc_feature 121: m=a or c
  misc_feature 125: w=a or t
  misc_feature 138: n=a, g, c or t
  misc_feature 148: w=a or t
  misc_feature 153: w=a or t
  misc_feature 198: y=c or t
  misc_feature 220: m=a or c
  misc_feature 221: w=a or t
  misc_feature 235: m=a or c
  misc_feature 237: r=a or g
cggtgaaaccagcctgttctggcgggactacttatcaggccctgcccttaaaggaaaattattttgaaaagaaagagtggatcttattctctttctagctcattgtgctttctggcttatmtctwctttagttttgantttgatatcwgtttwtaggattttatgattctgtattctgtggagaagcatgggaggggyaaggtgtgttggaaactgggcmwaaaaaccaggaggmaraaatggatgtc

SEQ ID NO: 30028 - DNA, 188 bp, Homo sapiens
  misc_feature 7: r=a or g
  misc_feature 8: r=a or g
  misc_feature 14: d=a or g or t
  misc_feature 15: r=a or g
  misc_feature 123: m=a or c
  misc_feature 124: m=a or c
  misc_feature 133: w=a or t
ccatcarracccadragcaaatatcgtataatagacacactagttagtagcatccttatcaaactcaagaacaagagaagggtgtctgctatcacagctactattcaacgttcttctggagtmmtaagcttgwtaagaaaacaacatgcataaatattggaggcagaattataatcgtaggcggcagt

SEQ ID NO: 30029 - DNA, 58 bp, Homo sapiens
  misc_feature 15: w=a or t
  misc_feature 16: w=a or t
caaacctgaggtccwwagaaaagaattaaccttcatttgattccttattaaaatctct

SEQ ID NO: 30030 - DNA, 178 bp, Homo sapiens
  misc_feature 114: y=c or t
ttggttttcctcttaccattctgactgttcttctgttttcttagccagtttattcttccttacacaactgggggtagaattcctccaggctcagctggagatcttcttcgcatytcatttctgtccttcctgattgagaccactcatggccatggcagacatctctaaattggcatca

SEQ ID NO: 30031 - DNA, 285 bp, Homo sapiens
  misc_feature 10: w=a or t
  misc_feature 116: r=a or g
  misc_feature 126: r=a or g
tgttaatttwtttttcagaaggctgactccagagtgaacaaaagtagcttgtgtggaattatttttacttatgctccactttgaatgcaatgtgtgccaagcacatcaccttatgrtgacagcttrttgcagccagaaggtctctaatttaaataaattctggttgtgttaatcaccaaagatataattatgtcatcatatgctgtgtgctttttaaataaatgattctgaaacagactgttctttgatagtttcatcattttttcatgagcttgcagaggaagt

SEQ ID NO: 30032 - DNA, 147 bp, Homo sapiens
  misc_feature 55: r=a or g
  misc_feature 108: w=a or t
aggagagtaagtaatcccctcaagatcacacagtcaggcctgcttgactccaaarccttcaccatactgccatgcgaatggtgagattcttggggaataaaggataawcatatactgcttctaagtctggtttttatagctagttag

SEQ ID NO: 30033 - DNA, 62 bp, Homo sapiens
  misc_feature 10: k=g or t
  misc_feature 14: w=a or t
caatgattakggcwaaagttttgcatgtacttcacctctgtatttctccctaatttcatcca

SEQ ID NO: 30034 - DNA, 228 bp, Homo sapiens
tcagtttttgcaaaaggcagctgggatttttttataggaattccactgaacacataaatctctttggggagtattggcttcttaatattgtcttctaatccatgaacatgagaagtctttccacttatttggattttttaaaaatttatttcacagtgttttcttattttattattcctaaacattctattcttttttaaaaaattaaaataaattctttccaacccc

SEQ ID NO: 30035 - DNA, 225 bp, Homo sapiens
gcttcccaaggtaactatggaaaaggatgcaatagcaataggaatgtgtaagttctgggctgtttaatatagttttctcaggtcaggcgtagtggctcatgtctgtaattctagcactttgggaagctgagacaggaggattgcttgagcccaggagttcgagaccagactaggcaacatcgtgagaccctgtctacaaaaaaaagaaaatattagctgggcgaa

SEQ ID NO: 30036 - DNA, 332 bp, Homo sapiens
  misc_feature 243: n=a, g, c or t
  misc_feature 244: w=a or t
  misc_feature 245: n=a, g, c or t
ataaaaataaaaagaggatgtggatgtagaggaaacttactggctattagctgttggcagagtgtgtattggtaccaacttctttggaaaacaatttggtgtatttggcattagttacatgcttagatacaaggagaaactcttgcttgtatggacctcaggagacaaatacaaaaatgtttagagcagcattgtttattgtagcaagaaatgaggaacaactcaaacgtccactgatgtttnwnctatgtgtgttaaaaccatatgagttacacagcactattttaacaaattaaaaacagaaaatacttcaaggaatgactagcctacct

SEQ ID NO: 30037 - DNA, 95 bp, Homo sapiens
tgtgcctcagcctcccgagtagctgggacaacaggcgcgccgccacacccgactaatttttgtatttttagtagagatggagtttcaccatgacc

SEQ ID NO: 30038 - DNA, 208 bp, Homo sapiens
  misc_feature 126: m=a or c
  misc_feature 180: h=a or c or t
  misc_feature 183: r=a or g
tttgctctgtcacccaggctggagtgcagtggtgtagtcatagctcactgcagcctcaaagtcctgagttcaagcaatcctcttgcctcagcctcccaacgtgctgggatctcaggcgggagcaamtgcgcctggcccgaaaccaagctttcttatcccaagcgctgacctttatcaaghtgrgctaatcctttatcatctcctaagt

SEQ ID NO: 30039 - DNA, 230 bp, Homo sapiens
  misc_feature 222: m=a or c
caatgaaaagtgcattgtcaagcaagttaccactgtagataagtggggcttaaacctcctgggagccagtggggaacacatgacctcagagtaatctcatctaaggggaagaaggagctgggttttttaaacacctagtcccataagtacttggtttaaggctcttccaggaagtcttaattctctgacacttcagtgaatacaggcagaacaggctcaagmatccttcc

SEQ ID NO: 30040 - DNA, 110 bp, Homo sapiens
  misc_feature 15: d=a or g or t
cgaaggcacagattdgggctgaggttatctgcatgtacatggaatttaaaaccgtgaaactagtatattccacccagactcttaaagaaattgagtaaagaccaggaacc

SEQ ID NO: 30041 - DNA, 439 bp, Homo sapiens
  misc_feature 228: y=c or t
  misc_feature 229: m=a or c
  misc_feature 259: r=a or g
  misc_feature 321: n=a, g, c or t
  misc_feature 322: n=a, g, c or t
  misc_feature 371: w=a or t
  misc_feature 372: n=a, g, c or t
gctcacccttgagataaacttctatttcattttcatttcggtttatatgtgggttttcttccaggtctgatgttaagcctataatattgcaatgtgatgttttgaagttaaggtgtaatagagccagtgaaccaagggttcacaccccagtgaaatacaaatattcagaattgagccactgtgttgccatactgattatgtaatgtgtgattaacaagtataatgtgymactttcaacatcagtttcatgccaaagttrcattttattagattatttgggagttcactttgggcccaaaggctcgtgtctacataataagnncttatgatttttctttttgtctttgttttattttttgttttgtgttttwngctttctagaccatgccagagtaatctcagctttctttagttactggatcacacatatccttcctga

SEQ ID NO: 30042 - DNA, 108 bp, Homo sapiens
ccacacaaattgacaaaatcagaaagtcacctgtttgttctgtaagcataatgtattccatcagatacagctcttgagttttatgcatgaaatgtctttttttttttt

SEQ ID NO: 30043 - DNA, 187 bp, Homo sapiens
attatcccgccacgtggctctagccttgttgatgtacctgttactttctcccactgcaacatttttgttaatgtctggcttctttctgcagaagagttcctcctcctgacatgcacttcattctctgcttttctatgtcttgacaactctcttatggtagtcattttcttatactgtagccccccaa

SEQ ID NO: 30044 - DNA, 97 bp, Homo sapiens
tttttctgtctgtatttctgattggataatttttgttgttcatttttcaaggtcagtatctctcctgtcatttccaatctgcttttaagccagcccc

SEQ ID NO: 30045 - DNA, 233 bp, Homo sapiens
  misc_feature 207: r=a or g
  misc_feature 208: k=g or t
tagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattrkcacagcagttaatatcaccatagca

SEQ ID NO: 30046 - DNA, 125 bp, Homo sapiens
  misc_feature 110: y=c or t
ttggcccctctagtcctgtgtccttgatgtctgtgaacggccactcctgagttctgtctgtgaggctcactgctgctagcatgttggagcccaagggcattgaggggccytcccctgccacccca

SEQ ID NO: 30047 - DNA, 266 bp, Homo sapiens
  misc_feature 235: n=a, g, c or t
cagatgaatatattattcagcctcatttagggagtaaagtatgataagtgcatctacaagtgctgaaatttgtagaacaaatgaggtcatttttgtgaagtaggctgagaacagactggtgtgtgtggatgggggaaaggatggtcgctagcttgttttggttttaagtgtaggctataccttgaattaacttgggaagtactgttactagcgacagtccctagtcattcattgnagacttgttgtcagcctcccatgtggagata

SEQ ID NO: 30048 - DNA, 94 bp, Homo sapiens
  misc_feature 16: k=g or t
  misc_feature 32: k=g or t
  misc_feature 52: y=c or t
  misc_feature 62: y=c or t
aggctcgtctgaactkgaagacaccccacatkccaagatgcccgaggttccygggaatgccyggggttcttcgatccggaaaatcctaccggca

SEQ ID NO: 30049 - DNA, 141 bp, Homo sapiens
tacttgtacttatctgtgtgtgtgaagctctacacagtcttatcctgtctagaggtttgtgattaccttactacagttgagacagagcacttccaaattataactggacccatgatctccctactgtcttccgaccccact

SEQ ID NO: 30050 - DNA, 112 bp, Homo sapiens
cacttactgagtatacagttgtttaagaaaattaaagaataaaaaaatctttagaagattaaagtgttaaacatacgtatgtctacagttgacatattaagttggctgctca

SEQ ID NO: 30051 - DNA, 233 bp, Homo sapiens
  misc_feature 16: s=g or c
  misc_feature 17: r=a or g
  misc_feature 208: k=g or t
  misc_feature 209: r=a or g
tcaataatgcactaasratttctttaaaaaaacactaatactgtacagtatttctgtgttttagtttttcccacagctgttgaaaatttcagccttgatttgaaacatgacctgcatgacaggctataagttgtcaatagttctttttctttggaaaagtacagttgtggcatttactcactttagcagatagctaaaagggaaaaakraggaaaaatatacactggacgctt

SEQ ID NO: 30052 - DNA, 189 bp, Homo sapiens
acagtccagtgtgaggggagcggcgctaagagcaggcgacgccgccgccgccaccaccaccgccatagatacactctcatcctacgggccacgcctgggccttgctgcccaggaaagcttcggccccgcagctcggcttgctgcggtctcaggtttctttacctccagaaagaagaatattggcccgac

SEQ ID NO: 30053 - DNA, 434 bp, Homo sapiens
  misc_feature 413: d=a or g or t
  misc_feature 414: n=a, g, c or t
catatgttcacgcaaaatatgcttaggctgtcaaattagcacaacaaagaatgtgtttcactatcttttctaggctaatttgtcttgagctgttgtctatagagcagtttacagacttgtgtcttgtatcattttccagtgccagggttctgaaattcattcagaacctgttagattaaagctgcaccctgtgattatttgaaaagaattagcttgagagtgatgtcactatatttgagttcttagagaagtatgagtggaacttgagtacagttgaattattaaatatgcaagttagaaattaagtctactgaaaaatttacattttgagtcaggttttgtgtcagtactttagcagtttttgagaatgtgtttgatatcacagtgtttgtaaattctatgaaaaatgcatdntccaaacaacttatacatgc

SEQ ID NO: 30054 - DNA, 167 bp, Homo sapiens
tcaacccattggtatttaaattttgcttgttaaattgcatgttttaacatatcttttaacagttaattcaggacagcagaagagaaactaaaaatgtgagtctcttgcttcagaatggaaatgttggtacctttggttctcactgaaacactgtctataccacctgc

SEQ ID NO: 30055 - DNA, 88 bp, Homo sapiens
  misc_feature 40: s=g or c
tgctcctcctgtcagtcactgactctgatggccttgggcsggctgcatcagcagcccttaaagaaagacccctccctcaacccccttc

SEQ ID NO: 30056 - DNA, 317 bp, Homo sapiens
  misc_feature 250: w=a or t
catcagaattgctaaaattaaaaataatggtaacgtgaaatgctggagaaacctaaacagtcatgcattgctgctggaaatgtaaaatggtacaactacttcaggaaatagtttggtattttcttataaaactaaacgtgcaattactatatgagccagcaattgcactcttggacatttatttcagaaaaatgaaaatttatatccatacaaaaatctatgtacaaatattcataacaacttcaatcawagtagccaaaaactgggactatagctcaagggtagagcattttactgcataatagccaaaaactagg

SEQ ID NO: 30057 - DNA, 148 bp, Homo sapiens
  misc_feature 135: n=a, g, c or t
aaatgtacatgtaaaatgtatgttttgtgtaaatgtatacaaaatatacatttgtagctaaaagttctctttttcttctagttctgtgtcctacatagagcagcaactttatctgcggtgggctccaagctaganttccgacagccgt

SEQ ID NO: 30058 - DNA, 173 bp, Homo sapiens
ttcaccaaaagtcaccacccttaattttttgaacatcctcctggaaatatttatatgtatataagcatacgtcattatttttcccacaaatgacatattattttatatgcagatctgtatttgcttatttcaaataatacatgtcttagacaactttatcatttcacggagac

SEQ ID NO: 30059 - DNA, 100 bp, Homo sapiens
aaggcggtttccacacacttccctcccccttgcctgccatctggtccagggctgggctgctcacagccaatcatccagcaaggcccatggcccacgggcc

SEQ ID NO: 30060 - DNA, 213 bp, Homo sapiens
  misc_feature 142: y=c or t
  misc_feature 179: b=c or g or t
ttgttaaccacattccaaaatgtggaacatttcttttagaaatgaaaatatttcaaggctgatgtattttaagactacacattatcaggaaacatacattgagagttcgcttaattaaaggttgttgggcatcaaattatgyttagtaggttactattctctaacaactcaaggatgcbttaatggatctgaatttgacaaagagcgtgccgt

SEQ ID NO: 30061 - DNA, 139 bp, Homo sapiens
  misc_feature 121: b=c or g or t
cccttcttagtttttgtttttggttttagagacagggtctcgctctgtcaccgaggctagagtgcagcggcatgatcatggctcactgtaactttgaactcccggtctcaagcgatcctcbtccctcagcccccggatc

SEQ ID NO: 30062 - DNA, 255 bp, Homo sapiens
  misc_feature 165: k=g or t
  misc_feature 166: s=g or c
tacagttttccatagttttcatatttttaatttgtgtaaaactaccttcaacagttatgatggattccttatctaaagttgatcagtattctaaatgctcaaaatggtgtatatgagctcgtcatctttgaataaggttttctagtgagtttagacacaatttaksgataagaaatgtttcaattatgtgcttcattgctataggtggatctccccatagtttcacctggaatttgtacaatatcaagggctgaa

SEQ ID NO: 30063 - DNA, 222 bp, Homo sapiens
  misc_feature 96: b=c or g or t
  misc_feature 121: k=g or t
  misc_feature 158: k=g or t
  misc_feature 218: y=c or t
  misc_feature 219: y=c or t
agactgcccacttcagaatgcggctgcacatgtgattcagggggttgtaattatttctcaataccaagggttctctttggctatagggtttcaacbctacggctcggatcggcaacagackacttctaaattccagagtctagtgaagggggagagckctaactctccagctccactggggtccagtttcttacagaatggggtagcagagaggaggyycga

SEQ ID NO: 30064 - DNA, 275 bp, Homo sapiens
  misc_feature 130: k=g or t
  misc_feature 132: n=a, g, c or t
  misc_feature 133: n=a, g, c or t
tttaagtaatataaacttaaaattttctgtgtttataatttattacatgaatgttgtaatttatttccaggtttaattattttaaggttaaaaggtgtgtgtgagtgaacatcttgagcccttgctgagkgnnagagattgttctaagcttttaacctgttatctcatttggtcttcaaaggacctttatgagttagatactgtaattttcgcaatatattaaatgagaaaattgtggcatattgtagtttatagttaatcatcattcccaccga

SEQ ID NO: 30065 - DNA, 97 bp, Homo sapiens
ttctgattggtttgtttataaaccttgagctagatacagagtgccgattggtgtatttacaatccctgagctagacataaaggttctccacggcccc

SEQ ID NO: 30066 - DNA, 140 bp, Homo sapiens
ttgtcttccacaaaaccagtccctggtgccacaaaggttggggactacatagaactcaatgaaatgagaagtagtttctgattcagctaatgtctgttaagtgattctctctatagatccaagtattatgagcaacgctc

SEQ ID NO: 30067 - DNA, 353 bp, Homo sapiens
  misc_feature 301: w=a or t
ttcttttgtgcataattttacacctcagagtctgtgctttggggtgctttttcagtgttggaaatagaacttcacagtgcctttaatcaggctctttggaccaacaggcattgtagtactgccagcagaataggacaaagttacctgccaaggggagcatcctttgttatctccgacctcattaataccaatcaattgagttaacaatcaacacatactgcttggattactcaaccctgggagtttaaaaatactcatgcctgagccccacctgcagacattctaaggtctggtctgtgtwctgggcatctgaattttgaaattagccctaggtgattctaaagagcagccct

SEQ ID NO: 30068 - DNA, 404 bp, Homo sapiens
  misc_feature 117: r=a or g
  misc_feature 277: s=g or c
  misc_feature 295: r=a or g
  misc_feature 307: m=a or c
  misc_feature 354: v=a or c or g
  misc_feature 355: h=a or c or t
cagatatattgttcccttgctatgaacaaggctgacacaacaggaggcaggcccccagagagcgagaggtaggaagagcattctaagatcagctgcaagcctggaaggcaggggtarctttcttcaccagggaggaaagggtgcacagtcagtggacagaaagtagatgggagcaaccccagaaatacaggtaatgagcaggagttggggcatattcttgttttcatgctttgaggactagttgggcttcgtattttgcttttgtttgtccatagasgagtccgaggaagtgcargagttcagaggmcagttgaatttgaattcctctccctacagaaatggaatgtgactagvhgagtgagaagagaaagtgatatgttctccttacccctcctttccacaaa

SEQ ID NO: 30069 - DNA, 193 bp, Homo sapiens
ttttttttcatttttgtgagtacggtgcctcctaaacaatcacatgaggatttgagactgttagaactcagtgttgttatccacacaaacggaaaaactcatttttaaaaaatgattgaaaatatcagatgaaataaaaaatcaaaattaactgtattatggaaatggtgttaggctagaagtagcccaaagg

SEQ ID NO: 30070 - DNA, 180 bp, Homo sapiens
tgagaaaataactatttcctttgctagggatgcagtaatcagcaatgcctgttgcaaccataagttacaccatattttctcaaagaaacatggtagtaatcagaggccattgttcaaagtactgactttagtcagctgacctgcaatcaaacctcagtttaggcacttactagccgtgtt

SEQ ID NO: 30071 - DNA, 61 bp, Homo sapiens
agggaacatatgcagaggtgcttttaaaaagcatatgccaccttttttattaattattata

SEQ ID NO: 30072 - DNA, 440 bp, Homo sapiens
  misc_feature 440: m=a or c
ccttacaatccacttatcagtgtggttccactttaactatctaattttatgtaacccatgttggtagatttctcttcacaaacaattatttatgcattctctagcatgggtatccgtggagtcagggaaatgattgaagagtgggatgcttccctcttatagttactcaacatagcatttgtttaagagatttaattaatggaacttttccaaaaggatcaatgatatacctggtgattgactttcactcagcatcataggctcatgaacttgcacagcgagggtcaggagtaaagaggtaggaaatgtctccttgggtgaggaagttacctgctactatctcctaacaagcatttttctctcagatgatttgctggccacactttctgcattttgctattaattcaaccaggaatgacgatgggtgcttaaaactgttm

SEQ ID NO: 30073 - DNA, 255 bp, Homo sapiens
atctttgattttcaacactttgactgtgatgtacctgaggttggttttctttgtatttattctgcttggagttcactgagctgatgcaatctgtgacttgatttcttttattagttttagaaaattcttgtctattatctctccaaagatttcttctgtctcactctttcttttccttatgggacttcaattacaaatatgttaaaccatttgctatcatcctaaggatcatagatgctctgttttatcccccga

SEQ ID NO: 30074 - DNA, 121 bp, Homo sapiens
aatgattccacttcccccggaacccagatcatccccgcgatttcctgtttattgcattaaggcgccgggtttccggggctcctggccccgcttattccgcgggggtcggcggggtcggcct

SEQ ID NO: 30075 - DNA, 226 bp, Homo sapiens
  misc_feature 189: r=a or g
tttaatagtttgccttgaggtcaggccttgttaaggagaacagagtgctcctaagacattttgatatagttgctttttttcttctttctctgccagaagcaagaaggctttttcctcagatcttcacagtaagaaccttgtagggctcctggaggtaaaactcaggaaagtgtgcctcctcccccacgrcgagactgagcccctaagacatttttcacccataagc

SEQ ID NO: 30076 - DNA, 310 bp, Homo sapiens
tcgacaaagaatcgtcagaggaactctcaaactaataggcttttcttgtttttagagccttattgtcttaattattaaaaggcaggataaatgaataggtactttgaaggccatcttagtaaatatagccaggccttaattttaggtattgtatatttatatttttatagctcttcgagaggtaatgggagaaagatgcagctgaagaaagatgcagcttggtgtatattattgtgaactttccgaaggcaagaaagaatttctgtttttcatgattctttatgctttgggaagaatgtggtagagaagg

SEQ ID NO: 30077 - DNA, 203 bp, Homo sapiens
tactattagatattatactggctaggcatggtggcttatgtctgtagttgtagcactttgggaggccgaggcaggtggatcacttgaggccaggagttcaagaccagcctggccaacgtggagaaaccccatctctactaaaaatacaaaaattagctgatttgtccactgtgaagttacttttttaaaatttgagggggccc

SEQ ID NO: 30078 - DNA, 145 bp, Homo sapiens
gaaatcagtaggttatctttaatctttacactacatgcagatccatagtatcctttgtagtgttgtaaatacttttgctttgaaaactttttcattgtcctaaatcaccctgactctgaccagtctttcagttctccaaaagccc

SEQ ID NO: 30079 - DNA, 261 bp, Homo sapiens
caaagtgctgggattacaggtgtgagccactgcgcccggccatattcagtgtttctaaataaatgtctatttaagcttatttctagatagatatttaactatgaaaaatcctattgacatactcgtaaatgccactgggatacaagaagtacaagaaatggtgtctcttaaagagtttccactcaagtaaggatgtccattaaaaattaacacaagctaatatagaaatgctaagtgaatggcagatactttaaggagtcg

SEQ ID NO: 30080 - DNA, 130 bp, Homo sapiens
gagcgtgtgatccattaccaagtctcctcatgaaaaccacagtgagtcagcccttcacagaactactacggaagaaaattattcatcacagtgtacagttaaacaaaggaatctcagtcacaccaaacct

SEQ ID NO: 30081 - DNA, 208 bp, Homo sapiens
cctaggtaattgatgttttgccatgatttccaaacttgtgtcagtcccacgttacacgcaaactaaattttaggtttgaaatttgtccctagttagttggtctgcttgacaattttgtgagtcttattaaccccaatcaatagagttgagagactatggctttaaaaaattaatgcaaacctggctttagctgtaataacacccacca

SEQ ID NO: 30082 - DNA, 348 bp, Homo sapiens
  misc_feature 16: y=c or t
  misc_feature 122: n=a, g, c or t
  misc_feature 123: v=a or c or g
  misc_feature 128: r=a or g
aaactatgtatttttytgtaaaaacctgatcacatagagaatatcagtggcttgtgcttgtgcttcgatctaaccagcttcttgacccacccccccttggtatgcagtgttaatgctcaggnvttgaraatagtacactccaatgtctcttttgcaagagtttttcacagaggattacatttgttcaaaagactctaataaaattgtgtgatcaatcttcacttgtggtttttatgtgacttttttctagttttgcatttgataactgctgtttaattctgaaaatgttgtctcaaaccagatgtcagggacaggcttgaagattcctgatgtctcagcacccagaca

SEQ ID NO: 30083 - DNA, 167 bp, Homo sapiens
  misc_feature 54: k=g or t
tattgccatatcgttgatataccacacaattcgcccatttaaggtatgcaattkaatgcttttagtatgttcacagagctgtgtacccatcgccataatcagctgtagaaaatttcataacctcatgccctttagtaccccccactcactaccccacaggacgggtc

SEQ ID NO: 30084 - DNA, 190 bp, Homo sapiens
ctggatgtctgtttccttcctcagatttcagaagtgttcggtaaataagctttgtgccctctttcttctttctgctctttcttggatttccataatgtgttggtctgcataatgatgtgtataaggctctcttaactctttttcattcttatttatctttgttctctgagtggataatttcaaatggccc

SEQ ID NO: 30085 - DNA, 108 bp, Homo sapiens
tgtgttcttgtcctctgcccaagtgattaacctttgctccagtggttttcaaacctggctgctgttagaatcacctggcagtgtttaaaaatgactgatgcccagcat

SEQ ID NO: 30086 - DNA, 95 bp, Homo sapiens
cattacgtggatttttaggtttttaaacatgtcctataggtgtgggtaatatgcatgtatacacacacacacacacacacacacacacacatata

SEQ ID NO: 30087 - DNA, 167 bp, Homo sapiens
  misc_feature 150: d=a or g or t
caataatgcctaagatgtttattatcttgccctttgcagaaaaaaattttcagcttttgctctggaatgattttgcatctcttccacccaacttccagtgtatcaatggccagaaaaataatctatatgttaatttgttaatttgatggdtcatggttcaaggctgc

SEQ ID NO: 30088 - DNA, 113 bp, Homo sapiens
  misc_feature 19: w=a or t
  misc_feature 46: w=a or t
  misc_feature 91: y=c or t
gagcgccccggcgggaggwttttctatatgagtggagaagacagcwgttaccagggaggtcatacaacatttttttaggatgtctgaagaygaagaaaaagtgaaattacgcc

SEQ ID NO: 30089 - DNA, 90 bp, Homo sapiens
tatttttttaaattatctgttttggcaaacaatgtaattaccatttgttcttaactgtttttcagctttacattactagcacagacattt

SEQ ID NO: 30090 - DNA, 124 bp, Homo sapiens
tttatagtatgacatactttgtgagtttgaagccttcaaagaacgtggtttttggtcttctcacaaatgctgacagattagtgtgtaacttttccttgtagatattacaaagaaacaggatagg

SEQ ID NO: 30091 - DNA, 117 bp, Homo sapiens
cacagaattataccatcctacctcatctaaagtcgatccgaggctggtccgatggtagtgggttaccagaacttaataacattaataactctaaagttagtatacaaccccgcccac

SEQ ID NO: 30092 - DNA, 175 bp, Homo sapiens
tagcacacttcacctgggaaacttgatgtataagctatagattgctattcatagatcattcagaaatatattaaatttgagatttttttttacccccagacaagagaaagtgcaaagtaaattgattctgtttctgtttgcaactgtactaagatattgcctataatgcccccat

SEQ ID NO: 30093 - DNA, 300 bp, Homo sapiens
aatgtaccaaacggatacaagatggaaataaaagggggaaactgtagggaggcgggtgtctgggaaatctccatagtttatgatcacttttttggtaaccctaaaactgttcttagtctgtttttcaaaaagagccattaaggtgtgagaagacctggaggaagcttgaatgcatattgtagtgaaagaagccagtctgaaaaagctactatgtagttccaactatatgacattctggaaaagataaaactatagagacagcaaaatgatcagtggttttggtggttttgtggggggtgg

SEQ ID NO: 30094 - DNA, 238 bp, Homo sapiens
  misc_feature 16: s=g or c
  misc_feature 17: r=a or g
taacaaccatctccgsrccagaagaagacaccctgacccaggaccttaaacattaggacctggggaagagggaaggggaaggagtaaagaggaagactaggagaacactgcaaagccaagcaccagaaactttccaccctggattctctacttttgctccatggacagagccccagtcagccaagtttcagacagaccgtgagcagtccctgtgcgttttattgcgacctgccggtgg

SEQ ID NO: 30095 - DNA, 202 bp, Homo sapiens
cattttctcaagactcaaaattggctaaactagaaattatgtaagatcactacaaataagtgacagagaaccctaaaagctttttggcagctactgtatccataatgatttagtcatgtgacttgaatttatggttcttgccttccaaatggcagcccttgcttgggagagctttgaggttcaagaatgctgacacagtgtg

SEQ ID NO: 30096 - DNA, 191 bp, Homo sapiens
ttgtgcatatacctaatgccactgaattgtacactttaaaatggttgaggccgggtgcggtggctcacacctgtaatcccagcactttgggaggccaaggtgggtggattacctgaggtcaggagtttgagcggcctggccaacatggtgaaaccctgtctctactaagaatacaaaaattagccggttaa

SEQ ID NO: 30097 - DNA, 132 bp, Homo sapiens
caaccagcattggcagcttctttcccctatcgtaaagttagtgtcatatataaaaataactagaaaggcatattttatatgtatgcctatctaattataagtatcattcacactgtctcccaaacccacccc

SEQ ID NO: 30098 - DNA, 231 bp, Homo sapiens
  misc_feature 42: r=a or g
  misc_feature 102: m=a or c
  misc_feature 117: s=g or c
  misc_feature 121: k=g or t
  misc_feature 132: r=a or g
  misc_feature 133: s=g or c
  misc_feature 144: s=g or c
  misc_feature 152: v=a or c or g
  misc_feature 170: k=g or t
  misc_feature 200: b=c or g or t
  misc_feature 214: m=a or c
attcggctgtggggagtaccggctgcagtcggctgtgccggragggtaggatggcgtctggccgatgcggtgatagcaccgaaagcagacggccgccagggmtccccctaccccccsgaaktttctccccarsggcgggggatsgggggtavgcggttcctctgttcttkctgcgttccccgcggcctcttaccacagabacgcgggcctccamcgtcctagccctcccgc

SEQ ID NO: 30099 - DNA, 212 bp, Homo sapiens
aaattaaagcaaagcaatcatgtggtccttactctaaaagagacaatatgtaaatgtactattataataaggtagctctgcagatgtaataagctactcataaattatttgggtttaagaaaacttaagactatgttaaactggacaacatctccatcttgagtgagagtaattagtaactaggatgaccacacattctcctaacacgggca

SEQ ID NO: 30100 - DNA, 265 bp, Homo sapiens
  misc_feature 124: d=a or g or t
  misc_feature 125: m=a or c
  misc_feature 142: v=a or c or g
cacttttagggtttttgacctgaaaagttctgtggcatattttttctttgctatccacttttttttccttgtagttcttccccgcgttctatcctttatcttctagagacctcggtagttcccdmaggaatagtgctttacvgagtctaatggtgatttcttaggtaaagacaggaaacatttttttcttttttacctacaagttccataccaaaaaatgaatgtaaacttttcatgcagttttacacattgaaaatgcaggtag

SEQ ID NO: 30101 - DNA, 250 bp, Homo sapiens
tttctttcattgtgttattgttttataggccctctggcatttatgctttaatgaggttctattttggtgtatttcgaggttttgtttcaagatttagaactccttttagcatttcctgtagcgctggcttagtagcggtgagtcctctcagcatttgtttgtctgaaaaagactttcttttcttgacttaggaagcttagttttgctggatacaaagttcttgactgacaattattctgtttcaggaggc

SEQ ID NO: 30102 - DNA, 307 bp, Homo sapiens
attttagattgaatgcttttcatttttctctttttgaaacaccctgtggttcatgttcttactcagagtaacagtccatgtccccatagcagcccacaaggcaccacgtggccccggctggcctgtccagtgctctcccctccgtccgctcgtcctctgcatgctggcctccctgtcatttctagaacactcaggcattctcttaagccaaggcctttgtagttgtgattccctctgcatggaatgctcttccccagccatctcctgtcactctctcacccaccccatgaggtcatgaccacgccca

SEQ ID NO: 30103 - DNA, 446 bp, Homo sapiens
  misc_feature 194: r=a or g
  misc_feature 195: r=a or g
  misc_feature 199: k=g or t
  misc_feature 256: k=g or t
ataatttccctagtcacactaataacctctgctgtgttgtcctcagtagcactgcacagctccattcaaacagctcaatgtgtgaaaaattggatgtgcacagccgaccaggaatggatgcttcaaaataaaattaacaccaagatacaaacagaagtggcaatgttaaagactactgttctgtggctaggatrrcaaktacaaagcctgaagttgcagcagcaattgcattgtcattttaaccctattcatattkgtgtaactaatttggaatataatcaaagtgaatatccaaggaactttgtaaaggcccatttacagggagttttacattcaatgttacttttgatattaatgattcacaaagtaaaatccttaacttgaataagcagactcaagtgcttcagccctctttaaaagcttgggcagaattccagcaaggtttc

SEQ ID NO: 30104 - DNA, 230 bp, Homo sapiens
  misc_feature 120: r=a or g
  misc_feature 138: r=a or g
  misc_feature 186: y=c or t
  misc_feature 187: y=c or t
  misc_feature 188: b=c or g or t
  misc_feature 189: n=a, g, c or t
gcctcggctgccagaggtgcctttgctaggcccggagccgttggcccgggccggccttgccctattcctctcctcctcctcctcctgggtcccccagggtggctgggcttgggctatgtrggtggtggtggcggggargtcttgggggcctctcagctcccgcccatgcctccctgatgggtgggyybngggcggcctctctctgaggagacctcacccactcctcgccc

SEQ ID NO: 30105 - DNA, 389 bp, Homo sapiens
gactcagagcgctccgggctgcaggagaggaaggtaggggaccaagctaccggtgcagggcctggatccaacccctgctctggaagactgagagctccacattctagctccctttcccccagtccccaaatttgtaggggctccttgaattgcacgccccatgggtggaggatttcatcctgatgtatgatccccaggaaggttcctgcaagtttggcagtttaggggaatcttttggaggttgaaggagggatttagccatctcctaatctcaaggcccttcttcctactttccttctcttttactttactttttttcccgctttctttctttgatatagacaattgatgttttctcagtttcaggatagtgtaagctgaggaaatga

SEQ ID NO: 30106 - DNA, 314 bp, Homo sapiens
taattttaaatctatttcataacctgttttgatctgtctgcatactgctatatgttaatttattacggccttttacaattcacttgtcatctgagattgttctagaaactgatgagggaaaagagtcgtactaaccaaaatgaatgggcaattgacataacattctatttcaggtttccttgtacttggggagccaaagcacaagatctaaggaaatcttattcacatttgtccctcagagcatcttaccctaagccacagaggtataaatagtaagatgagaattgctcattgtctgactccttgcacagcac

SEQ ID NO: 30107 - DNA, 117 bp, Homo sapiens
aataatgtactaattgcatatgatgagtaaattatcaacagcctttaaaaattggtcatataattagtaaatctatgagtttcaacctcttcatctagatgaaatagtcatgaagcc

SEQ ID NO: 30108 - DNA, 239 bp, Homo sapiens
  misc_feature 174: n=a, g, c or t
  misc_feature 176: n=a, g, c or t
  misc_feature 213: w=a or t
  misc_feature 214: r=a or g
aaaaggttgtagatcaaaatacgctctctcatcagtatatgagagggatgacttcccatatttttcccagcactagatgttaacatttattaaaatgttggtttcattactagtctaaaacatagcattcattcatttctaaaggttacattaatttgaccaaaagatgctgantnacgtttttatgtattaaggagagcataggtatacatwrtgaatggcatgttcacccccacctc

SEQ ID NO: 30109 - DNA, 217 bp, Homo sapiens
  misc_feature 117: r=a or g
  misc_feature 151: w=a or t
  misc_feature 162: w=a or t
  misc_feature 165: s=g or c
  misc_feature 166: n=a, g, c or t
  misc_feature 167: s=g or c
ctattttttgcaaataaagtaatatgctttagagtagccagatcctttgggctttgatcactgttagagcatagccaagcgtactaacgcaatatggaaccagatgctagaaagacrtttaaaaaggccatgtatcttaagtagtttatgwagcaggatttwtcsnsctctacctcttgagccaataaatccattctatctaatttgaccaccacta

SEQ ID NO: 30110 - DNA, 102 bp, Homo sapiens
tgaaaaatccttggagtcatttacgttggaaaggaagatacagtgaaaatgatgtaaaaaactggactccagagttgcaaaagtatttaaactttgatcccc

SEQ ID NO: 30111 - DNA, 207 bp, Homo sapiens
tcccttccctcaaggttaaagctcctgtcagactctcagaagggtctgtgggtgttgtatattaggcaaacaggggaaagcttagaggtccttctatatgtgttaataagctgtttctaagtgtttaaatttgaaaagcatcatgttctcatgatttatgggaatgaagcaagtactgaaatcaaattaaatactccctgagtccca

SEQ ID NO: 30112 - DNA, 105 bp, Homo sapiens
aggctgggactttactccgggtggcggcgaggacgagtctgtgctccatcagctgccgcacccgccgcctcccgcccccaaaccccatccccgcggttgagccac

SEQ ID NO: 30113 - DNA, 208 bp, Homo sapiens
gtataagatatccaatcaacaatgtttgtttccagttagtctttagtgtttcctatcacagtatatatatatatgcatatctatatatatacttaaatagattagccagtattttcctaaactatgtctttaaaaatattgtatagtttttttttaagagatatgaggcatataagatataattctaaccctatatgaccccatgacc

SEQ ID NO: 30114 - DNA, 367 bp, Homo sapiens
  misc_feature 322: r=a or g
  misc_feature 363: h=a or c or t
taactaaacaacaggtgcccaatagaagagtggtacctgatttccggtgcaaaattgaaacctatacactcaaacctaggcattatcattcaggacataggcatgggcaaggacttcatgtccaaaacaccaaaagcaaggcaacaaaagccaaaattgacaaatgggatctcattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaraaaaacaaataaccccatcaaaaagtgggtgaaggacatghacaa

SEQ ID NO: 30115 - DNA, 369 bp, Homo sapiens
  misc_feature 213: w=a or t
  misc_feature 214: n=a, g, c or t
  misc_feature 215: n=a, g, c or t
  misc_feature 368: n=a, g, c or t
atctacagaactctccaacacgaaacaacagactatatattattcttagtggcatatgacactctaaaattgatcacaaaattagaattaaaacactcctcagcaaatgcaaaataactgaaatcataacaatctctcagaccacagtgcaatcaaattagaactcaagattaagaaactcactcaaaaccacacaactacatggatattgawnnacgtgctcctgagtgacttctgggtaaataataaaattaaggcagaaatcaagaagctctttgaaaccaatgagaacaaagagacaatgtaccagaatctctgggaggcaactaaagcagtgttaagaggtaaatttatagcactaaatgccnt

SEQ ID NO: 30116 - DNA, 161 bp, Homo sapiens
ttagtgtggctttagtatggcttccttttaatattgtacatacattgtatctttgttttatggtaataagtaataaaaatgtagacttcatattttgtacaaaatgtcctatgtacagaataaaaaagttcatagaaacagcaaatataggtaagtggcaa

SEQ ID NO: 30117 - DNA, 88 bp, Homo sapiens
  misc_feature 88: k=g or t
taactataaatgatgaaaaacgaagcaaacttaacatcagtttttatcaacttaaaacaaccaatatcacaggtaacttttttttttk

SEQ ID NO: 30118 - DNA, 301 bp, Homo sapiens
  misc_feature 138: h=a or c or t
tttctgaagtattttggccgattcagagtttcctagatgtctgttttatatctctctcgtatgtaatggcgtggataagggtaaaaaatatatatatttaaaaaaccaaaaaggtatggaaaaaggattgctctcgahgttgagaacatcagcttttctgttttttttcaccatataaattagagtattctttcgaaaaatgggtggtggttatggtacagaccataacaggctactttgctgctacagtaaggcatgaaagagttcagcgaagttaactgtcttgcagaatttgggggat

SEQ ID NO: 30119 - DNA, 170 bp, Homo sapiens
ttgtttgctcttgacagggtaggcctcttaaaagaaaaaaaacaacttgttttttctttatgaatcccctatgccaaacacataccttccatgcatgacatgagatctgcaaactggattttagccaccgtatttatttagtcaaaaaaattgtcacttgtagcagaccc

SEQ ID NO: 30120 - DNA, 191 bp, Homo sapiens
tattcctaatttttattgaaaattatcagtggagcaaagttataaaattctgaataattgtttagagattacagaaataaataccagatctgagaaatgatacagattgaaattttataagagaggtgagtttgatagccagttccaatttcatactcatatggacttagagaatgttaaggatgccacgt

SEQ ID NO: 30121 - DNA, 187 bp, Homo sapiens
  misc_feature 121: r=a or g
gtttcctaaatatttttcatacatagtcctgtcaacttaagaatgctttagagtctgaagtgaagcttttaaaatgataaattatagggaatgctgtgtaagaagttttacaacctatatrgcatttgccattttaaaagccttagtgagactaaggcttttaaaacacaaaacagacatctggctt

SEQ ID NO: 30122 - DNA, 140 bp, Homo sapiens
ctactcaaaacaaaattttgctgcaataaaaatgaatccattaaagttcccattggtgacatgttaaggtcaggtgttcaaacaataatccaagaaccaccacgtcaggaaaaccgaacttgtttcttcaagcctcagtc

SEQ ID NO: 30123 - DNA, 182 bp, Homo sapiens
aaagaaaagaatggacagtgtttgcagagagttgctcacgagtttccctctaatcctaaatgtcttcatgtctatcagtctgagcagacggtgagtagggcgggcacattctccaggcccttcttcctagctctgtggttgacctctcagcaagtgctatccaggctgggccaaccagaccc

SEQ ID NO: 30124 - DNA, 73 bp, Homo sapiens
  misc_feature 68: s=g or c
cataaaatcttaacttggtcttagcctcgtttctttcactttcggaggtcacgagttaatttgcgtastggca

SEQ ID NO: 30125 - DNA, 123 bp, Homo sapiens
tacatgtgacaaatctgcagtcgtgttttctttctgagttataatgactcagatgtcataattaatttgatgagcaggtgggggttattagccttgtgcttcacttgctaatagctgcacagt

SEQ ID NO: 30126 - DNA, 392 bp, Homo sapiens
  misc_feature 8: y=c or t
  misc_feature 24: v=a or c or g
  misc_feature 81: r=a or g
  misc_feature 349: h=a or c or t
  misc_feature 350: n=a, g, c or t
ctacaacyagaaataccatttgavccatccagcccattactgggtatatacccaaaggactataaatcatgctgctataargacacatgcacatgtatgtttattgtggcactattcacaatagcaaagacttggaaccaacccaaatgtccaacaatgatagactggattaagaaaatgtggcacatatacaccatggaatactatgcagccataaaaaaatgatgagttcatgtcctttgtagggacatggatgaaattggaaatcatcattctcagtaaactattgcaaggacaaaaaaccaaacaccgcatattctcactcataggtgggaattgaacaacgaghncacatggacacaggaaggggaatatcgcactctgggggctga

SEQ ID NO: 30127 - DNA, 255 bp, Homo sapiens
cagaaccacaatgagataccatctcagaatggttattattaaaaagtcaaaaaacaacagatgctggcaaggctgtggagaaaaaaggaacacttttacactgttggtgggagtgtaaattagttcaatcattgtggaagacagtatggcgattcctcaaagacctagagccagaaataccatttgacccagcaatctcattacttgatatatacccaaaggaatataaatcattctgttataaagacacatgcc

SEQ ID NO: 30128 - DNA, 230 bp, Homo sapiens
tactgacaaactttggcattccttggcttgcagctgcacaactccatctctgcttagtagtcacttagctctcattcatctgtgtgtgtgtgtcttcacatgaccttctcctttctcagagtctgtctctgtgtcttttttccttttaaaagtgtgccagtcatattggtttaatggcctacccattccagtataacttcatcttaacttgattacatctgcaaagcccc

SEQ ID NO: 30129 - DNA, 230 bp, Homo sapiens
  misc_feature 11: n=a, g, c or t
  misc_feature 12: y=c or t
  misc_feature 19: m=a or c
aacgcggtganyagccaamatgcctcgcttccttttcgttggcacagcaagtccttgtgccgagcactgattgctaaataaggtatctgggctccagtcacttcatcctaagagcagttgtaatcagagtttcagcagcacacaccgccctctcagggagggagatgctggctgggccgtcttttacaaatggatcgtcagtgtgttcgggtaataaggaaacgagagag

SEQ ID NO: 30130 - DNA, 290 bp, Homo sapiens
  misc_feature 7: b=c or g or t
  misc_feature 8: m=a or c
  misc_feature 12: y=c or t
  misc_feature 138: m=a or c
cagaaabmctgygtcaaggccgggcgtggtggctcacacctgtaatcccagcattttgggaggccgaggcgggcggatcatgaggtcaggagatcgagaccatcctggctaacacggtgaaaaccccatctctactamaaatacaaaaaattcgccgggcatggtggcgggcacctgtagtcccagctactcgggaggctgaggcaggagaatggtgtaaacctgggaggtggaggttgcagtgagccggggacgcgccactgcactccagcctgggcaacaatgcgaga

SEQ ID NO: 30131 - DNA, 280 bp, Homo sapiens
  misc_feature 7: k=g or t
  misc_feature 264: b=c or g or t
aaaatckccagcttaagaagagaataatgaacgcattcccaggaggagctcaaggcttcaaaggtatgctctgcttcaagccccggggaatgtcaccgtggaccctttacgtgtctgagaagtcctccctagaacagaaagcctggccaatggagaagtggaatgcgcgctgtccagggaaacagaacccttgcttccagcatttggaactgacagtgtgaatgagatattttaacactctttccagtggagctttttgtgtabaaagagtcaaccaaac

SEQ ID NO: 30132 - DNA, 115 bp, Homo sapiens
  misc_feature 115: m=a or c
tttaatgacatatgtatgttctatctctttttcaggtcatcctgtacagttctacagcatgaataggcctgcctctcgccatactcccccaacaatagggggctcgttgccctgm

SEQ ID NO: 30133 - DNA, 328 bp, Homo sapiens
  misc_feature 12: y=c or t
  misc_feature 25: m=a or c
  misc_feature 114: r=a or g
  misc_feature 160: r=a or g
tctcatcaactygttgatggtcaamaataggtaaataagatgctttaaattttgaagggtagtatgatgggaataagtagggtgaagtgatacagaatgaatgactgcagttcrgattaaggctatgttaggttggtcagagaagtcctttttgaagcarcaatatataagctgagacttgaataagatgggacatgaagctgggtggagtggttcagggagaggggttagccaatgccctgatgaggtttcattttttggaagaacatttattcaatattactgattgaattttgtcaggcatttgagatagtcatgaacgaaacag

SEQ ID NO: 30134 - DNA, 190 bp, Homo sapiens
ctcttctgtaggatggggatcacaccttctggaataattatgaggctcaaatgaagcttctgattcctggggggaacacggagcagtttcaggttgaacattttgtccctgggcctggggacgtctgactctccttggatcctagcaccctaacgtgcttttcctgcctctccccccttcccaccagcgg

SEQ ID NO: 30135 - DNA, 224 bp, Homo sapiens
tgctctgctgttgccaggtgccagtctgttttcagtgaggctttggacagcagtggggcagaaggcacctgccctttaactgtcagtgaccatgctagacactgttgataccacctccccctacttccgtctccatcctcctgacctcaacaccaaaccatttctcctctgtggtgctttaaaaattgtagcaaatttttgtgtggtgcaagaatgcatggcct

SEQ ID NO: 30136 - DNA, 219 bp, Homo sapiens
  misc_feature 7: m=a or c
  misc_feature 8: m=a or c
  misc_feature 115: n=a, g, c or t
  misc_feature 116: h=a or c or t
  misc_feature 134: r=a or g
  misc_feature 135: w=a or t
  misc_feature 149: w=a or t
  misc_feature 150: w=a or t
aatgcammattactcttttgcgatctttttatgaaaataattaacttagcctttagcgtatctagattttgattttatgcattatttttagcaagtttctaagatactaccttcnhaggcaaattgatttttarwtaaaaaagaaaacwwtttgtgtgattgaacatgtgcttggaagttagtaaaaagaaaaatattgctttatttagaactgggatc

SEQ ID NO: 30137 - DNA, 112 bp, Homo sapiens
tggtgcccttttcagagctctgctgttcctttataaatcctaaagaactgagtctggggagaggagaggggatgccagctgctgcctctgacttcagggagaagcagactat

SEQ ID NO: 30138 - DNA, 112 bp, Homo sapiens
atactcttactatataatctagcaatcacactccttggtatttacccaaatgaactgaaaacttacatccacacagaagcctgcacgtagctgggcatggtgctgtgggcct

SEQ ID NO: 30139 - DNA, 117 bp, Homo sapiens
  misc_feature 45: m=a or c
  misc_feature 47: m=a or c
  misc_feature 54: m=a or c
  misc_feature 70: r=a or g
  misc_feature 71: w=a or t
  misc_feature 81: y=c or t
aaaatacatagtcattcaggtacttgttatcttctttgatatcamamtccttamtatcctatgtgggtgrwtcccttttcygtctcttaccattattctgtcatagtagatatttgc

SEQ ID NO: 30140 - DNA, 316 bp, Homo sapiens
  misc_feature 7: s=g or c
ctaaaastatttttatgtttctttaacatggcttaaattttgaacttaatgtatcaagttagtatggtcatattaatacctgtgcttttcagattcttcaaacacctaaatgaaagtgataaattcaaaactgatccttttagttcctcattatatgatatgaagggattaactgtagcaggatagtcaacctgaccgtacggcatggtgctttttttcaggataaatcttcagacaaaaaagtgcaaacaaaagggaaaaggggagcaaagggaaaacaggccgaagtggctaaccaagaaactaaagaagactt

SEQ ID NO: 30141 - DNA, 119 bp, Homo sapiens
  misc_feature 12: y=c or t
  misc_feature 36: r=a or g
  misc_feature 43: w=a or t
  misc_feature 44: k=g or t
tcaaatatcagytccccagaaaggtctgcttaagaragacctwkctaagtagaacccccaaaaaagttcagcctcaattacgttgttgcactgtctttaaagtgcttaccacagccccc

SEQ ID NO: 30142 - DNA, 105 bp, Homo sapiens
ttggcatttcacactgagatctgtattcctagtgaataaaagacagctactatattaggagggattccattttcacaattgcaaaacagatatttcaggaacgta

SEQ ID NO: 30143 - DNA, 120 bp, Homo sapiens
ctattgtgtgctggctgccaccccaactgctattatttttattggtgagatatccatgtatttcataaaatcaacaagagaatccctgattgctcaggagaaaacaattctgaccggaag

SEQ ID NO: 30144 - DNA, 319 bp, Homo sapiens
  misc_feature 8: w=a or t
  misc_feature 95: k=g or t
  misc_feature 139: w=a or t
  misc_feature 157: b=c or g or t
attaggtwgatttcatttcacagctcaccggcccacttctcccacctcatcggagcaagttgtatatttaactgtgccctggaatgacatatttkaaaacagtaggtttgacatttctggaaacacttgcttggcatawcctgaactcctcagtgtbagccaaagatggcaattacagcgtttcatcaagtctagagaagaggtcttttaaatcaccttttataggctttagtttctttagcttgaagaaacccaaaactatcccttaatcgaatgcgaaattctacccatctaacaacataatcgcaataaccggcat

SEQ ID NO: 30145 - DNA, 121 bp, Homo sapiens
tattgtagagaacactctccattttttccccttacccttttaccagcactgctaaatggattgatttgagattcacctctttttccctgtggaggtgataatggacaacggaatgaccaga

SEQ ID NO: 30146 - DNA, 297 bp, Homo sapiens
  misc_feature 7: n=a, g, c or t
  misc_feature 104: r=a or g
  misc_feature 120: m=a or c
  misc_feature 123: r=a or g
tacagancatctcacactcagaaagctggcacatttttgaaagcccaagtgtgggtaagtgcgtggaacaacgataattcacactgctttatgagtagaaattrtgagaaatattgtgcmagrcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataatt

SEQ ID NO: 30147 - DNA, 131 bp, Homo sapiens
  misc_feature 112: w=a or t
  misc_feature 114: w=a or t
  misc_feature 119: w=a or t
  misc_feature 129: m=a or c
cacatctaatcagaaataaatagtaacttctcttaaaagcaaaatttattcaaagacctttgctaacattcttaaatatctgctagctgtaataaataaatcagtgtacttwawgttcwtagctcccgmac

SEQ ID NO: 30148 - DNA, 264 bp, Homo sapiens
  misc_feature 8: y=c or t
  misc_feature 9: y=c or t
  misc_feature 14: w=a or t
  misc_feature 21: y=c or t
  misc_feature 24: w=a or t
  misc_feature 74: m=a or c
  misc_feature 75: y=c or t
  misc_feature 120: w=a or t
tatttatyyttacwacttgtyttwgtttttttgagacagtgtcttgctctgtcgcccaggctggagagcagtgmyattatcgtgactcacggcagcctcgacctcccagactcaggtgawcccttcacctcagcctcccaggcagctgggaccatagctatgaacaaacacttccagctatgttttgtattttttgtgaagacggagtctcaccatgttgcccaggctgatctccaactcccaggctgaagcaattcctcagct

SEQ ID NO: 30149 - DNA, 184 bp, Homo sapiens
  misc_feature 12: y=c or t
  misc_feature 123: w=a or t
tgtaattttgtygtcagtgatgaaagtgttttgacatattcattaacaggaagttctattataagaaagaaatgtacagtcttgttcacagctaaattctatatgactacattaattcttggwgttatgaagttttaacaatgttatttaatgttatttaaaccttaagataaatcatccccac

SEQ ID NO: 30150 - DNA, 127 bp, Homo sapiens
atattttcaaaatgacagaactgtagagatggacaatagattggtgccaggaaacagggtcaggttgaggggtgcaaatatgaaggggtggcccaagagaatttcttcatatcttgactggggaagc

SEQ ID NO: 30151 - DNA, 238 bp, Homo sapiens
gaagggaaaacagagaacctagtggtctaccaagtggttggcaactttccaatgtctgcttactctgaggcttggcactgggggccagggcctgccccagggctcctggaatttcccttgatccagctaggctgggacactccctaaatcagctgcgtgttgttagcatcaggcagaatgaatggcagagagtgattctgtcttcatagagggtggggtacttctccataaggcagtc

SEQ ID NO: 30152 - DNA, 280 bp, Homo sapiens
gaaaggctgattgctttctaaactgtctatttgggcaagtaaagttgatagatttatgttctcccatcctccgtcttacaatggaacttatagataaggtcttatcagaatacatcttcatacattgctgctggagtataagtaggtgcagtcttccttgtggggtaaattctgtataattcaaagcttcaaaattgatactacattttgtcccaacaatttcacttttagaaatgtattctaagggaaaaaaataaaaactatatgcaatgacgttcta

SEQ ID NO: 30153 - DNA, 137 bp, Homo sapiens
  misc_feature 48: y=c or t
gtttcattctttgtcctatggctatccagtggtcccagcgccatttgyaaagaggctgttcttttccctgttaaatggacttggtactcttgttgaaaataatttgaccatatatgtgagggattatttctgggccc

SEQ ID NO: 30154 - DNA, 214 bp, Homo sapiens
ctagaacgcaggctctgcaatcatttcagagtcatatccagccctgatgcaggactgtagagcaggagggacctcaagagaaggcagagcctaggcagagctgggggccaggggcaagagacagtggggcaatattcctctcggcagagagcctcccgggcttgtgagactgtcctggatggcgagtcccagcctgtcctgaatcagagcagcc

SEQ ID NO: 30155 - DNA, 336 bp, Homo sapiens
  misc_feature 2: n=a, g, c or t
  misc_feature 3: h=a or c or t
  misc_feature 71: m=a or c
  misc_feature 72: v=a or c or g
tnhgaaaaagttcacctgaactaaagacacactcaggtgttcagataaagtgctgggtggaaatagtgaamvgagatacgcttcgtcttgcataccttggtggatagggcaacatgacatggaaagggagtcagtagcatcgggcttctcatttgcaacactgtgtgttaggaactgaatttaggaacaccgaggcctctaccttgcacataatcatctgaggtcacctaggagtacccacagtgaggctcaccaccttgtggcttgtcttcctttgttcctgatgcctcaccagcccagttccaccccaggtagcttccattcagcagcaggcaa

SEQ ID NO: 30156 - DNA, 111 bp, Homo sapiens
  misc_feature 11: y=c or t
atactcttacyatataatctagcaatcacactccttggtatttaccaaatgaactgaaaacttacatccacacagaagcctgcacgtagctgggcatggtgctgtgggcct

SEQ ID NO: 30157 - DNA, 409 bp, Homo sapiens
taactacaaatacctgttgagcacctgtggtgttccaggcccttcggggctgctgggtgaggcaggtataacgtacgtgtgtgcctaccctgcggcttgtattttgggatttcaggagaatgtgtcttggcgccgggggtgccaaggggccctcccgtcagcgcctcctgaccttcagcccacaggcagccatctggggggcttggtaacccacagattctgacctgggcgcacctgcagatggggtttctgatgcatgcacgggtcccgtgttgaacaggaagcttcttactctcacctgtgcccctgtggcctttcctggtgccgtttcccactgtggtgtctggacactttctcccagggccctcctggctggaatgtggggtaacacaagataataacgtcagac

SEQ ID NO: 30158 - DNA, 184 bp, Homo sapiens
tcttttactactataatttttttattttattattattatactttagttttagggtacatgtgcacaatgtgcaggttagtgacatatgtatacatgtgccatcctggtgtgctgcacccattaactcgtcatttagcattaggtatatctcctaaagctatccctccccccttcccccaatccc

SEQ ID NO: 30159 - DNA, 323 bp, Homo sapiens
  misc_feature 118: w=a or t
ccttttgtctacttgtctttagtaggaaacgttgcaaattccgtggcttgattgcttctttatggaaagaatatggcaaagctgatgcaagatgggtttattttgatccaaccattgwgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctt

SEQ ID NO: 30160 - DNA, 122 bp, Homo sapiens
  misc_feature 44: k=g or t
gaacctccttaattataattctagatataattgacccaaacatkctgtttttaactttgtagttttaaagaaagaacacacattaagtatatattccaatctatcatttgattatgcaagcc

SEQ ID NO: 30161 - DNA, 304 bp, Homo sapiens
tatgtggaaagcctgtagtgggaaattttaaaaggaaaggaaagggaaataagaaaggtaccaacatacatttagaacctattatatgctacattttatacatataatttcatttaatcttcataaaagccatatgaaggaaatactgtattagcatttctattttacatgtgagaaaaactaagacctagagagtttaaattattcccataaggtcatctgactagagaataatcaagttgaaataggaacacagaagtgccacatttaaaaaaattacatataaacacacaaatggaaccct

SEQ ID NO: 30162 - DNA, 97 bp, Homo sapiens
tggattaatctaaaatgttgataattcttggccaactatgaggtggtttatagtatgtgccgcatcaatgttgatggtcaaactgttagctgatcat

SEQ ID NO: 30163 - DNA, 109 bp, Homo sapiens
cgcttttttgttttgaatttttgaatccattttattattacaggaattttttcaaatgtttatgttgagacacataataagcattttgcatttattaaatatgaaccgt

SEQ ID NO: 30164 - DNA, 283 bp, Homo sapiens
cagtttgttttattcattctttctatttgttttgtaaccattaaacatccctaccttcccccagccccctgctaccattcccagcctctgttaaccatccttctactctctatgtccatgagttcaactgttttgatttttagaacccacaaataagtgacaacatgtgatatttgtctttctgtgcctggtttatttcactgaagatagtaatctccagttttatccttgttgttgcaaatgactgggtctctttattttttctggcttaatagtactccac

SEQ ID NO: 30165 - DNA, 183 bp, Homo sapiens
cttagctcactgcaatctctgccttctgggttcaagtgattctcctgcctcagcctcccaagtggctggaactacaggcatgtgccactgcgcctggctaattttttgtatttttagtagagataggtttcaccatgttggccgggctggccttgaactcttgacctcggctgattggccccc

SEQ ID NO: 30166 - DNA, 168 bp, Homo sapiens
ttgttaccacagtagagataatttagtagaaaaatgctttgaggcttcagtatttgtaagattttgcattagccagatgctaggttgttgaaggcatttcagtgttgataatagcctgagcagacttctttacaaatgggatctgtttctatatgtgtatatgcccac

SEQ ID NO: 30167 - DNA, 132 bp, Homo sapiens
ttgattcttgataaatacctcacttactgaacacttcttacatgccaggcactgtgctaaatgcttttcagctattagctccttccagcctcacaataaccctgtgaggtagatactcttattaaccccaac

SEQ ID NO: 30168 - DNA, 391 bp, Homo sapiens
  misc_feature 389: n=a, g, c or t
  misc_feature 391: n=a, g, c or t
taattctaacatctgggtcatcttggggtcagtttttattgtctattttttcttctgacatcacattttcacacttcttcatatgtctagtaattttgtttgtacataagacattgtagatgaaaaattacagtaactctggaattaccttcctctgaaaagtgtttatttttgttttagtaggctgttaaactatttgtggatcaccttaaacttgtgggaacttggtttcggactgtgttaggttgggtgtattttggttttgccctttgtcctagagcaaatcccatagtcctgggacatggtctttactcctcagatggctcttcggggatttcggtgaaagacccaatgtttgtaccaagcacctctaactttgtggaactccnan

SEQ ID NO: 30169 - DNA, 404 bp, Homo sapiens
  misc_feature 346: w=a or t
  misc_feature 347: h=a or c or t
cactaaaactaaataccagcattcctgttgcagcagatgtagttgtagaacatgcattgaggcgtattataaggaaatcatttattgttttttaagggcagaagggatttaggagaaaagctacagtatagattgattctctagaatatcaatgatcccttttcatccatggttcatcaaaaacatactaactgcatttgtttgatcattgcaaatttaaaacaaaacagcatttgctgttaggaaacaagacacataatcctcttaggaattaccattatatcacattaccactgtgaggtagaatggatcattcattaatttctttatgaaatttgcatgctawhgtttttctaatgaggctgtaggtttccatgtaaattctgtgatagatagtggctgtt

SEQ ID NO: 30170 - DNA, 400 bp, Homo sapiens
  misc_feature 19: s=g or c
  misc_feature 61: s=g or c
  misc_feature 71: m=a or c
  misc_feature 72: n=a, g, c or t
  misc_feature 74: v=a or c or g
  misc_feature 98: s=g or c
  misc_feature 103: v=a or c or g
  misc_feature 123: s=g or c
  misc_feature 127: n=a, g, c or t
  misc_feature 128: n=a, g, c or t
  misc_feature 170: s=g or c
  misc_feature 182: b=c or g or t
  misc_feature 183: w=a or t
  misc_feature 197: s=g or c
  misc_feature 199: s=g or c
  misc_feature 351: s=g or c
  misc_feature 352: m=a or c
  misc_feature 361: n=a, g, c or t
  misc_feature 365: v=a or c or g
  misc_feature 366: s=g or c
aactaactgtaagtgtgtstcgaacttgcgcgggggcttcagcccgcccggggctgcggastggccggttmngvctctcgggagaggggcgcggtgtstccavggtgactttccgtgaaggasgatnnggtgtctccgcagctttggggccccaggaaagaacagatggsttggcatcttcbwccgagcaagcgcaststcaggccgggcctgagcctgcagcctgtgtgccctccatcatcagggccccctctcaggacaggctacaccgagggtgggacagcggacttccagggacacttccaagtcgtgcccatgcagatacctcagtatacactgcccacagttaasmaaccacganctgvsacattgttttgaagaggtgaaaatgcctcactca

SEQ ID NO: 30171 - DNA, 247 bp, Homo sapiens
aatgataacaaaggcttctaactaatagttacgtggccagattacatagcctaccatagattttttttattgtgtatgggatgataagaagtttagagaattttcttactagtaagtacctttactaagtaatagctaagtataaaatctttagttacagaaagcttgtgagcaattaaaatccttttacatttttcttgcagaatgggagaaaaatatggcaaatacaaaactgtaaaataagggc

SEQ ID NO: 30172 - DNA, 178 bp, Homo sapiens
ttttttttttggttctgtgcaccaaagagctgactttgaagtctggtagtttattttctttttttatttttgtgatggagtctcgctctgttgcccaggctggagtgcagtggcacgatcttggctcgctgcaacctccacctcccgggttcaagagattcttctgcctcagcctccg

SEQ ID NO: 30173 - DNA, 102 bp, Homo sapiens
ttcaagaggtctctcacaaatagatgtacaaaagttgaattagcacgtccaaagccatgtggttttgaggctaattccttgttacataattttttttttttt

SEQ ID NO: 30174 - DNA, 99 bp, Homo sapiens
ccattacataatgaccttctttgtctctttttgcagtttctgacttaaaaagagacaaagtgttgggtcttgttttttcattcattcagtcacctcgta

SEQ ID NO: 30175 - DNA, 375 bp, Homo sapiens
  misc_feature 341: k=g or t
ctctctctccctacctttgtcagcacttagtgttgtcggtgaattgggttatggccattttaataggtgtgtagtgctatcataattttatttgcaattcctaatgacatacgatgttgagaatctcttcatgtgcttatttgctgtttatatatcttacatcttttttggtgaggcactgtttggatcttttgcccattttttgagttgtttattttcttgttgttgagttttaagagttctttgtatattttgcattacagtcttttatcagatgtgtattttgcaaatattttcccccagtctgtggtttgttttcccattctgtagacatcttccakagaacagaagtttttaattttagtgaagcccgtt

SEQ ID NO: 30176 - DNA, 78 bp, Homo sapiens
  misc_feature 17: s=g or c
  misc_feature 19: s=g or c
  misc_feature 28: v=a or c or g
  misc_feature 37: b=c or g or t
  misc_feature 58: r=a or g
  misc_feature 65: d=a or g or t
ctacgggtggccgggcsgsatgtaatcvgctgctgabctggcagttctgtgtcgctargcttctdcccggccgccgcc

SEQ ID NO: 30177 - DNA, 236 bp, Homo sapiens
cttctgggcggggaagagcccctcccgagccccgagggcgatcccaccctctaggattactccacgccaggcggccagcgaatttatcccgcccgcctccaccgccccttcaagccctggggaactgggagaaacgtggcgcgcagggcacctttcccacgctgctcctcaagggaaaggacgcgagtggtcttgcccaggttaggcaaggcagatggcatctcagaccccggacc

SEQ ID NO: 30178 - DNA, 184 bp, Homo sapiens
caatgttctgatcttcccagatagtcttccagtattttcagaattgtgttggacaatccttttggcagttaatccaggtcacctatagcccccttattggcctccctcttctgtgttctctacagtttttcatgattttcctttgcttgccacaaatccttcatgagggcaggaatggggtggc

SEQ ID NO: 30179 - DNA, 324 bp, Homo sapiens
  misc_feature 291: n=a, g, c or t
tagggagagattttaaaatggaatagaggatactttcctaaattaggctgctgataaaagtatacataacaatgaaatagaaagtaactctttctaatttgttgattcacttatgtctagtaagagttattgagagaattggcctataatatctactattaattttagtatgaaagtattttagattcaggcatatgacaagccagttacagccatctttcatttactaagtgtcttttatacatgaagacctgtggtaggtactagggatccataaatacagatatggcncccttattacctgttagaccttgagctccagtc

SEQ ID NO: 30180 - DNA, 176 bp, Homo sapiens
ggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacctctc

SEQ ID NO: 30181 - DNA, 153 bp, Homo sapiens
taaatcccaaagttcttaccatgcccccatgatctggaccccgccatcccttccactcccttctgcaccatttgtttatttgagctctgccattcattaatcccagggcgagccactttccgctgttcctcccactttgtatgccactgcacc

SEQ ID NO: 30182 - DNA, 151 bp, Homo sapiens
tgactttaatactagaatatgtagtctcagccttaattttacatttacattattttgtaattttttattactatttttaaggggttaaagagaacatacattctcacattagtgtactttctggtagaaagttgctgcaaaaacatttgaa

SEQ ID NO: 30183 - DNA, 194 bp, Homo sapiens
ctcggctcactgcaacctacgcctttggttcaggtgattcttctgcctcaccctccagagtagctgggattgcaggtgcctaccaccgtgcccagctaatttttttgtatttttggtggagatggggtttcaccatgttggccaggctggtctccaactcctgaccccgtgatctgccctcctctgccccactc

SEQ ID NO: 30184 - DNA, 74 bp, Homo sapiens
agtcaatgaatcaatcagtaacccagcctcaggtatttctttatagcaacacaaaaatggactgacgcgcaact

SEQ ID NO: 30185 - DNA, 156 bp, Homo sapiens
tcaggaaaaatcaacccagcaccagcagctaccaaccaccattccatctcttcacttgaacagcattagttaagtccagatgtgggaacccttctcttggaagaagttcctaattgtgtctcagaccggtgtaaacaaaccagccagccgccacct

SEQ ID NO: 30186 - DNA, 109 bp, Homo sapiens
ctttcttttaaactatagttgaattcccttggtttccctagacagactatcaccatggaaccagtggctggcattttaaccttgtttttgaaaatgtgtccccccccga

SEQ ID NO: 30187 - DNA, 285 bp, Homo sapiens
atattgtatgactgccatattttattgaaactaaggtcaatgttgaaccatatcttgatttcagaatttaaaatgtgttaccttagaaataatgaaatatagtgtaacagttggtttctaaatgtggttttatttcaggggccattatttaacctgtgtgtatgctatgatggagttcttttgtgatttctttacttctaaatttaaatagtaattatgtttaaaaacaaatgtttttgtctttagttgcaaagcagcatatatctcatttccttcaaccttgcc

SEQ ID NO: 30188 - DNA, 312 bp, Homo sapiens
cattgaaaaaaagcattgtagtaaagtttaaagtggagctcagacaaatcatgacttattaagagactacaggaagccattcagcatttaataataactgtttacaacatgaggcaaagctaataatgttatggttttattaagagatctgtcatctctgtttttcttaaactggtttaacagtcagagctttgtaatgtgtttcagctgaagatttattataggcttgtaaattatctaaatgttctttttagaccccatgacaggagcacagaggaactgagataactctgtgttatgagagggtggctc

SEQ ID NO: 30189 - DNA, 210 bp, Homo sapiens
tatagttgttgtagtccgtttctctaaaaatagtcctgttttcatatgaatctaagagaacattaccggagaaaataaagttactcatttatagttactaataataagttagtgattaacttaccacaattggataaaatataaaactattcttcagcacatttatacctaaattagtgaagtccatttgtgaagttcatttggcatctg

SEQ ID NO: 30190 - DNA, 221 bp, Homo sapiens
tttttaaattttttgtagtgacagaggtcttgtgctatgttgcctaggctggccttgaactcctgggctcaagtgatcttcctgccttggcctcccaaagtgctgggattacaggtgtgagccactgtccctggcctagaataagtcttaaatacaagtcaagtctccagctttgttcttattggagattgttttgggtattcttttgtttgcgtgtgttg

SEQ ID NO: 30191 - DNA, 232 bp, Homo sapiens
  misc_feature 17: w=a or t
  misc_feature 94: r=a or g
  misc_feature 102: w=a or t
  misc_feature 103: r=a or g
  misc_feature 111: r=a or g
  misc_feature 126: s=g or c
  misc_feature 139: w=a or t
  misc_feature 159: k=g or t
  misc_feature 161: m=a or c
  misc_feature 166: w=a or t
  misc_feature 167: m=a or c
  misc_feature 170: w=a or t
  misc_feature 185: w=a or t
  misc_feature 186: r=a or g
  misc_feature 193: r=a or g
  misc_feature 194: w=a or t
  misc_feature 201: r=a or g
  misc_feature 208: r=a or g
  misc_feature 211: w=a or t
  misc_feature 212: d=a or g or t
  misc_feature 220: r=a or g
  misc_feature 223: r=a or g
  misc_feature 224: m=a or c
taaaaattgaatgccawagtacaagtagaggagttttttattttatatatcacacacacacacacacacacacacacacacacacacacatatrtgatacawrtgctttcrggctgcttaccttascgtgtagtggtawctattcacttcttaatttckgmcctcwmtcwatttaattgtctagwrtgtaaarwgtctttragacatragwdttcctcaragrmgccacagt

SEQ ID NO: 30192 - DNA, 147 bp, Homo sapiens
tgctgttaggcctgctgttccctttgctcttgattaggagagatggaaggagatgagctcccataactgaattggcctttggttcatgttttctccccatatgtatatatgccatatgtgaatatgccatatatatgtgccaacaat

SEQ ID NO: 30193 - DNA, 356 bp, Homo sapiens
aataagctaggaataggagggagtatccttaccctgataaagaatattaatcaaaaacttagagcaaacatcatttttacggtgaaatgttagaaggattccctttaaaatcaggaaaggagaagggtgcccgttaatcactgctgctgttcaacagtgaaatacagatgccattggtcacagctatacaagaaaaagaaataggatacaaattagaaagagggaagcaacctgatattattcactgatgatatgattgtctgtacataaaatctatacataaaacctaagtggatcagtaaactattggaaataataagacagtttagcagttgtctaaatatataatccagcaa

SEQ ID NO: 30194 - DNA, 244 bp, Homo sapiens
  misc_feature 218: s=g or c
tcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattatcctaatcacacatttaacacagggaataagtgctgaagtgacccagatcaccaagsgcagttcctcatcatactttaatttt

SEQ ID NO: 30195 - DNA, 51 bp, Homo sapiens
  misc_feature 45: y=c or t
ccattacataatgaccttctttgtctctttttgcagtttctgacytaaaaa

SEQ ID NO: 30196 - DNA, 255 bp, Homo sapiens
acatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagttatctcttgctgggaacacagccagttttcacaatgcctagactgtgtatgtctatttgcacaagattgtcttttcctattttggagtggcct

SEQ ID NO: 30197 - DNA, 85 bp, Homo sapiens
ttaattttcattgtaacacctgccactatttgccatgtggtttgttttacctgcggatatttttgttactcatctccccccacca

SEQ ID NO: 30198 - DNA, 145 bp, Homo sapiens
atattgttcatgctgtggtttcatatatgatatcttttaaactaacaaattgtagacactgaaaatttattacttctgaagagaaatattgattattataatttttaatggaagatttaaaaacaagatatcttgatatccagca

SEQ ID NO: 30199 - DNA, 235 bp, Homo sapiens
  misc_feature 71: m=a or c
gtgtatttttttaatcatatatcttcctcagtacaatgtaaggactgtaaaaaaagagataatgtactgtmttgctttctgttgactcccaggaactcgaaaccagcaccaagaatagatggtcaaaaatgatactttaatgaacaaataaatgggtggctaaaatggataagttgatgtggttaaccagtgaaaaggaaactcacacaaaatctgcagttgcatgaattcccct

SEQ ID NO: 30200 - DNA, 146 bp, Homo sapiens
ctgggccttacttgttttttcaacgacagttttggtcttcagttaagctgttaggcaattttcttcagtggtatggcattttctcaaataaaactctgcaagagttatcaatagatggtttattaaatcgatatattctcatggca

SEQ ID NO: 30201 - DNA, 73 bp, Homo sapiens
aggttgatcacaattgttgtgtggccatgtaacaatactctgagagctggacttatgtatttaccacgggggt

SEQ ID NO: 30202 - DNA, 410 bp, Homo sapiens
  misc_feature 306: n=a, g, c or t
  misc_feature 307: s=g or c
agaaaaaaagctgaagatttcatatcttttatttcaacttccataatatcaagaacctaaagatgtactgtacatgaaaagatgctcaacatcattagtcattagggaaatgcaaatcaaaaccccaagagacaccactctccatccagtaggatggctataatactatacatattttaaaatagaaaggaaaattacaagtgttggcgaggattgtggagaaattgaaacccttacacattgctgttgggaatgtaaaatggcacagccactgtggaaagcagttcggcagttcctcaaaaggtnsggcatacagttatggtatgatccagcaattccacttctagttatatacctaaggtcacacaaaaacttgtacaccagtattcagagcagcactattcacaata

SEQ ID NO: 30203 - DNA, 217 bp, Homo sapiens
gttgtaacagagattgtataacccacaaaatccgatatgtttacgaactggctcttcatggaaaaagtttcctgacctctcatctagatcaatggggttgtacgttaccatttaaaaatatttaggttgtaatctatcctcttattacttgtatttatgggtaactattttgtaagtaaggctgtttcgtatagaattaacgtggtttaggtaagca

SEQ ID NO: 30204 - DNA, 374 bp, Homo sapiens
tgtagtatagtttgaagtcaggtagtgtgatgcctccagctttgttctttttgtttaggattgtcttggctatgcaggctccatatgaaatttaaagtagttttttccagttctgtgaagaaagtcaatgatagcttgatggggatagcattgaatctataaattactttaggcagtatggccattttcatgatattgattcttcatatccatgaccatggaatgtttttccatttgtttttgtcctcttatttctttcagcagtggtttgtagttcttcttgaagaggtccttcatatcccttgtaagttggattcctaggtattttattctctttgtagcaattgtgaatgggagtcactcatgatttggct

SEQ ID NO: 30205 - DNA, 377 bp, Homo sapiens
  misc_feature 186: s=g or c
caaacacaacaaaatatattctttatattgtctaatattcagttcacattcagtttttcttttttttaaattatattagagacagggtctcaccatgttgcccaggctagtctcaaacttctgggctcaagcaattcacctgcctcccaaagtgctgggattataggcatgagccaccatgcgcascccattcagtttttcttgattgtaaaagtgtctttgtagggttatttgcttaagtcaatatccaaacaaggtctacacatggtatttggttgacaggttgtagtcttaacttagttttttgatgattattgcctaaatccattatatcatcagagattttaaaatgatgattttctaactcaagggcattt

SEQ ID NO: 30206 - DNA, 302 bp, Homo sapiens
  misc_feature 65: m=a or c
  misc_feature 70: m=a or c
  misc_feature 182: m=a or c
  misc_feature 268: w=a or t
tgtagtatagtttgaagtcaggtagtgtgatgcctccagctttgttctttttgtttaggattgtmttggmtatgcaggctccatatgaaatttaaagtagttttttccagttctgtgaagaaagtcaatgatagcttgatggggatagcattgaatctataaattactttaggcagtatggmcattttcatgatattgattcttcatatccatgaccatggaatgtttttccatttgtttttgtcctcttatttctttcagcagtggwttgtagttcttcttgaagaggtccttcatatccc

SEQ ID NO: 30207 - DNA, 404 bp, Homo sapiens
  misc_feature 52: h=a or c or t
  misc_feature 53: n=a, g, c or t
tcttgggaggagacttccagaactctctcacactcataccattaccctccthnatcactaaacatttgtatgcaggtgatattaggttaaaatgaataaaaagaaattgcaaagggtaggctaagaagtgagccccagacacttttcaccagctaaacctctattgtctgaattattacttcccagcccaggggttgtcatgatgctcaaaccagggctaaggtcaattgtctggttttcagtatctatacatatatgagatctccatggtgctagcagaacatttgtgttctctggctaaatctgtgttcttgatacacttacctgctctcttttatttttagttctcagcctataggaggagaatatggtcaagaccatatcctaaaaatcaacagacaccg

SEQ ID NO: 30208 - DNA, 174 bp, Homo sapiens
ttttctcccccatctcttttcctttaatttacgtgaaattaacataacgtagccatttagtgcattcaaaatgttttgcaactgccatccttaactagttccaaaacattttcagcaccccaaagacaacccatacccattaagcagtcagtcccaactctctttccccgcccc

SEQ ID NO: 30209 - DNA, 250 bp, Homo sapiens
aaattaaaatcgctgttttctggactgaggtgcaccccctgtggatgtgctccgggccctgaggttcccctccctccctgatggtgtccggagagcgaaaggcatctgtccagctgatgtggcctaccaagtggcacgacctgcccagctcagtgcacccactcgccagcttttcccaggaggatttcccaaagatttctctctgctgactgttgtccggacccgccctggtctccaagctcccctcctt

SEQ ID NO: 30210 - DNA, 162 bp, Homo sapiens
taaagaaaatgtggtatatatacaccatggaatactactcagccatgaaacaatggcctttgcagcaccatggatggagctggaggccattattctaagtgaaagtaattcaagaatggaaaaccaaatgccgtatgttcttacctataagtgggagctatt

SEQ ID NO: 30211 - DNA, 248 bp, Homo sapiens
tagtctttgttttcccagattacattttttagtaggggaacttgaataataatcaccatgatatgtcaaaagctcctggtttctcaaggcagctccacagcagggagctctgtagttagatagggttgggttcatttcctgtttctgccactcaccagctatggccaaggacaagttacatgatcgatgtttcagattcttcttgtgtaaaaaatactaaaatacacaaacacacactcacacaccct

SEQ ID NO: 30212 - DNA, 194 bp, Homo sapiens
  misc_feature 106: n=a, g, c or t
taatgaggtttgaacctgaactgttgggagataatggattaaacattttggggtatgaactgatttggagggggtagagtggaggaggcagtgttttgtttgaccnttttacctcttgagtttgtggaaataccaagtagacagttagatttatgtgattgttgtttaggagaggtcaggtctggagacatgcg

SEQ ID NO: 30213 - DNA, 168 bp, Homo sapiens
aggaccttcttttacttggcttttaaaagttattcacttagtcaaaatttattgaacacctatagtattccaggcagaatgctaaccctcacggagctcacaggggatacacactaagggatatatattgtagtacagcacagttattaaatagcaattgcagacgac

SEQ ID NO: 30214 - DNA, 344 bp, Homo sapiens
taaaagtttgttgcaaggttctgatcttttagacagcagtgttaactgtactgaaaaaagtgagtgggagttaaagactccagagaagcagctgctagagactcttaagtgcgagtctataccagcttgtacaacagaagagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagcc

SEQ ID NO: 30215 - DNA, 58 bp, Homo sapiens
agaacttctgaggcgtagaaaagtccaccgagaagttatatttaagtacttggcaaca

SEQ ID NO: 30216 - DNA, 241 bp, Homo sapiens
  misc_feature 23: n=a, g, c or t
gattagaactacagctgctaggnacatccctgtgcaaatctttgtacagacatatacggtttttcctctctggggtaaatacctggaagtggaatgcccaggtcgtaagcctaacctgaacttaagccggcagatgaggatatccccagcctcccggaacaagcagacagttattaatggaaatgttccaccagttcagagaaagacatggtgtgacttaacactgaagtcaggagcaagg

SEQ ID NO: 30217 - DNA, 175 bp, Homo sapiens
  misc_feature 100: m=a or c
ttaaatatagataatttactgttaactacacaaaaagtatttagtatactttccaacttgcaataaatcaaattagctgtaaagtgaatacaaaaataamctttcatatgtaagaaagaaacttagtttcttctcaatgatggaatccttgaggtttgtttttaataagatgccc

SEQ ID NO: 30218 - DNA, 168 bp, Homo sapiens
gctttatttgtgattttttagaataggaatctggtttggaggttgacaaaataagtaattctctcttttgttatattttctttcaatcttggctttgatttggtgtaataagctggtttcatcaaacttattatcagcctataatgagatacatgacatggagcagca

SEQ ID NO: 30219 - DNA, 209 bp, Homo sapiens
ctgagtgggcccagagaccagtcagtcttcatgtcaccaggtttgttcaatcccatccctgcgcacggcaggagccatccagcgaaacccagacagaggtgtttgtgggagtggactcactttttcagacgcacttgctagtttggagcctgaggcattgaaggtgatggcagctagtgttccctcatgggcagcaatagtgcagacaa

SEQ ID NO: 30220 - DNA, 80 bp, Homo sapiens
cacgtatagaaacgctgttttttgtacattgatttttgtatcccacaactttactgaatccgtttattagttctgtctgc

SEQ ID NO: 30221 - DNA, 124 bp, Homo sapiens
ctgtattttcttttaggactttggagatctctcaagttgtactgttttctagtattcctgagtatattcctttggtaacgtgaaagtaaatagtttatatttgatgattttttttttttttttt

SEQ ID NO: 30222 - DNA, 148 bp, Homo sapiens
cttcatttctgaaaaatattttgatagccatagacttctagggggacatcactctaaaaatgttccatcccttttcatcctttcttgtttctaacccttatcattgtttctctatgtgtaatgagtctttttcttctagccggctctg

SEQ ID NO: 30223 - DNA, 79 bp, Homo sapiens
atcagaatcctcctccctatgctccgttgctgaagctcagttgctcggctggagctgagctaaacagaagcgtcagatc

SEQ ID NO: 30224 - DNA, 218 bp, Homo sapiens
cctagaacatttaaaaaagcatagtctggccaacagctgacatacatggaaatattttgtcattgtcacaggttagacagtgtaatttagccactgcatctgcaaaaaagccaaacacttcctggtaattggaaaattgttatactgctttgggtctgtaagttatatattaattcatttggtgtgagaagaactagtaataaagtatgaaggtctac

SEQ ID NO: 30225 - DNA, 247 bp, Homo sapiens
  misc_feature 21: w=a or t
  misc_feature 23: w=a or t
  misc_feature 24: y=c or t
  misc_feature 35: v=a or c or g
  misc_feature 37: h=a or c or t
  misc_feature 38: n=a, g, c or t
  misc_feature 39: w=a or t
  misc_feature 81: w=a or t
  misc_feature 101: k=g or t
  misc_feature 102: k=g or t
  misc_feature 178: d=a or g or t
  misc_feature 190: b=c or g or t
  misc_feature 195: k=g or t
  misc_feature 198: k=g or t
  misc_feature 207: b=c or g or t
agtgatttcaaatttaggatwtwytgttgttggtvghnwactgtccccttagtttcttgttatttccaatttgttctgcawagtcattacttttaattctkktcttactaaaattttatggtggttgggggaagggagttagcatcactaacctgacagttgttgccaggaatttgcdttgtttactgcbagtakatkagaaatccbagatctcagaatcacaatagtaataaacaacaggggaggc

SEQ ID NO: 30226 - DNA, 137 bp, Homo sapiens
ctgtaggaaaagggagaatcttccatgttggtgtttttcctgtaaagatcagtttggggtatgatataagcaggtattaataaaaataacacaccaaagagttacgtaaaacatgttttattaattttggtccccca

SEQ ID NO: 30227 - DNA, 100 bp, Homo sapiens
tgtggttgtgtgcctgtttgtctcgtccatgagagtaagcttttaagaactggaactctgcaccaaatgtgcagtgaaatgactttgttggagaccacat

SEQ ID NO: 30228 - DNA, 253 bp, Homo sapiens
acatgtgttctcgttattcaattcccacttatgagtgagaatatgcagtgtttggttttttgttcttgcgatagtttactgagaatgatgatttccaatttcatccatgtccgtacaaaggacatgaactcatcattttttatggctgcatagtattccatggtgtatatgtgccacattttcttaatctagtctatcattgttggacatttgggttggttccaagtctttgctattgtgaatagtgccgcgc

SEQ ID NO: 30229 - DNA, 273 bp, Homo sapiens
ctaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctctt

SEQ ID NO: 30230 - DNA, 158 bp, Homo sapiens
atgataatttttcttttagtatatggtgattagtttactttttattcaactgtgtctttttttgaagtcttcttcattgaaatatattgttactaaatatagaattaatggctttctttaagcacttcaaagataatccactgttttctggaccccaa

SEQ ID NO: 30231 - DNA, 142 bp, Homo sapiens
tataatctttaattgtccatggatgttaagaactgcctctttttccctgctctgtttgcttacgtacctgtcattaagtaattttcacatattccaaagaagctaagtagtacctctaaatgcttgatttcttctccccgct

SEQ ID NO: 30232 - DNA, 177 bp, Homo sapiens
caaatgcgaggaggggtgctagacctgataagtctaggaagaccagtcagcttgatagccagttgttaaactaaaggaccacaaaggtgtgtttagtagttctgatatgggattactatcagtttatacatatgtatagattttcttttaattataaacagccagatagccagcaac

SEQ ID NO: 30233 - DNA, 110 bp, Homo sapiens
catttaatcatgatctttacagaaaagaacatgttattcgtattttgctaatatcaactgcatggattaaagtagtccctccatacatggggaagtgtttggagcaaaga

SEQ ID NO: 30234 - DNA, 99 bp, Homo sapiens
aaaccattgaactgttttctgtcactataaattagatttgtcttttctagagtttcatgtaaatggaatcatacactaagtactctttgtgcctggctc

SEQ ID NO: 30235 - DNA, 163 bp, Homo sapiens
cacacatacaaaaaaggaattagacttcatatactgtcttgcaaatttcttcttaaaacttaatggatttcttccacataggcacatttgacccttgagcaatgccaacgttagggatccccctgtgcagtgggaacttcacatataattttagacaccccgt

SEQ ID NO: 30236 - DNA, 429 bp, Homo sapiens
  misc_feature 355: w=a or t
  misc_feature 356: s=g or c
ttttatgtttgttaaagtaataaatgtgcagaggtcagaaggtctaataatactctacagcctgtagcactgcaaagtgatgtgctggggttggcttgtgttggctcgtgagagcctactggtaaaatttttaggaatttaggagttttgcaagctggttgttaaacagagccattattataaattacattgaataaacttgcaattaagttatagtaaaagcagaagtactaaatattaaaaatgtattacttcccaattatttcactattatctgtgttcttgaggttatctgtgactattacatttgcagagtggaaatattctataatagtgtgctgagagcctcttctawsactgtatttggtggcattagcctgaaatcagtgatcgtgggatatttacaccaccaaaattggcaaacgctat

SEQ ID NO: 30237 - DNA, 118 bp, Homo sapiens
acaattcgagatgagatttgagtggagacgcagagccaatgcctgtcacttggagacagggcttcgccatgttgtccaggctggtctcgaactcctgacctaaaatgatgcacccgcc

SEQ ID NO: 30238 - DNA, 210 bp, Homo sapiens
  misc_feature 6: r=a or g
  misc_feature 7: s=g or c
gcgtcrsctcctgagtagctgggactacaggcgcccgctaccactcccggctaattttttttgtgtgtgtgtttttagtagagacggggtttcaccattttggccaggctggtctcgaactcctgacctcaagtgatccgcctgccttggcctcccaagttttgtttgttttttatttcttctaaacaaaacaaaacaaacaggatcact

SEQ ID NO: 30239 - DNA, 362 bp, Homo sapiens
ataaagaatatgcccagagagatgatgagataatgcatccctgaaacaaggacaggatattgttcagagaatgttccaaatttacaggacagttgtcaaaataaaacatccagtggaaaagttgtaagacaaagttaacccaatctcctagaatgtagaacaaaaaagcaaggagatgtttgataggaggaaaaaaaaccaagaaaactagaagatgaaattaaggaggtgtgacggttaggagttctagaaagagaggatggagaaagaaggaaatttgcaaacagatagtaccccaaaatgttctgagctctgaagggtatgcatttttggattgaaagatcccaccaagttcccagcaa

SEQ ID NO: 30240 - DNA, 162 bp, Homo sapiens
cctcacactactatttataatgtaaaagaagccaaagatccaggttcagatatttctgcctttaagttacctgaacacaaatcaagtaccttcaacagagttaatgccaatatgtctcatcctttagttttggggaaacatcctcttctttcaggtggtgcc

SEQ ID NO: 30241 - DNA, 190 bp, Homo sapiens
aagaatgctctaaaccacttcttcccacagagtctttcccatttgaacgttaagtccttttacttactgctttgattttcatgagcatgcaaacgttcctgaggagacataaccttcatgtgagtttcagtacttttccccagagcatgtttgacagtagaagttactacgagagatttaggtcccctaa

SEQ ID NO: 30242 - DNA, 109 bp, Homo sapiens
tccaaacaagaggtgacataatctgacttaagttttaaaagaatcaccttggttgttgtggagagaaaagtctgtaaggtcaagtatggaagccaggagatcaggaacg

SEQ ID NO: 30243 - DNA, 227 bp, Homo sapiens
  misc_feature 161: d=a or g or t
  misc_feature 169: w=a or t
  misc_feature 193: s=g or c
tattgctgcttttaatatgtttcaaaatcagaaattataatgcacctttgttctttttcatgggtgtttggctagaggtcataataaaattttaacattttaaacaatatttctttaaaaaactgctgttgggatttttatgaagattatattgaatttgdctaccacwgtaagttgtattgacatctttgasaaactattattttttgattcctgagcaaacatat

SEQ ID NO: 30244 - DNA, 201 bp, Homo sapiens
catgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctcccccat

SEQ ID NO: 30245 - DNA, 226 bp, Homo sapiens
aaaagcaacagcgggtccctgagtgctccccacatatcatcgttgtgcctgctggtaggctcagcagggagccgtgtccacttaggcgaacgcatcctccgaggaccatagtcctcagggtgcgaaccacttagctggccatagcaaggttgttggatgttggactcctctgcgcccttggagagaggtcctccacgacttctacgccaatctttttacggggcgg

SEQ ID NO: 30246 - DNA, 172 bp, Homo sapiens
ttagattaattcaagttgtgtgctatatttcttgtataatttacaaagttacacaaaatataaagagcagtaaacttgtctgaaagtttttggcaaaggaaggtaacttcaatgtaatagcttcctttaagagtacaggaaaatgcattctgtaatgaagtggggcccaagt

SEQ ID NO: 30247 - DNA, 274 bp, Homo sapiens
  misc_feature 14: w=a or t
  misc_feature 17: n=a, g, c or t
  misc_feature 31: y=c or t
  misc_feature 131: w=a or t
  misc_feature 195: m=a or c
  misc_feature 196: n=a, g, c or t
  misc_feature 206: m=a or c
  misc_feature 207: v=a or c or g
  misc_feature 237: m=a or c
acgaaaaatagtawaantttcaatgacttgyaaaagtgagaatggcactatgcaatatttaaggacaaacatcctgcatatacaaatctggacggatcttcaaatggcagctaaatgatctagttatgcgwaatctgtaaagaaaccctatagctttatagcaaacatagctgtagtttggattacatcttatgmntaaaacaaamvcatgttttactaatatattaaacatacgamgtataatacttctaattcataggtaagatatcgtgta

SEQ ID NO: 30248 - DNA, 329 bp, Homo sapiens
tgaatttttaaatagaatctcttttcatgtttgaatgattgttattagttctagaagcattctctttgtcatgacccgattatgtatactcttgggtttaggaaggacaaaagtgatgaaatttgcatgagatagaataaatatcttaggaggagtgaaagaacctgaggaagagacacgaccctaagggaatgaatgcataagcagtcttctcagtagcccagagtttccaggaaacaggaatatttatatcccttgcccactcttaaaatacatagatacataaaaaggcagtctctgtagacaacacatgcacacacccacagcct

SEQ ID NO: 30249 - DNA, 202 bp, Homo sapiens
tccaagcagaggaaaccataagtgcaaaattctggaaatgaggaagaaattagggagtttgggaaattaaaactgggcccgcaaggctggacagtagagtgaagggaatgttgagatatgagactggagaggtaagcaaatgccaaataatgaaggactccacaaaccatgctaaaagagtttgggtcttatccagagggcc

SEQ ID NO: 30250 - DNA, 306 bp, Homo sapiens
cctggttggatgtcacttgccagaaggcaggaaagaaatggcctgtctgttcacctgttgctgctcctcatctggaagttgtgaccaggatcttgtttgaagacctgtccccagccccagtcctgacctcttgcttaccagctattgagtggctatgaaaacataaagcccctggaaaccagcaagccacattttctgagatactgtcctgccctcccttttttattgttttgaaatattcctctcacccccccacgttaaaacataaccatgtgtattcactcctgagtgactttcccccaaaca

SEQ ID NO: 30251 - DNA, 210 bp, Homo sapiens
cctaggcatgcagcctttattccaaggtgtagtccttattcctagtgtgatgtggcctttctgatacagaaacactgaatatccagctaaatgcctgagatgctcagcaagagctttccattttggctatgctagagctccaacatatgccagcatttataacctctggtatatagtgctggtttggttctcaaccctgcatcaggcaga

SEQ ID NO: 30252 - DNA, 180 bp, Homo sapiens
agaggaaatttaaagcagtggtttttagagcacaaaataggccttgcatcttttggaattgaagaactcttagaagaaaggagagaaaataattaagatagagctagttatcaaaactgccctttgaaatctaagtgtagacattggtagcttacattggttgctgaccgttgggggtac

SEQ ID NO: 30253 - DNA, 237 bp, Homo sapiens
caaaaactaagcctttgggtttcctgatcattgcaagggtcagtctactggacatattcttttcccttccctatacccacagatgttctgtggatcattaatttacttgtgagatgatcagcaggtttaaagtcttttattattgtcgtgtcatttgcatacataaataacaggactagcttaaccttaaaccagctctttcccttttctgcttttcttctcatttcacatccccct

SEQ ID NO: 30254 - DNA, 159 bp, Homo sapiens
gacatgccatttctaggttctgtgactttgacaatgaggctgtcatttttttccctcagatttgtagtcagtgagagtattatttcttttctctggaacataagcttcttctcaaagttgtaatttcaaacatgaaaagtaatcctgagtgcagcctga

SEQ ID NO: 30255 - DNA, 117 bp, Homo sapiens
ccttggcctccccacagtgctgggattacaggcgtgagccactgcgcccggctgggtttatttctttatacattgtagaaagctagcggtttactgtattctttttctcaaacagca

SEQ ID NO: 30256 - DNA, 363 bp, Homo sapiens
aattgctacaggatcttgatcctacttgttaaaatttccattgaaagctcagctcttgtctgcagctgatctgggcacaacagttttggtacccattgagtggaaagtttgctcaactttaatttttcagtcagaatagtgtaagctaagccaatttagatatctatggtgttgactattgtttgtgctgttaattcttgttcttcttcaattaaggcatggacataatttttttcaatttttttttcaaacgatgtggaaggcttgctgctatgtgcttcatcttcagcatcatctcatcccttcttaaaatgagttatctgtttgcaaactgctgatttcttttggagaatcatccccact

SEQ ID NO: 30257 - DNA, 123 bp, Homo sapiens
agatgactctcggtggagaaaggagcccaaggaatgagaaatatgaatggtaagatttctgaaacaaatctcagaccccaaacacaccctgctctatcaaagcaactgcatgctgagcccctt

SEQ ID NO: 30258 - DNA, 248 bp, Homo sapiens
agatttgttttttttccatctctaaattaggattctaacataaaattgcctgctgggttttggaagctgtgaatttaaaaaccaaaagctgaaccttcagagttttgcatacaaaatgggaagcagtgaaggcttagaatagtgactgttaaatagtactttttcccctcaaatggttttcagttccaaagtcttaacagaattgcttttacagttttgacctgcaggtgcatattaacagtggccca

SEQ ID NO: 30259 - DNA, 329 bp, Homo sapiens
atgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcgcctt

SEQ ID NO: 30260 - DNA, 102 bp, Homo sapiens
tttaaaaaataaaattaactgggcgtggtggcacgcatgcagtggcatggtgatgactcactgcagcctctgcctcctgggctcaggtgatcctccccgcac

SEQ ID NO: 30261 - DNA, 165 bp, Homo sapiens
catttcttttaaagattaataactttttattacctgttgaatactttacctattgattattatatgtatagttgcttgagctgtcaatcattgtagcatttggaacataaaatgcgtgtatttagcaatgtagtcccctagtaagtgttgggaaatccccagtct

SEQ ID NO: 30262 - DNA, 412 bp, Homo sapiens
gcatagaggtgtttgtagtattctctgatggtagtttgtatttctgtgggatcggtggtgatatcccctttatcattttctattgcgtctatttgattcttctctctttttttctttattagtcttgctagtgatttatcaattttgttgatcctttcaaaaaaccagctcctggattcattaattttttgaagggttttttgtgtctctatttccttcagttctgctctgattttagttatttcttgccttctgctagcttttgaatgtgtttgctcgtttttctagttcttttaattgtgatgttagggtgtcaattttggatctttcctgctttctcttgtgggcatgtagtgctataaatttccctctacacactgctttgaatgtgtcccagagattctggtatgtt

SEQ ID NO: 30263 - DNA, 112 bp, Homo sapiens
tacatttccagcattttctaggttgactacaaaaatggctctacaactgagtaggttaaggttaagcctttgttgtgtgaaaagactgtaactttacattccgcgggccaaa

SEQ ID NO: 30264 - DNA, 91 bp, Homo sapiens
cagccagatcacttgaggtcaggagtttgagaccaacctggccaacatggtgaaactctgtctctaacaaaaaaaaaaaaaaaaaaaaaaa

SEQ ID NO: 30265 - DNA, 212 bp, Homo sapiens
ctacttggatcccatgcctgaaatttggaagcatatgtacaaaaatcatttttacgttttatttttaataaatcattgtgtttgaccgtacatgtctaacattttttttctaggatccattccgtaccgttttttaagggatatttgtttaagactttacgtgttaattctttattcttgatgtgtacttagagaaacttaagaggtcctgt

SEQ ID NO: 30266 - DNA, 166 bp, Homo sapiens
actttcaatttatgtgtgtatttacaggtgatgggagtctcttgtagaaagaatatagttaggtcttgtttttaatccatttacccattctctgtcttcttactggataatttaatctatgtacattcaaggtaattattgatagataaggacttgtactgccctc

SEQ ID NO: 30267 - DNA, 179 bp, Homo sapiens
agttcacctacatctggggagggggtgtttcttttttgaaacggtgagaatttatgtgcatgtatcattcatttatttctgaagtatttactgaacactttttatgtgttaggtactgtgatagacactggagatataattgtaggcaatatgggtactgtttctgctttcctggtgca

SEQ ID NO: 30268 - DNA, 251 bp, Homo sapiens
tagagtgcatagtatccctgggcactggacgttatgagagtgatgtgagaaacacggtaacatacacaagcttgaaaactaaactttctaatgttatcaacagtgctacagatacagaagaagtccatataatgcttgatggcctgttacctcctgacacctattttagattcaatcctgtaatgtgtgaaaacatacctctagatgaaagtcgaaatgaaaagctggatcagctgcagttggaagggtca

SEQ ID NO: 30269 - DNA, 146 bp, Homo sapiens
accctctgtcggctccggctgcggctccagcctcgactattattttatttattttgggtcgtgcacaagcctcagtgcctgcagtccgcgcctcctcggcccgcgggcgcctcctcccttggctccggagccccagaccccggccc

SEQ ID NO: 30270 - DNA, 242 bp, Homo sapiens
  misc_feature 117: y=c or t
tgtttttttttcttttgacattgcaaccgaagtcataaggccgctagctccgctgggacagaggcttgagagaactaacggctcggtgccttctccctggtctcagaccatcgtctytgcactgcgaaggcatttggtagcctcgccactgagatactaactagacctagactaggagctttatcaggttctaggaggtcctttaggaagactctcaaaggcaaatccctgatcccccaccc

SEQ ID NO: 30271 - DNA, 161 bp, Homo sapiens
caaggtcttaaagtgtgcccccacatattacctattcaccacaagggaaaaaaataaggtttttttatactggagaagtaggaaaattccttgactaggtgattaaaattaacatcacccaatgaggggcagatgaacatgggatacagtaagaaggacac

SEQ ID NO: 30272 - DNA, 171 bp, Homo sapiens
aaatattcttgggatgtttgaatttagaggaaaggaataagaaaggagaaatgagtatatgcagagtgacagttgctaaaagccattgaaatgttagttgctggtaaactatataccaaattataatgcttctgtgtattgttagaatgagaaatgtttgtatcagacctc

SEQ ID NO: 30273 - DNA, 331 bp, Homo sapiens
gtttctcaaaccgtgccttcccatttatgctgcatccgcgccctgaatctgaaattggtcgtcctgccacgccgcctcaccgcggtataaggtcgtcccatcctgaatggccggtgcgcagactcaattgcgactttgaggctgtcagccgccacccggcaaccttccagtgaacaggattctgggtttctcaaagctgtaattggagggccactccagaggtgttaaagctccagcacttcgagcctgcctcgtgggaaagtcttaggctgagtctgtaggtgtctgcagttaagaagccagcggtctgcatatgattgctcagggggtg

SEQ ID NO: 30274 - DNA, 353 bp, Homo sapiens
acggggtgtacttgggaacgaggggtgaagcggcccaggtgaggctcgccatggccaaacagctgcaggcccgaagctagacgggatcgactacaacccctgggtggagtttgtgaaactggccagtgagcatgacgtcgtgaacttgggccagggcttcccggatttcccaccaccagactttgccgtggaagcctttcagcacgctgtcagtggagacttcatgcttaaccagtacaccaagacatttggttacccaccactgacgaagatcctggcaagtttctttggggagctgctgggtcaggagatagacccgctcaggaatgtgctggtgactgttggtggctatg

SEQ ID NO: 30275 - DNA, 201 bp, Homo sapiens
tgcatctggtcttctctcgggttacagagcaagcctccacgtgggaagcagagcgtttgtctggactgctgtgacttgtgactcttctgtagtcatgtgtaacatgtgggctccgctggaaaaaagcaaggattaaagtaagtccctaattctagggatctgtatttgcaggtctagccttaccaaaatctaggccccaaa

SEQ ID NO: 30276 - DNA, 137 bp, Homo sapiens
tcattccgtattcagcacatacgtctgtttctcgttaagtatttatttacacctcacaacaactctgtactcccctgttactcccccattttacagaggagactgtaggtctggagatattaaatgacttgctgtgg

SEQ ID NO: 30277 - DNA, 443 bp, Homo sapiens
  misc_feature 72: r=a or g
  misc_feature 356: k=g or t
  misc_feature 401: k=g or t
  misc_feature 410: r=a or g
  misc_feature 416: r=a or g
catcaaatattattttattatttatttaattattaatcaaatgtttgtgtaggtctatttctgggatctctrttctatttcattaatctatgtgtctgctcctctaccaataccacactgtctttattaccgtcgctatatggtaagccctgacatcatgaattttcttctttttcatacgttttggctattctagtgtctttccctttccatataaattttaaaataagcttgtctatgtctacaaaaaaatcttgctgagatttgggtaagaattgcattaaaccagctgggcatggtggctcacggctgtggtcacagcactttggaaggctgaggcaggaggattgtttgtkgccaggagtctgagaccatcctgggcaacatggtgaaacttgtckctacagaaraatacraaaaattggccgggcgtggtggcaaga

SEQ ID NO: 30278 - DNA, 121 bp, Homo sapiens
ttatctacattcaagcaaaactagctcttttataagacatgtagttgctacccttttgggcctttatcttgcacttttttgctttggatggtatgccttacactttcttgtacaaagtgga

SEQ ID NO: 30279 - DNA, 139 bp, Homo sapiens
cccattctgcatgccctccccacttcccccgattcagagacttagaagcatcagagttgataaattagattgaaaccattccagtaggaaatcaggcagttccctgttgaaagttgtctggctttttgcacgtgagccc

SEQ ID NO: 30280 - DNA, 264 bp, Homo sapiens
ccgcaaccagggcctgaacaggctgatgctggctgtgcgcgacatgatggccaacttccacctcaacgacctggaggcgccgcacgaggacgacgctgagggggagggggagtgggactgagcgtccgcagaggtgaccgaaaagccgtatgatgatgttcccgatttctctgttggtcggagtcggccagttgcctgaagtagggaagctgagtgtgtcgctccctggtccactgtttctcctataaatgtaaatgggccagc

SEQ ID NO: 30281 - DNA, 423 bp, Homo sapiens
  misc_feature 343: m=a or c
  misc_feature 371: s=g or c
  misc_feature 373: r=a or g
  misc_feature 397: m=a or c
gattcgtcagttcttgattctatgttctagaatcttcttcacctcaatttcaatccaataaaattttataattgcctgccatgaatgaagctctgtttggcactttatgtaaatatgtgggcataaatatgatgtctgtcttaattgattttaccaagaagtatgaaagttagatgtgttcaaaactaagcttcaaggcggaaatacatatcccaattaatataccaagaaggtgctgcggagggaaattgcaattctagatgtattagatttctatggctgcataatagactaccgtaagcttagcagtggaaaacaacacacatgtgtcatctcagtgttmgagagtccagggtctgggaatggcgtastrgggtcttcagcaaggctgccatgmagtgtcagcttgtgaggcttggctga

SEQ ID NO: 30282 - DNA, 271 bp, Homo sapiens
aatatgtagataaatcagacatttcacagcattttctcattatatgtggtactaattcatgttataaatatgctgtagtattttttgaatggttaaaaggagcaaaaaacaacctcttgcatttttattctaaattctagtgaagctgaaaatattcacctaccatgtcttaggttgtcccttctacttttaaaaaagcacacggattggtatgtttaggggtgaaatgtcataatgcttgtatcttaccttcaaaatgtttaggggaaga

SEQ ID NO: 30283 - DNA, 87 bp, Homo sapiens
cctatgtgcctgtcagctagcttcaacaattaccaactctgagctactcttttatcaataataccctactcatatctctcactcccc

SEQ ID NO: 30284 - DNA, 227 bp, Homo sapiens
  misc_feature 3: r=a or g
  misc_feature 47: h=a or c or t
  misc_feature 128: r=a or g
  misc_feature 130: s=g or c
  misc_feature 135: m=a or c
  misc_feature 169: r=a or g
  misc_feature 184: y=c or t
  misc_feature 192: n=a, g, c or t
  misc_feature 204: m=a or c
  misc_feature 218: w=a or t
  misc_feature 219: y=c or t
atractaattatactggtctcaatttaatcatgtgagtttaaaagahaaaatcaattcacagagccaaaaatcagcctgaatgtacaaggaagcaatggattttgaaaaacaacctccagccagaaarcstccamcaagcgggcaggtctccagtgagcagatgcacartctgtcctggcctcyagccagcncgtgggtgctcmcaccatccaggccwyacagcagc

SEQ ID NO: 30285 - DNA, 190 bp, Homo sapiens
ttatttctccttcacttatgaagcttagtttgactggatatgaaattctgggttgaaaattcttttctttaagaatgttgaatattggcccccactctcttctggcttgtagggtttctgtcgaaagatccgctgttagtctgatgggcttccctttgagggtaacccgacctttctctctggctgccct

SEQ ID NO: 30286 - DNA, 285 bp, Homo sapiens
  misc_feature 270: d=a or g or t
ccccaccctgtgtccaagtgttctcattgttcaattcccatctatgggtgataacgtgtggtgtttggttttctgtccttgtgatagtttgctcggaatgatggtttccagcttcatttttgtccctgtaaaggacatgaactcatcattttttatggctgcatagtgttccacggtgtatatgtgccacattttcttgatccggtctatcattgatggacatttgggttggttccaggtctttgctattgtgaatagtgctgcaataadcatacatgtgcatgt

SEQ ID NO: 30287 - DNA, 108 bp, Homo sapiens
gtgtgtgccaccatgcctggctcatttttttgtatttttagtagagacgggggtttcaacatgttggccagcctggtcttgaactccttacctcaaatgatctgcccc

SEQ ID NO: 30288 - DNA, 187 bp, Homo sapiens
cataaatgatagcactgcatacaatgtaaaagcaagtaagtactcacaaaattgttactttttggttatggtgtttttattttaaaagacagtatacgcctctattacatgagttgcatttatcattcagttaatgtgatttcactttgaaattctgtgactttttcaaaaagagatgtgtcgcctt

SEQ ID NO: 30289 - DNA, 107 bp, Homo sapiens
  misc_feature 55: m=a or c
  misc_feature 65: s=g or c
  misc_feature 86: r=a or g
gattatccttgctgggctgggaagtggggaaagcaggggagcctgtgctgggtgmgattatctgsaatggaccgggttaatgggargcttgctttggctcgctggaa

SEQ ID NO: 30290 - DNA, 271 bp, Homo sapiens
  misc_feature 117: w=a or t
ttattttttaatttatttggtactgtaaaacaccttttcagaatgagtaaatgctgcatatgcattttggagttgttaatatgtgaaagatattacagattcagcaagaaaggaaawtttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtctc

SEQ ID NO: 30291 - DNA, 135 bp, Homo sapiens
tcaaaacctgcagttaacaggatattagacatcaatcctggtaaccaaatattaaagattctctttaaaaaagactgaacatgtttacaggtttgaattaggctaaaaggtcttgcagtggcttttcatggccaa

SEQ ID NO: 30292 - DNA, 112 bp, Homo sapiens
taaaaaaagaactagataaaatgagtcaggattaactgtggctcttccattccaatggtaaacagccacttgctcttgctcaaatttcatttaatgtctgaaagggagagag

SEQ ID NO: 30293 - DNA, 173 bp, Homo sapiens
caactgacctatctttgaaatatttttttcccgatatcacactgttttaagtactttgtctttataacaataaatcttgatatctgttcgtttaagatcttatactattattgccctttatattttcttataaattttagaatcagtttgttaatttctcccatatgctgcct

SEQ ID NO: 30294 - DNA, 202 bp, Homo sapiens
aatttcacccagaatccaaaaagccaagatggcctttctccaaaagaggagtgggcaaagacaaacacaagcacatatctgatctggaaaactgcctgtcctctgtgaaaattaccagcttcaggggctatgacttctacggtcttaaggataagacctgggatgaagtcttggaaacacatcacaaactcccgaccgatcc

SEQ ID NO: 30295 - DNA, 120 bp, Homo sapiens
  misc_feature 104: k=g or t
agagaagtgtggttttatttgtaaaaataagcaaatgctaggccttttaatctaagtctgtaactacacatgtgatatttatgtgtacatggtacttttctcgktataagactattccca

SEQ ID NO: 30296 - DNA, 310 bp, Homo sapiens
  misc_feature 93: s=g or c
  misc_feature 94: r=a or g
  misc_feature 157: r=a or g
  misc_feature 243: k=g or t
cccttgttgcgattcttctgtgaaggtacagtgtgtatgtgtgtatgtgtgtatgtgtgtgcgtgtctctgtcccagaccctgtgtcccccasrctgccccctgtccttcggtgcttcccagagacccctctgagctggcctgtggggcacgggaarccccctggatgggaggcggggccacaggtcggctagagggtctccaccaggcccactgaacagaaccccacggctgccagaatgtkccctgagcccacactgtggccagtgggacagtcctggtggctgacatcagcgtccatgcttggctca

SEQ ID NO: 30297 - DNA, 387 bp, Homo sapiens
  misc_feature 106: r=a or g
  misc_feature 126: k=g or t
  misc_feature 131: m=a or c
  misc_feature 342: m=a or c
tcaggaaatgactagagtggatcctggcactgattccaactctttgccagctaatcttaacatttagcagaaagctctagcaacatgatcttaattgtatccaggrggatttgccaaatgtatgtkcagtmtctcaagatttggcattagtcagacatgttgatgctagccacaatttggatttctccatagaataatcatttatttttgcagatcaaataaatcagagtttacaatgcacaggggatcatttatttagcattcccttgctagaagcccgtgtgccaggcactgtgctagaagtggtgggcagtataaagaaatctgtctccacagccacamaaccagagggtgcacatgacttgatccctatgaccaagtcaagtt

SEQ ID NO: 30298 - DNA, 383 bp, Homo sapiens
  misc_feature 98: r=a or g
  misc_feature 109: k=g or t
  misc_feature 342: k=g or t
  misc_feature 343: r=a or g
gagtataaaataacttaaaaacaaattgttgcaccacatgtaatcatcatagaacaacaggccgtaagacaaagggaattacagtaataagcagttgracatcctgtgkttaagtagatttttgaagaatgagctggcctaaataagattctaggtcattttcaaaactcaaagcagagtcattaatgagttctcatcattgcacaccatttacctcccataagatacatctataatggttcctgctgacctttcagttctattgtaaggtgatatttttggtgcctttgagatctttccattgaaagtatttcctgtaactatagttctcagacatttgckrtataaatctcacttgataaatctgtgctgaaactgtggta

SEQ ID NO: 30299 - DNA, 406 bp, Homo sapiens
  misc_feature 390: m=a or c
atgtaatgactactgagcaccatgccaagaacaatatgcattcagagccaaaatattgttagtttcaaagagctcagtgtttgtgagattgaaaaataaataggtgattctaatataggttgagaagggctatagtcgaagcacaaactgtttcctaaacaaaaaactcctaaccccaagtgagctgggtgttagggtaagggtgaggttaggaataggtttctgtgcaaaggagcccctgagctacttctgaaagaagaaacttaatttagattagtgaccaaggggaggaagagctttctaggaaaaaggaccaaaaaatgccaatgattgcagataaatgtgttttctttttggggaatacaaatagttttgtatagctggggttgmagatgagggaggtgga

SEQ ID NO: 30300 - DNA, 138 bp, Homo sapiens
ctaggtggcctttcaggtctgtttgatgttaggatttgcttctccctgggaagtgggtgatggggaaaaagacaccttccattggcaggtgtagacactgcaggctggacctcctgggtgtgcttgtggactccgacc

SEQ ID NO: 30301 - DNA, 243 bp, Homo sapiens
ttatcatgtgtcttcaacctttatgtcaataattgcagacttagaatagcagttctaagttaatggtaaaatgttacctactttcgattccatagcatctatcttctttgagtactttcttagagtgtgattttaatgattatgatctttgttctaactattttgaggcttcattaaaaaataaattatgattttattgttagaatcgtttctataaattaacgtcactgcgcctggccctaa

SEQ ID NO: 30302 - DNA, 201 bp, Homo sapiens
tagatgtgtgggtgggagggacagagtcttgctctgctgcccagcctggactgcggtggcacaattatagctcactgcagccttgaactcctgggctcaaatgatcctcccacctcagcgtcccaagtataacagctgggacaggaggtgtgtgccaccatgcctggcttattttttattttttgtagagagggggtccgt

SEQ ID NO: 30303 - DNA, 423 bp, Homo sapiens
tgtatgctcttgtcttgggccttggcatgagtgttttctttacctggaatactcatcccacaaacattcacgtggccatctccttcatcttcttctagtcaaggtattaatatgtctgatgagacacctaccctgactaccctattctttccaattcccattacactgccctattatttccataacattgtcagcatctgacatactttactatatgttttatttattttctttctcttctcattacagtgtaaatgccataagggcagtggtttgggtctcttgtttattgaagtatgctaagcacctagaatattattttacatatactaggtactcagtaaatattagttgagtaaatatttgtagaacagattcatttcatattctccattttgtggttctgcttcctttatgtcaaga

SEQ ID NO: 30304 - DNA, 410 bp, Homo sapiens
  misc_feature 387: v=a or c or g
  misc_feature 388: n=a, g, c or t
actgttataaatggtatgtgggctgaagatagggcttctgtattttctgactcccttctctgtgatttgttttgtgacttgtcctttggagggtgaagaagtgagaccctacatggctttttagtgcattgatggagcagagacacatctatgaacaactgcctatgcaaactgattactcggcagtataatttatcagtttgtatgagtaagtgagtgcttctcactatggatttagcttgcacttcaatttaggtaagtatactgctgcagcagcctcgaaaccagtgctctctgattgtaccaattagtaaatcctgaactttaccatcagaaaaagacatagctccacatttatgaatgcctggcttttgagaatgagagtavntatgtcaccaaaactgccaatc

SEQ ID NO: 30305 - DNA, 106 bp, Homo sapiens
cacacgatcatggtagtttggttgttttgcgagaggggaactaggtggttgatagacagaggtgggagtaaaactttatataccctttctaccttttcagttgtgt

SEQ ID NO: 30306 - DNA, 319 bp, Homo sapiens
catcttgaatttaattaggctcatatgacagaattccatagatggaattgacatcctaggtcatatagtccaagtccttgtttatatttgatacctagtgagattaaagggacattaaaaagtaaagaaaggaaagacctcatatttcttaccttccagtagagaaatctttctatgaaatcagaggaaagaattagaggaccagaatttttcctaaaatcaactttcatacatcttttttcatataaaaggcatagctgcatacaatgctaaaatattgtattacatttcctttatattgatgggaggaagggggaca

SEQ ID NO: 30307 - DNA, 201 bp, Homo sapiens
gattcttttcattctttgaaatcactttgctgagatttttttattttttttattttttttttggagacagagtctcgctgtgtcgcccagactggagtgcagtggtgtgatctaggctcactgcaacctccacctcccgggttcaggcgattctcctgcctcagcctcctgagtagctaggattataggcatgtgccacct

SEQ ID NO: 30308 - DNA, 176 bp, Homo sapiens
  misc_feature 11: k=g or t
  misc_feature 12: k=g or t
ttatcttattkkatatatcttactcttaataatttagaaaggtttaaaataatagattgacggatattttctcttagcactttgaagagtttaaaatcatagattgatggaaattttctcttagcactattgtcttttataatttgaagatactttcagtttaaattatgagtggg

SEQ ID NO: 30309 - DNA, 79 bp, Homo sapiens
  misc_feature 25: k=g or t
  misc_feature 26: k=g or t
  misc_feature 27: n=a, g, c or t
  misc_feature 28: n=a, g, c or t
  misc_feature 45: h=a or c or t
  misc_feature 46: w=a or t
taacaggcaatctacggaaagggakknnaaatttgcaatctatchwtctgacaaagggctaatatccagaatctacaaa

SEQ ID NO: 30310 - DNA, 192 bp, Homo sapiens
  misc_feature 109: s=g or c
caggtgggcagctgtgattgcacaacttgaagggccatcattcacatctattcagtgggagtggggtccctgggattgggcagtgtggtggccctgtgtctcctcaacstctgctcctgtcttcatcaccttctctctggaagggaagaggagttggaaggtctctggttttcttttctttttttttttttt

SEQ ID NO: 30311 - DNA, 55 bp, Homo sapiens
gcaatagattttagtaaaagaaatgtgcaacacctatagtttctacattttagcc

SEQ ID NO: 30312 - DNA, 206 bp, Homo sapiens
aaacatatacaaggtttagtgattgaccactgaagattaagaatgatgggtaaggaggtactgatatatttgtttattgtccagactacttgataattctttgcagcatcctgacaccacctctttccttctggatccaggaatcatctcttcatattagttattgtcaaatgtgttgttcctgagtaattcatatctcccactaa

SEQ ID NO: 30313 - DNA, 111 bp, Homo sapiens
  misc_feature 35: y=c or t
ggccaacatagagattggcgatggttgtgagattyaagagtgtgtgtgcatcttgacaatattagaggaggctgagcccaagcaggcacattctcttcgacccctccccca

SEQ ID NO: 30314 - DNA, 127 bp, Homo sapiens
actagcttatggctctgtgggcttggtgagcaagatcccagggcatgttataaatagatacccgcagatttgggaaaaggtttacaagattttccagcccaagcacatgttaactgctccccctcct

SEQ ID NO: 30315 - DNA, 183 bp, Homo sapiens
cccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctatc

SEQ ID NO: 30316 - DNA, 320 bp, Homo sapiens
  misc_feature 290: m=a or c
  misc_feature 291: v=a or c or g
taaattgaactccaagttgaatagtttgtttttattttaaaatttcttttcaatgtgttagttcattttgtgttgctattccagaataccacagactggataattaataatgaacagacgtttatttggctcatgattctggaggctggtaagtccatgagcatgacatctatccagggcctttgtgctgcatcatcccatggtgggaggcaagagggcaagagggcacaagacagcaagcaagcaagagggggccaaacttgcttttataacaggcccactatcttgamvcctaacccactcccatgataacaatatta

SEQ ID NO: 30317 - DNA, 149 bp, Homo sapiens
ccatgccctgtctcagtgtccaccctatctccccatcccccaggctgcagctttaggaattagttcctcagctgaaactaaacaccggccaatagtgtaatatgttcaacattttattaacacgagatgaatctcaggtacatggagca

SEQ ID NO: 30318 - DNA, 251 bp, Homo sapiens
aaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggatacaaacaaaaacttgtcatataggaatttttttctgtcttttccctgtgtacagcaaactgaggaagaaagatcattatttaatactcggccct

SEQ ID NO: 30319 - DNA, 149 bp, Homo sapiens
attctacgtcgctctttcttgaagagtcaagtcgttaaaataccaagtggaggcattccacaaacaggtgtccacaccacggccacgcggacacggagtcggggaatctggatccccacatgcccgccgagaactctccagctcccggt

SEQ ID NO: 30320 - DNA, 137 bp, Homo sapiens
ctaagattttaaagtcaagttagtaactaaataaccaggaaaagttaagtggaaaccactggtttttatatgttcagggacaaagacacaagcacctgcctcttaggcagttgtaaagatgtattttgagggcccgt

SEQ ID NO: 30321 - DNA, 246 bp, Homo sapiens
  misc_feature 168: r=a or g
  misc_feature 172: y=c or t
  misc_feature 182: y=c or t
  misc_feature 185: m=a or c
  misc_feature 197: m=a or c
  misc_feature 201: m=a or c
cactatatggatataccacattgtgtgtgcccattcatctgttgatgggcattttagttgttttcaccttttagccattttaaatagaactgctatgaacatcggtgtacaagtttttgtttgaacacctgttttcagttcttttgtgtatagacaggtagtccctgrcctyaaggattttytgmctttacaatggmgtgmgagcactacacgctcagtagaaaccatacttttgagtacccacct

SEQ ID NO: 30322 - DNA, 182 bp, Homo sapiens
  misc_feature 163: r=a or g
  misc_feature 172: y=c or t
  misc_feature 173: w=a or t
  misc_feature 182: r=a or g
attgtgtaatgctttatactaggggtctcaaacccctgggtggcattagattcttacaggagcgtgaaccctattgtgaactgcacatgcaagagatctaggttgtgcgctcattatgagaatctaatacccgatgatctgaggtggaacagtctcatcctgraaacaaacywacccccggr

SEQ ID NO: 30323 - DNA, 132 bp, Homo sapiens
gcttttctctcgggtgatccggccgagtggccctgggttagcagctgctgcatttccccggctggctgcggtcactggtggcagtgctcaggcgcccgccgcccttgaccttcggccccgcgagccctaacc

SEQ ID NO: 30324 - DNA, 132 bp, Homo sapiens
gcctgggcgggcggtgcagctcacttctgaccccgccccccagggtctccaggtgtctaaccagcttccctccacccgggtgcgcgtcacagaccttccccgcctgcatctggcacttcgcgcgaccccgaa

SEQ ID NO: 30325 - DNA, 91 bp, Homo sapiens
  misc_feature 6: r=a or g
ctgaarctctgccttccgggttcaagccattctcctgtctcagcctcccgagtagctgggactgcgggcgcccgccaccacgcccggccaa

SEQ ID NO: 30326 - DNA, 82 bp, Homo sapiens
cagccatcagtccacctgtgtgagtagacgctggacccgcggggtttcttcctttttactgggctgtgtcacgcggcatcat

SEQ ID NO: 30327 - DNA, 157 bp, Homo sapiens
  misc_feature 157: m=a or c
ctaatcttcattatggtcactgaaaacaatattgaacaggacatgaccaaagataaaaaccttgtggctggctcactactagacattctttttattacgcttcagaaagaacgctttaagcaactgtgaatttacttctactgttgtcccgccccam

SEQ ID NO: 30328 - DNA, 217 bp, Homo sapiens
  misc_feature 165: y=c or t
  misc_feature 167: k=g or t
caggatccaagtcttctaagaatgaaaatgttgaagtctacccagaaccagccatccttgtagacatttctatttggttgatttataaagatttaatatataaagatttaatatgagttaaacatgtttcttattctgtgatctctaattagaaagtaaaattcygktggccataaatataaaggaaagttttcacttatattttagtcaaacacca

SEQ ID NO: 30329 - DNA, 183 bp, Homo sapiens
  misc_feature 155: k=g or t
  misc_feature 161: y=c or t
  misc_feature 162: w=a or t
  misc_feature 164: m=a or c
  misc_feature 167: y=c or t
  misc_feature 172: k=g or t
agatattaaggagtctttaaaatgatcatatgattaattttaggaaataccatgttaaaaaaagctaaacagtttttattttttaactgcaggtcttctcatagcctttaatttgcaaaaatgaaatacaaagagttggatataatatacaacgkttttcywamctycagckgactacgcaac

SEQ ID NO: 30330 - DNA, 89 bp, Homo sapiens
gattttggttgatgcatatttccccgtttaagtagccgttagggcgcagtatcggcagcttgacacccaccaagcaaaagtttcagccc

SEQ ID NO: 30331 - DNA, 133 bp, Homo sapiens
tacaaaattagccaggcgtggtggcgcatgcctgtagtcccaggtactcaggaggctgaggtagaggttgtagtgagccgagattgctccattgcactccagcctgggcaaaaagaacaaaactccgtctcaa

SEQ ID NO: 30332 - DNA, 282 bp, Homo sapiens
gttttcgtctctcctccccacgaagcggaatgttttggagccgatggataacaagaacactattaacattcttttgagcctgttttttaaaagggggagggagcgtgaagaattgtttaacatttggccatcgtttggctgcacactaagcaccacgaagtatttatggttgcagatcaggtgcaaacggggcttagagagaaaggatatagacctgcagctaactggatttgatttataagagagaaatctgcagtcaatgcccactcttgccacatccac

SEQ ID NO: 30333 - DNA, 173 bp, Homo sapiens
caaaaacaaaaacaaaaacaaaagaaaaggaataatgataaaatcgaaaatctgaataaacgtataatgagtaaggagactagatcagtaatccagtctcccaacaaagaaagcccagggcaagatgagttcactggtgaattccaccaaacctttaaagatttagcagcaat

SEQ ID NO: 30334 - DNA, 217 bp, Homo sapiens
tcgggcttgtgttctccctctcattttagtctgacttgactattgtttttcctttctggcgcatgaatccatacatcattcctggaagtgaggcaagactcttgcatctctacaaagtagttttgtcaatttgaattcagggaaaagttggtcacagcctgcaaatgacttcatttggaagtctgattgtttcagttgcctgacaaatactacactg

SEQ ID NO: 30335 - DNA, 285 bp, Homo sapiens
tttaagtgctgtattgaaatatatggcaaacttttaaatttctaagatcattaaaaaatccttgttttctgtatgttttaatgttttcttggctatgtgcaattctaaaaatcagagagtacttgtttgtacccttttctacactttgaaagtttgatagcagaaaatgaataggccaaaagtgtacttaaaaaattgttttcccaggaaaggacaccaattgaaagcacacagctcaatggattatcacagagtgaacaccactatttctcttcaccccagttt

SEQ ID NO: 30336 - DNA, 238 bp, Homo sapiens
  misc_feature 31: b=c or g or t
  misc_feature 32: v=a or c or g
caattagcagggcactggccagagtttgtabvctgtgttttaccttaacaacattctatttgctctttgtatatttaagtgttgtaaggaaacgtgtttcaatcaaaactgaccatgagataaaggaaagagatgtggcttttgtgatattctatcacaaacacttattgtatctctgtaaaatacaatgtatgtatgcatgtaagtgtttttgtcctaatgttgctactcccatgac

SEQ ID NO: 30337 - DNA, 303 bp, Homo sapiens
caattgttggtaaagggaatagaattattgaagaaccagaatttaaccctgtaagttatcgtcattcttggtttgtgtttatgctcatagttcacaaaggccaatggacctcccacttcccttccctgttaatagagtctggcttaaaagacactcagtagctatctcctaggggaaggcctagctgcactctctgttcacttcattcccacttccttttaccactgacctcccacagacttatttaactgcttcctttgggagggactattctttcctctcctacctgacctcccctgcgac

SEQ ID NO: 30338 - DNA, 133 bp, Homo sapiens
tactggtggggacctctgttagtcactttacctcatccaaagtataaaggaattggaccaaataatttaccacatagctctaaaacttaatttaaaatgtaattccagaaaaaaaaagggaataagcaagggg

SEQ ID NO: 30339 - DNA, 122 bp, Homo sapiens
aaataccttaattataaaagatcaaagaaaaatattatatctgacttcctttcagaagctatgcaagcaagaagagaatgggtttaaatatttaatttcttgatagaaataaaaaactcacc

SEQ ID NO: 30340 - DNA, 338 bp, Homo sapiens
  misc_feature 31: s=g or c
  misc_feature 32: b=c or g or t
  misc_feature 266: b=c or g or t
  misc_feature 267: n=a, g, c or t
  misc_feature 290: r=a or g
gtttctgtacactcactggcaggcttggtgsbggctccctcgcccgcccgcccgccagcctgggaaagtgggttacagagcgaaggagctcagctcagacactggcagaggagcatccagtcacagagagaccaaacaagaaccctttcctttggcttcctcttcagctcttccagagggcttgctatttgcactctctcttttgaaattgtgttgcttttacttttcacccttctgcttgggttttatgagggctttgttaagtbnagagggaaaagagactgagcgarggaaagagagaggcaaagtggaaaaggaccataaactggcaaagccgt

SEQ ID NO: 30341 - DNA, 113 bp, Homo sapiens
  misc_feature 99: y=c or t
caaggtaatagtcgatataaagtgaagcacaggtccaccagattccagaagctgtgcttttatctatgatgttctaccagctcccatcctttttttttyctgtcaggttgact

SEQ ID NO: 30342 - DNA, 202 bp, Homo sapiens
tggaaatctttttctttaaaagtacccaaggaatgaatgataatggtagagaagctcccatggtagctgtgggatggaggttttcttggctaaattgattttttaatttgtgttttttaggtgctagtatgataaattcgggagcatagaagttaggacttgcatcctcattggaggcaaaaattggttattggggaggcac

SEQ ID NO: 30343 - DNA, 334 bp, Homo sapiens
tgaaggactggtacgcaatactaagtagaactgggagtagagtataaccatcaatagctattgtttgctacgctacttgctttttataaaacattaccagtcctgagaagtattagctggagagtgtgaagaaagaacatttcatcatcttgcccaaattcacaaaacaagtaagtagcagagccaagtctacttcaaaatttggtaatctttatggttctgcaatactctgttttcctgaataagtaaaatacagctcttttaaatagcacaggaagagtcttggttgcccctttcactacaacttatgacttcccattatacacacccaaac

SEQ ID NO: 30344 - DNA, 87 bp, Homo sapiens
  misc_feature 2: r=a or g
trattttagtggattacaagacagactggttaaaggattttttaattgattgtgcttttggctttaggtaatgggatttactttttt

SEQ ID NO: 30345 - DNA, 174 bp, Homo sapiens
  misc_feature 20: r=a or g
tttgaaatacatctgttaaracttaaaaactaaagtgtgattttttttgttgttgttaagtttattgaagtttattcccttaatcagtgaaggacaacccttatttattacctagagcagttgtataattcgctgttagaaattttggtattgggacagtggataagcaggcac

SEQ ID NO: 30346 - DNA, 207 bp, Homo sapiens
attctccagtcttctatgtgttgcaaaaagaagagaaatgagcccaaactgtgtaagtttgtggaggaaaactcacacattcccgggacagtgatcatattcttcgttcgcgtgttgtctcaggtctacaaagaaagccatctgtgagctcagcctccaggggctccgcattgcctacaacagcacaaaagccaaacccgtcagccc

SEQ ID NO: 30347 - DNA, 169 bp, Homo sapiens
ataacctgaagaaggtgtttctcaaagtgaagttgaaggctccaaaagaagtctaaggtgggcccactagtgtgcattttaaacaaacttcctaggtgattatttcacattccaaaatctgagaactaatgccctgtgggaaacagcaccacttaaaagcaaggccaat

SEQ ID NO: 30348 - DNA, 369 bp, Homo sapiens
  misc_feature 201: v=a or c or g
  misc_feature 333: d=a or g or t
caggagttaagtgtcaaatcataaaaatagtaaggttctacaaagtctaaaaatttaggacatgtttatagcctgttcttaagattccagcttcaatgaaattgatatattatgcctgttgtttctacattaatcttatgttctcctactctaccattccaggaaccgaaataaggtagattgctacaagtatggattttvattttggtaatttaaatcattagacagaacaacttatttataaattacccttttcaaaccgatcatcattgtttctgtttgttaaacttaatgaatctccaacacaacttatttcactttacaattcttatdcattgacttttgttaaagcccatgtaaacaccacta

SEQ ID NO: 30349 - DNA, 63 bp, Homo sapiens
ctctccgccagaccgccgccgcgccgccatcatggacaccagccgtgtgcagcctatcaagct

SEQ ID NO: 30350 - DNA, 312 bp, Homo sapiens
  misc_feature 56: m=a or c
  misc_feature 65: r=a or g
  misc_feature 243: n=a, g, c or t
  misc_feature 244: v=a or c or g
tgggccttaggagacatggcgtcccctggggggcctcacagcgcctctagtggggmcttctcctrggcggaggctcctgagggaaggcagtgcgcaccttggctgtgtctctgcagaatcttgtatgcttgctgcgtggtgtcctcccatgcagttgcacgaaatcattcttttattcctgatcctgtttcctgtttatttcatgaacttgtctgtaggcagcatggtgctgggcgctgcagnvgccattaatgcatgagacacagattccactcaggagagagaagacgaacacagacacagtacacggtg

SEQ ID NO: 30351 - DNA, 126 bp, Homo sapiens
attccatgagagaatgtgctgggtagaagaaagttgccagcggtttaagcatttttaaaatgcaagaaacgctcagtagaacgagcttgaaccagccaactccagacttggaagcaagcacaccgc

SEQ ID NO: 30352 - DNA, 191 bp, Homo sapiens
  misc_feature 146: n=a, g, c or t
ctgtttcggtaccagtaccatgctgttttggttactgtagccttgtattatagtttgaagtcaggtagtgtgatgcctccagctttgttcttttgccttaggattgacttggcaatgcgggctcttttttggttccatatgacctntaaagtagttttttccaattctttgaagaaagtcattggcagccc

SEQ ID NO: 30353 - DNA, 162 bp, Homo sapiens
atgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggccc

SEQ ID NO: 30354 - DNA, 292 bp, Homo sapiens
atcgatggcaccacctatgcagactgagacacaggcaaaggaaccccggtataggagaatcagcttacattgttaagctccctgcccctcagtcttttacagttatcttttcctaaacctaatttggcaacagtgttttgttggttggttgatttcgcacctttacagagtctttctaagggtttaacttagtattcatgactgggcacggtggctgatgcctgtaatccttgcactttgggaggctgaggcaagaggaccacttgagcccaggagtttgagaccaacctga

SEQ ID NO: 30355 - DNA, 242 bp, Homo sapiens
atccttctcctgctcttggatgtcaaaattccaggttcaccagcttttagactctggggctcacaccagtggcccccaggattctagggatttcagctttagactgaacctaacactgtcaacttgcttggttctgaggcctttgaacctgagctgagccacactactggctttcctggttctccagcctgcaggcagtctacaggtgggatttttttggacttcataataaagtgagtccc

SEQ ID NO: 30356 - DNA, 300 bp, Homo sapiens
tcaccatttttcttaggaatcttatacaataaatccttcaggttgcacaaaagcaaattattagttttcattagaaactctggttctgaattacaatcataggttatataaatttaactgttagatggtctataaaaatgacaaatcttattaaaatatgtgcaatatttatggaagtcaaacagcttcatatcagtgataaagattgttattaaaagataaatactgtctgttaatttgcctcaagttcctcgtttataaaataagagagttggacactgattcttaacatctcctcca

SEQ ID NO: 30357 - DNA, 203 bp, Homo sapiens
taatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttatatttgatagactgttttcagaaaactcttatcaacaagtgggc

SEQ ID NO: 30358 - DNA, 251 bp, Homo sapiens
cccatctgcctgctcccactaggggtctgagtagcaggcaccgaagaagtgagccacgccctcttcacacaccctttgaggaggacaagggaacttttcctgtttcagaaagttgtgttgagaagaatggcaaggctaacagggcaggtgtccgggcggaggggcggaactggctgttggcatgtggtgggggagatgcttcatccgggtcttgcatttgttccctctgacaccagcctcgacaggacact

SEQ ID NO: 30359 - DNA, 127 bp, Homo sapiens
  misc_feature 36: n=a, g, c or t
  misc_feature 87: m=a or c
  misc_feature 116: m=a or c
  misc_feature 126: r=a or g
agatgtggccggtgtacgtgaggaattgcgtttaanattttgtctcattttacttaattaaaattgaagcaaccctcttctcctcamtcgggtcatacataaatccttgtggatamtcccccaaarc

SEQ ID NO: 30360 - DNA, 125 bp, Homo sapiens
taatgacccggcccccgccctctgcccccagctgctcctcgcagttcggttaattggttaatcacttaacctgcttttgtcactcggctttggctcgggacttcaaaatcagtgatgggagagac

SEQ ID NO: 30361 - DNA, 302 bp, Homo sapiens
cagtttttgccattaataattcactgacaatgagtttaagagacctatcattaaaatgcaccaagcaattgcaaacactcttaaatcaaattaaaggagggggcactaagtaaagaaatagaagatataacaaagaaccaaatagaaaaaaatggaaatgaaaaattcaacaagtaaatttttaaaaattactggattggctcaataacagaatggagatggcagaggaaataataaacttgaacattcatcaatagaaattatccattctagacaagaaataaaatcaattgggggaaaaa

SEQ ID NO: 30362 - DNA, 359 bp, Homo sapiens
  misc_feature 328: v=a or c or g
ggcgtcattaggatcctggtgggcggtgggacttgggttcaaagaagaccaagcaggcagacgtgttcgggggcccgcgggttccgagactggagactggacctttggctgtccccacgtgcattctaggtcaacggtgcggtggcagaaccctggggctctcccccgcggaactcggccctggccgaggccccaaccacgctagtaggaggaggccgagcatccctcctcgaaatcgcgaaatcccggcccgacaatgtagccacggagtcgaaagccgcgtgcgaacttggcactcacaaagcctagataaccgtctattttcatvtgtaaaataggagggatggacccccacagca

SEQ ID NO: 30363 - DNA, 91 bp, Homo sapiens
tgttttctgtgttaaaaccccatttggtgctattgagtttgttctttattcttttatcccagtgaaaattgttgatcttgctgtagggcga

SEQ ID NO: 30364 - DNA, 163 bp, Homo sapiens
tttttcttctctccctcattcatatggttgcagtctgagtgtctaggttaggaccatatgacttcatgtacacagcattgggctggggatggacccctaacccaagctgggaaaacagactctttcactgagaatttgctcgtgagcctcagagaccccattc

SEQ ID NO: 30365 - DNA, 387 bp, Homo sapiens
  misc_feature 179: n=a, g, c or t
  misc_feature 348: w=a or t
  misc_feature 349: k=g or t
tttagtttaattagatcccatttgtcaattttggcttttgttgcaattgcttttggcatcttcgtcatgaaatctttgcccttgcctgtgtcctgaatggcattgcctaggttttctttcaggatttttatagttttgggttgtagatttaagtctttaatccatcttgagttaacttntgtatatgggttaaggaaggggtccagtttcaatttgctgcatatggctagccagttctcccagcaccatttattaaatagggaatcttttccccattgcttccttttgtcaggtttgtcaaagatcacatggttgtaggtgtgtggtcttatttctgggttctctagwkctgttccattggtctatgtgtcggttcttgtaccagca

SEQ ID NO: 30366 - DNA, 166 bp, Homo sapiens
  misc_feature 94: r=a or g
cctaaccactttccatatttcctagctaaacttaacgtttctttgctaagaactatgaattacacattctttaacaatagatgaaagaggtgargtcattatggaaaaacatttcaaaaatttctgtttttggtacgtctttcaagagtttccctgaccaccccca

SEQ ID NO: 30367 - DNA, 178 bp, Homo sapiens
aaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggctat

SEQ ID NO: 30368 - DNA, 182 bp, Homo sapiens
cccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacaaa

SEQ ID NO: 30369 - DNA, 278 bp, Homo sapiens
  misc_feature 140: m=a or c
gagccaggccgggtggaaaacaaaaagagaagaagtgattatgaaataataagacggaccgtgtgccccttgcaaggtgcggcctgcgaaatcaacagacttataaataaggtctggtggaagcgcaggagcgcacgcgmgaggctatggcgggggaacctctgtgagttccgcggcggaggctagaacatcgctgtggctgcgggaccctcacccggcgctgaaaaccctccacatcagctcctgctcggaaatgtctccgcagctcaccagtgcca

SEQ ID NO: 30370 - DNA, 142 bp, Homo sapiens
  misc_feature 17: k=g or t
aataaagtatataaatkgtgaaatataaaaacttggaacttattcaaagcttcaaagcaaacaacagttttgtgtaagcattctttcccctccagtattaggtgtattcttggtaggattatttgtgataatttgggctaca

SEQ ID NO: 30371 - DNA, 166 bp, Homo sapiens
tcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgccta

SEQ ID NO: 30372 - DNA, 382 bp, Homo sapiens
  misc_feature 317: n=a, g, c or t
  misc_feature 363: m=a or c
ttaaagtgacatgattgcactgaaaagggatagtgcttttgtgaaatttttcaaatttgagtaatagatgcctttttaaggcagtgaatttacacaaatatgggaggggtatatggtgttactgatttttaaacctctttgaccatcttctagtttttacttctagtttttacatctaggagaattgtgaataacaccaactgttcttaaactctttaatgccatgtcttaaatgccggtatttgctgctgaagacaaaaatgaaaagtaggatgaaaataatagaatggcactgtaagtgtttattattttgtcanaatgtaaacaaagactacataacccaatgatggagggaaaaagggmatgtatctcattcagatgt

SEQ ID NO: 30373 - DNA, 369 bp, Homo sapiens
  misc_feature 314: r=a or g
  misc_feature 322: b=c or g or t
  misc_feature 323: y=c or t
  misc_feature 324: w=a or t
ctgactcttattttgtgacatctatttagttaattgttcacttccagtatatgtatatagctgtaccagaattgataacctgcccttagtagaagaacatctttatcaactaaattaaatgccttcgtacaagtttcttttgcctttcatcttaagagactgcactcattttcaatatcactttgactagcaccctttcccttaagtccctcactgaagttattttgtatggttcataatagagctagataaatttgtaacagtctgcattgtatcctgagattctacaaccttttaattaatttttaattaaraatataabywttattttggtaaatattagcacttctgtgccacactactatatat

SEQ ID NO: 30374 - DNA, 128 bp, Homo sapiens
tgtgcatgtgtctttatagcagcatgatttatattcctttggggatatacccagtaatgggatggctgggtcaaatggtatttctagttctagatctctgaggaatcgccacactgtcttccacaaca

SEQ ID NO: 30375 - DNA, 160 bp, Homo sapiens
tattcaacatgctgaagtaaatcttgcagaaaaagcatttttacagccattgcctgcagtcttttaatttgtcagcctgagatccatcacagctgaattaggtttcttaagccgtttatttgcaataaagtgtaatcttccagttagtttgcaaacacct

SEQ ID NO: 30376 - DNA, 236 bp, Homo sapiens
cacattgcgcaagtttcagttactagaaaggaaggggagaataaaattggtaggcaccttatagtccctgccatcttcttaatgtaatgtcaattttgaattttttgttgtgatatatgatgcataagcaaaccgtgtactgcttagagaaaaataaactgacacctgtgtacccacagtgcacttcaggaagtgcgccgttctacgccttggaagcccccacatgccgccaccca

SEQ ID NO: 30377 - DNA, 362 bp, Homo sapiens
  misc_feature 158: w=a or t
aatttggttttggttaaaatttttggtttatttatttgaaatccacactcccttggaaactcttaagtgcatttgtgcacttctgtttgtttgtctcaaagaagggactgtaacaatctgagtaatttccatgtcctcttccttattcctctagtggwtgaagctgtgtagcattttaacatatatatattcacaaatatattcatataaacagtatacattttgaatcagtcatttgttaaagaaaagtatattcaatgaagatgaaatttaaataaaaaaaggacagagtctatcctccagggattgaacattttccaattatctggtcttttcctgttgtgcaaaaatgactcattgct

SEQ ID NO: 30378 - DNA, 244 bp, Homo sapiens
taaagtaatagtatcagagtggggaacgtctctctgtatgaccaaactccagaatctgtaatagaaaatatctacaaatcggactgcatggaaatcaaaattttctacatggcaaaacgttacagttgacccttgaacaattcagggattggcgtacccacccactacgtgcagtcaaaaatatatatataacttttgactgcccgaaaactttactgattgcctgtctattgacctgaagccc

SEQ ID NO: 30379 - DNA, 71 bp, Homo sapiens
tttataattatttaaatctgtaaagtaaagagagtgatatctaccatgcagtgtttttgtttttttttttt

SEQ ID NO: 30380 - DNA, 320 bp, Homo sapiens
ggtttatgtggttttattctgtcttaaatataagtttcaaggaagggaaaacaaaagtgataaaatgatagaacagtctagaggccactgtaaagtcaccgccactttacgtgtatgtcagtcttggtgttcttgtatgagtaaaatggatgtaaaatcataaaatcacagtgaatgtttcaggctacactggaaaaagtatgcacttagaattaaaggaaattgtataattcaccaagatttctttgtgtagatcaggggttggcaactatgacccacaggctaagactggtcagcggtctggtttttcacagccatga

SEQ ID NO: 30381 - DNA, 133 bp, Homo sapiens
ttatgaacaatggtgctatgaacagttgcgtacaagtttttgtgtgaacatatgttttcaattctctcattatatacctaggagtagaattactgggtcatatggtaactgtatatttttgaggaactgccat

SEQ ID NO: 30382 - DNA, 203 bp, Homo sapiens
  misc_feature 25: r=a or g
  misc_feature 26: w=a or t
actcttggcagtggctgtctttggrwagtaatgaactttcttcttatatactactttttaattttctgatgagtaataatttttaaatggaaccatgaaacagaacggcaaataccaatgtaattcccccaaatcttagtatctggtaggaatttcactgactgtttgctgctacatgctcatcagactcttacctggccgct

SEQ ID NO: 30383 - DNA, 78 bp, Homo sapiens
aacacatacatgtcattccctaccatctccaccctctgtttattcagagctgcaccaaccatgttcatcacctcacct

SEQ ID NO: 30384 - DNA, 156 bp, Homo sapiens
tattttagaggggacccatgtaaatgtgcttttcagtggggaacagaggatgatactttttgtgtttagttctcagctactttgagttacatttactccttcagaaatggcatgaaattttaatgtgttatcccacattattcataagaatcaggg

SEQ ID NO: 30385 - DNA, 312 bp, Homo sapiens
  misc_feature 105: w=a or t
  misc_feature 106: n=a, g, c or t
  misc_feature 107: n=a, g, c or t
  misc_feature 108: h=a or c or t
  misc_feature 283: n=a, g, c or t
  misc_feature 284: w=a or t
ttcctgacctttttgtttttgtatcatcatggtgattttgactagagagcagatgtgcagaagcttttaagaatctagatagcacgcagcatcatgtccactctwnnhaaagccagaataattaatagttcctataaggtgatttggaaccaggaacctcaattgccaaatcaaggccaaaataacaaatttgatagattatgggatcaaccttagccaaatagcttataccatgaaacaatatataatagttccaacttgcttgtttctttgatccaagganwagaagtatgagcaacggcacagacacca

SEQ ID NO: 30386 - DNA, 169 bp, Homo sapiens
ttcatgaaaatcatgattctgtttattacacctatgaagactatgcaaaaagcatttcatgtgaagtactaggctcagttcttcgtacccaccatactaataccctatcaaatattaacagtattaaacatggagaaaataaaactgtaacttttaagcatggaaaccg

SEQ ID NO: 30387 - DNA, 238 bp, Homo sapiens
actcaaatttaggactcagggtttttacttgatgccattgatccaatgtctgtatatccctttttctatgctaaaaatcaattagaaggctagtgaaaacagtttaagatttttaaaattaatcctgtccttaagatgtatcccactaggaatggaaggtcaaatagctgcatttaaaaatcactagaaatagttgctctctgggttgttatggcatcaattctgtaagcaggtgcat

SEQ ID NO: 30388 - DNA, 367 bp, Homo sapiens
  misc_feature 266: r=a or g
  misc_feature 316: r=a or g
  misc_feature 317: m=a or c
  misc_feature 326: r=a or g
atgagatcagtctggattcttgttgtaccagaaattttaaaaatgctcaaagtatggattggggcatgtcaaatggacacaagagctagctcaaagaggcactgactggccagatcttggacaatattttttggtaacagctttattgagatataattcatgtatcatacaattaattccattaacgtgtacaattcaatggtttttagtatatttgcagagttatgcaactaccacctcactcagttttagaatattttcaccartctaaaacaaaaccccatttagcagttactgcccaccccgctcctcccarmtgcctggcraccactagtctactttctgtctctatggatttgcctactct

SEQ ID NO: 30389 - DNA, 381 bp, Homo sapiens
tagatttcccccccaccatgaagtttcttcctatttttttatgctgtaacttacccccaatctttatctctggatttttactctttcaattttgaagttgactagcattttcaaacctttattttatacccttgtcttttatattaactttttcttattattctttaggtaagaatgattgatgttggctgatattggagtgctcattcacatgaagtggatagatacttctcaagacatcacacagcgtgagtcaatcaaggagggaagccacaagcagactgacaacgtttctaggtaagttaaatgattcttagtctgttaaactgtcttcagaaaggcccttgggtggtacaaaaataacaatactaatgtgggaaa

SEQ ID NO: 30390 - DNA, 97 bp, Homo sapiens
  misc_feature 16: w=a or t
  misc_feature 36: r=a or g
  misc_feature 37: r=a or g
  misc_feature 70: r=a or g
  misc_feature 97: n=a, g, c or t
agtaaggaaggtaagwtaggcagaggaataagtttrrctgctatactgttactacaaaggcctcagccartttcatagcaagctctgaagctggggn

SEQ ID NO: 30391 - DNA, 356 bp, Homo sapiens
ctggtccctgacgacgcgcagtgagggccccgccgctaccccagcagtcgcctcccaagttcgcggaacgcagctgaccggctccctctggactgggtgacatgactgctcccaagcagtcgtttgtaaactgagtttctgtaaaacaattttatttttcatatgtgactgtagcggggtatgatttgaactttgttttccgtcccccagcccggattctctgtcttctcctgtacagccgttccgttttcttacctcgtctccgtcaccgaggccctcagccctgaacacaaggactgggcagtttccctattgattcctgaacctggaacttaagacatcttccgaggggcccc

SEQ ID NO: 30392 - DNA, 411 bp, Homo sapiens
  misc_feature 156: m=a or c
tagaaggaagatcagcattcataaaaaatataaaacaaaatgctcacatagtagaatggtccccaagaggagagcagtatgtagttatcatacagaaataaaatagacatctatcagcttgacactgcatccattagtggcaccatcacaaatgamaagagaatttcctctgttaaatttctttcagagtctgtccttgcagtggctggagatgaagaagttataaggttttttgactgtgattcactagtgtgcctctgcgaatttaaagctcatgaaaacagggtaaggacatgttcagttttgaaattccagagcatcatgttattgtttcagcatcgagtgatggtttcatcaaaatgtggaagcttaagcaggataagaaagttcccccatctttactctgtgaat

SEQ ID NO: 30393 - DNA, 325 bp, Homo sapiens
  misc_feature 96: s=g or c
  misc_feature 137: s=g or c
  misc_feature 318: r=a or g
gtctcgccatgctgctcctgggcctgctgctgctgctgcccctgctggctggcgcccgcctgctgtggaactggtggaagctccggagcctccacstcccggcctcttgccccgggcttcttgcacttgctgcagcscgacctcccaatctatctgcttggcctgactcagaaattcgggcccatctacaggctccaccttgggctgcaagatgtggtggtgctgaactccaagaggaccattgaggaagccatggtcaaaaagtgggcagactttgctggcagactgagccacttacctacaagctggtgtctaggractaccc

SEQ ID NO: 30394 - DNA, 344 bp, Homo sapiens
  misc_feature 90: k=g or t
  misc_feature 92: k=g or t
  misc_feature 102: r=a or g
  misc_feature 103: w=a or t
  misc_feature 104: s=g or c
  misc_feature 105: r=a or g
  misc_feature 266: r=a or g
  misc_feature 268: r=a or g
  misc_feature 270: r=a or g
  misc_feature 272: r=a or g
aactggatatgtgtatatagagtagtttttcaaaagtaaactaaaaatgagaagcatatctcaagaattattttattgcaagtcttgtaktkaaatgttaarwsratttgttgttgcaatttagcttgctttcaagcttcaccccttgcacttaacataagctatttttggcattgtgttatcatcggcttattttatagatcaatatttttatttccctttttgctgaggaaatgaagataagcaaaaatataaatatatatatrartrtrtgagttattaaaatcagaagaatactttgtggctgtgctgtttgtgccaatagactttgtcatgaccaaaaa

SEQ ID NO: 30395 - DNA, 256 bp, Homo sapiens
ccaagacgagcaggtcacctgaggtcaggagttcgagaccagcctggccaacatggtgaaagctcatctctactaaaaatacaaaaaaaaattagccgggcttggtagcaggtgcctgtaatcccagccagtcaggaggctgaggcagaagaatcgcttgaacccaggaggtggaggttgcagtgagcccagatcacgccactgcactccagcctgggtgacagagcaagactctgtatcaaaaaaaaaaaaaaaa

SEQ ID NO: 30396 - DNA, 260 bp, Homo sapiens
  misc_feature 88: r=a or g
  misc_feature 110: r=a or g
catccattccaatgtagataaatgtttaccaaaggaagcaacagcatggtacatattatgtacgtatgttgcttacaaggattaatgraacaaaaaattttggataagcrttaaagatactctcaaatggccgttctccctctgtccatcgtgttttcatgggttacacattttatatatcatgaatggaaaagattctctgttcacgaattcctggttcagaacaaaataggaaactaaagtaagcatttacgacatac

SEQ ID NO: 30397 - DNA, 230 bp, Homo sapiens
aggtttccgaccctccgcgtggcccacagctcataccttttcgggtgtccccgggtgtcaggcgagagcggtcctggggggcgctgggtgcccacccggttgaatggccgcctgagccggggaagatgcttcatctgcccctgcccagatccggaagaacggtgaatttcccccgcagctgggatgaaagcagctccatcagtagtggactcagcgatgcctcagaccgc

SEQ ID NO: 30398 - DNA, 66 bp, Homo sapiens
tttgagacccagaaataaattcttttcttttcttgattcttgctcttaaaaatacaaaaaaaaaaa

SEQ ID NO: 30399 - DNA, 341 bp, Homo sapiens
  misc_feature 102: w=a or t
  misc_feature 303: r=a or g
  misc_feature 304: s=g or c
aatttttttcttagctttaaccccagcccatttcaaccccctctttgccctttgtatattcttttgaaaatatgatccagtagtgtttatgaatgtgttgtwgtgtaaaatttagagattgatgttaaacaacagaattaaaggacaaagctgtcttttttgttggaattggggatgggagagcagctcaaagtgggaaatatggagaaaggagagacattgtggaaaagaagagataaattgaggggaaaaaaagaggatgaaaaaatgaagagagagaattactgatgtgcttcacacccrsacctcctctccaacttcacagtaacagaggcaatgtc

SEQ ID NO: 30400 - DNA, 329 bp, Homo sapiens
  misc_feature 90: s=g or c
  misc_feature 93: r=a or g
  misc_feature 94: r=a or g
  misc_feature 99: v=a or c or g
  misc_feature 100: y=c or t
  misc_feature 103: r=a or g
  misc_feature 169: r=a or g
tgaagggtcaactgtactttaataattgtttcattggtaaaatgaggataacttaccttgtagggttgttttgaaggttaaatgagatasatrrtaaavytargagcagtgctcaggtcataaaaattgtagtcaatattatttctttcaatttatttgtaaaacaaaraagttttagtctcaatttcattctagaagtgtaatgtgaataaatgggtatggtgtatattcttccataactgttccagttgacagtgtattttatggtggtctaatggtccaggatgaagtttattcttctcaggacttttataattcatttgttgcat

SEQ ID NO: 30401 - DNA, 126 bp, Homo sapiens
ctttaatgtgaaaaacaaaaggacagaggaaagtaaagtaaaacaaaggaaattagggcccacaagcttaattagtatagtgttgtaacccaaatcaacaatgggaaggacacagtgacaaaacct

SEQ ID NO: 30402 - DNA, 105 bp, Homo sapiens
ctagtttggggctagtatataaataatgatgctgtaaatattcatgactaaatttttgactcagttgatttttgattattgatctttaaaaatcttgccacccgc

SEQ ID NO: 30403 - DNA, 310 bp, Homo sapiens
  misc_feature 104: k=g or t
  misc_feature 105: b=c or g or t
  misc_feature 123: m=a or c
  misc_feature 219: r=a or g
  misc_feature 220: r=a or g
atagaaatatttatatacaatggactactactcagtcatagaaaagaatgaaataatgtcttttgctttaacttggatggagctggaagccattattctaaatkbaagtaactcaggaatggmaaaccaaataccacatgttctcacttataagtgggagctaagctatgggtacgcaaaagcagacagaatggtataatggacactggagactcggarrggggcaggtaggggagtgagacatgaaaaactacctattggtgtacagtgtacactgttttggtggcaggtgcactaatatcccagatct

SEQ ID NO: 30404 - DNA, 306 bp, Homo sapiens
  misc_feature 57: k=g or t
  misc_feature 250: s=g or c
  misc_feature 264: m=a or c
  misc_feature 287: y=c or t
  misc_feature 289: k=g or t
  misc_feature 291: k=g or t
  misc_feature 300: m=a or c
  misc_feature 303: y=c or t
  misc_feature 304: y=c or t
  misc_feature 306: y=c or t
tcgttcacagctgggggtccccgattccaatgctgttttttggggagtggtttccakgagctgcctggtgtctgctgtaaatgtttgtctactgcacaagcctcggcctgcccctgagccaggctcggtaccgatgcgtgggctgggctaggtccctctgtccatctgggcctttgtatgagctgcattgcccttgctcaccctgaccaagcacacgcctcagaggggccctcagcctctcctgaagccstcttgtggcaagamctgtggaccatggcaagtccggytkgkttcatccamcayyty

SEQ ID NO: 30405 - DNA, 337 bp, Homo sapiens
  misc_feature 312: d=a or g or t
  misc_feature 313: k=g or t
  misc_feature 320: w=a or t
cttatgttttcacctgtcaacaaaaatgtccagatacatacacttgaaaaataagatattctgtccaaagcctacgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttattgttcataaaacaggtggatattcagaattacgtctgatacadktaatggwaaacctttgaggccaga

SEQ ID NO: 30406 - DNA, 375 bp, Homo sapiens
  misc_feature 113: y=c or t
  misc_feature 119: w=a or t
  misc_feature 129: k=g or t
  misc_feature 199: h=a or c or t
  misc_feature 247: k=g or t
  misc_feature 249: m=a or c
  misc_feature 276: r=a or g
  misc_feature 289: w=a or t
  misc_feature 340: w=a or t
  misc_feature 350: y=c or t
caaagacaatattgtatttttactgtggcctttattttaatataaaggtacaggtgcaaaccaagaagcaggtagttggaacttgagaaaaattctgtatttcctgtgtactyaatctwtaagtcacakgagtttccccccaaccccaaccatttagttcttgtgccttttttttcttgcctttctgcataaactagghcctctagtacaatagtaaataaaagtggtgacagtcttgttctcagakgmaagcttcaccattttaccattaagtartatatgtgcaatwgtgattgtttttaatagatattctatatgcttctcaaactgtagtgaaggwccagtttttyttgtggtggtgtttttgtttttgga

SEQ ID NO: 30407 - DNA, 412 bp, Homo sapiens
  misc_feature 301: h=a or c or t
  misc_feature 347: r=a or g
catagggatttgttttacagattatttcatcatgatggtattaagcctagtacccattagttatttttcctgatcctctccctcctctcaccctcgaccctccaataggcccccagtgtgtgctgttctcctgtatgtgtccatgtgttctcatcatttagttcccacttagaagtgaggacatgtggtgtttggttttctgttcctctgttaatttgctaaagacaatagcctccagctccatccatgttcctgcaaaggacatgatctcattctttttatggctgcatagtattccgchggtgtatatgtaccacattttctttatccaatttattattgatggrcacttacgtttattccatgtctttgctattgtgaatagtgctgtaataaatatatgagtgtatgt

SEQ ID NO: 30408 - DNA, 232 bp, Homo sapiens
  misc_feature 101: s=g or c
  misc_feature 156: s=g or c
  misc_feature 180: k=g or t
  misc_feature 183: r=a or g
  misc_feature 184: r=a or g
  misc_feature 194: y=c or t
  misc_feature 206: y=c or t
  misc_feature 211: w=a or t
  misc_feature 216: y=c or t
  misc_feature 230: k=g or t
caagtctgtcctccctaggctggcagctctgtcagcacccaggttgttagaatagttgttaaaacaggtcattctgttgccaagtaattacggggccttgsactcagtaaccttccccacgaagcaggccgtagtgtgcttactgctctcccttgsctttccatcccctactttgatgtkggrrttttctttcyttttacttttcytttawtttcyttttttccgccagkct

SEQ ID NO: 30409 - DNA, 205 bp, Homo sapiens
tacggtgtgcgaggcaacagggagaggtacgggaatagttctacttccttgttttttattcttgtgttttagacacagggtctgctgtgttgcccaggctggagtgccgtggcacgatcacggctcactgtaatctcaaactcctgtgctcaaataatccacctcagcctcccgagtagttgggactgcaggcacacgccaccta

SEQ ID NO: 30410 - DNA, 375 bp, Homo sapiens
  misc_feature 97: r=a or g
  misc_feature 102: b=c or g or t
  misc_feature 107: k=g or t
  misc_feature 319: n=a, g, c or t
  misc_feature 320: b=c or g or t
  misc_feature 344: d=a or g or t
ctcttcaccagtcttctgtattacttttcaattcctgattctttgtatgtgacttgtttttctcctcctttgcctttctctttggaggcctgtaggrttttbctttktgtccctggtgttctataatttcacagtgatgttgtggtgtggaaatctttctcattttttgagctgtgtctttgcttatcttttttccatttgggtaacaatctagatgttttgttgggagatcaaacaaatatcagtatctgcatgttttatctcttgggccaattggttttcttagagaagaacctcataatctgctcagggagttaanbgtaagaccagcatcattgtgggadcccagtggtggaagcaggaatgatgtcctca

SEQ ID NO: 30411 - DNA, 232 bp, Homo sapiens
  misc_feature 103: k=g or t
actgccctaccgtaagagacagtgagaagaagtcttaatagagcctgtttccactgctgtgcagtgtttgggcccatctcaataaaggcctagagtgattgtkgaatcagtgataaaatgtcccatgactaagcgcttatttaaagacatatttctcagaggaactgtaaggggatttcagctatgtgagttccttaaaaacagccactatccttaaaagttgaagatacca

SEQ ID NO: 30412 - DNA, 293 bp, Homo sapiens
cggggttttgccatgttgaccaggctggtcttgaattcctgacctaagtgatccacctgcctcagtctcccgaagtgctgggattacaggcgtgagacaccgtgcctggccagatggacttttttggagcatttagttccaagcaccttccctgcattttctcagttaatcctcccagtgactctttgaagcagggactatgacaatcgtcatttcacagatggagcaactgaggcacagagaggaagtcaatggccacggtcgcccagctgaggaaggatggagccggctgc

SEQ ID NO: 30413 - DNA, 254 bp, Homo sapiens
tatatatttctcaagtgaatgcaaacggatttatcttggttacatgttaaaaattgtgcaggtcaggatgggcgcagtggctcacccctgtaatctcagcactttgggaggccaaggcaggtggatcacctgaggtcaggagttcaagaccagcctgactaacatggtgaaacctgtccgtctcaaaaaataaaaaaaaaagtgcaggtcaggcatggtggctcttgcctgtaattttaggactttgggagact

SEQ ID NO: 30414 - DNA, 116 bp, Homo sapiens
  misc_feature 108: r=a or g
atcaaagcactgattgaaacaagaaaggtctcattctttacctttggagagacaatatcacgtttttgttttcgaattagacttctttaaaacacacacacacacacrcacacaca

SEQ ID NO: 30415 - DNA, 214 bp, Homo sapiens
taacagagcctaagggatttatgagatagcatcaaacagataaatagacacattacgggggttctaagaagtaaaaactgagaaaatggcaaaaaagattatttgaaaaaataatggccatacagttttctaaatcttttaaaaaaaaggtgtggatatacaaatccaaggtgcatgatgagcttcaagtaggatataccccgagagacccgac

SEQ ID NO: 30416 - DNA, 88 bp, Homo sapiens
  misc_feature 36: k=g or t
  misc_feature 46: w=a or t
  misc_feature 59: k=g or t
  misc_feature 73: w=a or t
ccaaagtgctataaggttgtatttttaatcatattktttaaaatgwcatactgacttgktttcaaagtttaawagtactaaagcctaa

SEQ ID NO: 30417 - DNA, 347 bp, Homo sapiens
  misc_feature 344: n=a, g, c or t
  misc_feature 345: s=g or c
  misc_feature 346: y=c or t
ccctcctcctcccgccctgcctccccgctggatatcagtttgtggatatctacagttaatagagtgaccaaatagtaggaatactgtctctctattctgaataaaatactttgaatcagatttagaaataatgaataaaatacaaatcagccattgaaattgctctaattttgagagcttatgatttattcatctttgttttccaagttcaagttatatgtagacattttaattattcggcagtagtattgaacatgagtccagttaagcatctggatccaactgccaattttctagacacacaaaacaaaaacatgttgaattacaccatgtatattcagttnsyt

SEQ ID NO: 30418 - DNA, 143 bp, Homo sapiens
cagaaatagaaagctgtccacaggcattgcactgccccctccagccccactgcaccaaactgctggcttctgttgttatttttccccttctcttctttgggtttcagatgaaactgagtcccacacaataatgcatgggtgct

SEQ ID NO: 30419 - DNA, 369 bp, Homo sapiens
  misc_feature 101: w=a or t
taaaaaacattttaaacaatgaaaaccacacttgtgcacatagtttaccttgcttatttccttaaagtaaacaatcttacaatacaatttggacttaaacwtggaacttacagttattttttgcagtttcctagtgaatgattattttttagacagacacttaagagcctactaagtatcaagtgttttacaggtttcatttaatctttactattccggggaagttttcatttccttgttttacagatgagtacactgaaactcaaggaattagatatgatatccaaggtcatctagatttccaggctctgtctgctggatcacatttgcttttgtacttttaactatgactgggatatataattttat

SEQ ID NO: 30420 - DNA, 332 bp, Homo sapiens
  misc_feature 312: r=a or g
ggcttccgaccggaagtgagaagaggaggaagttggctggttgcaccgatctgggggcttcccgggctcgggtaaccggagtgctggtatctaatcgtcgctcaaaggctcctaggtgcgcgggtggatataattcccggcttctcgagaagacactacagcctcaaggaggtatatcccgtgccttacctgactgggggctctgagtccagttgtgttgtcttcaacttagacaccatggaggcacctccagtcaccatgatgcctgtcactgggggcaccattaacatgatggagtacctgttgcagggragtgttttagatcacagttt

SEQ ID NO: 30421 - DNA, 53 bp, Homo sapiens
  misc_feature 19: w=a or t
  misc_feature 38: k=g or t
ggggcggtgtgacttaggwcggggcgatggcggctgakaggagctgcgcgtgc

SEQ ID NO: 30422 - DNA, 164 bp, Homo sapiens
ttttttgagatgtagtcttgctctgtcgcccaggctggagtgcagtggcgcgatcttggctcactgcaagctctgcctcctgggttcatgccattctcctgcctcagcctcctgagtggctgggactacaggcacccaccaccacgcctggctaattttttttt

SEQ ID NO: 30423 - DNA, 331 bp, Homo sapiens
  misc_feature 300: w=a or t
  misc_feature 305: n=a, g, c or t
caactgcttttctgtaattccattataaaaggtaaatatgtgtttctctgattagtagaatgaaagcagtgtatatgtagataatgggattattacagtttgagtataattttgcccagtaacattttttgctctaaatttaccataatcagtagagctcagcctttttagtaagcaggctgattcacaatttattgcttgatatgttcttcctctgtatgtaaaacactcttctcttttttgatagccattttctttatgctggtttttctgatgaatctatatgttatgtcatttaawaaganaaattattgccacattttgctgtaca

SEQ ID NO: 30424 - DNA, 178 bp, Homo sapiens
ttagccaggatggtctcgatcttctgacctcgtgatccgcccgcctcggcctctcaaagtgctgggattacaggcatgagctactgtacccagcctgtgttatccattttttctaataataccactattaccttagcagttactcatatttgaaaccatagacctttttagacctcca

SEQ ID NO: 30425 - DNA, 78 bp, Homo sapiens
cacaaatattataatatggaatacttagttttatctgaacatcccatttaattggaaatacgtaagttgatctaataa

SEQ ID NO: 30426 - DNA, 149 bp, Homo sapiens
ctcctgggaagtgaagtccggagaccaggggtggccggctcccagcgcgccaagctgctaaccccctaactcccgttcctcctcggcgtttcttctccaagtccgaagtcagggtccaggactgctgcgatgcatcagccccgcctctc

SEQ ID NO: 30427 - DNA, 79 bp, Homo sapiens
  misc_feature 3: y=c or t
  misc_feature 21: d=a or g or t
  misc_feature 27: k=g or t
  misc_feature 54: k=g or t
tcycagtttcgaatagtgccdactggkttaaaactaaaaataatacagcttttkggacatttaaccaagatactaagaa

SEQ ID NO: 30428 - DNA, 313 bp, Homo sapiens
  misc_feature 25: k=g or t
  misc_feature 87: s=g or c
  misc_feature 126: r=a or g
  misc_feature 172: r=a or g
  misc_feature 176: r=a or g
  misc_feature 271: r=a or g
ccacttaattatacataattttgtkctcaatcccctatatttctaacgattttaagaatggtgataaagagagaatgaagttgagtsttcagctctctgccctaagttctgggagaggtaggtaargaccatgttgtagcaggtaaagtcatctttccacttggaatttgarttgrcacaattaaacccacacatatgtgcatacatgtgtgtaaaatatatctaaaatctctgtatatttaactctctatatctactttatataccaggrgttcccaagggttattgatttctagttccataacacccaagc

SEQ ID NO: 30429 - DNA, 75 bp, Homo sapiens
  misc_feature 46: b=c or g or t
tgatttacccacctttttctgccagtcattactcagtaaatatttbttgagtgtttgaaaaacatgaatgtcagt

SEQ ID NO: 30430 - DNA, 62 bp, Homo sapiens
  misc_feature 13: k=g or t
cttttactttaakttctgggatacatgtgcagaatgttcaggtttgttaaataggtatatgt

SEQ ID NO: 30431 - DNA, 147 bp, Homo sapiens
  misc_feature 27: d=a or g or t
  misc_feature 101: y=c or t
tgccaaactgttttgagggtgaaaggdcacatccattcatctttccccttgttattatttcattttgtaatgacatatttatcaaaattgcccaagttttytggtgataggattaatatagctattccagcttgtgaaaagggcttt

SEQ ID NO: 30432 - DNA, 158 bp, Homo sapiens
  misc_feature 141: k=g or t
tactgggtgaagtggtttgaggtttggttgctaaatgatagatgcccttcaatgctaaattgaaatttaaaaataaaattttggttgaaggagtcttactaacttaaaaaatgtttttgaaactgttttcattttataggkaactagttccccgtacc

SEQ ID NO: 30433 - DNA, 388 bp, Homo sapiens
  misc_feature 11: w=a or t
  misc_feature 96: n=a, g, c or t
  misc_feature 97: y=c or t
  misc_feature 200: k=g or t
  misc_feature 215: n=a, g, c or t
  misc_feature 216: n=a, g, c or t
  misc_feature 218: r=a or g
  misc_feature 226: k=g or t
  misc_feature 256: m=a or c
  misc_feature 310: r=a or g
  misc_feature 311: r=a or g
  misc_feature 326: d=a or g or t
  misc_feature 336: r=a or g
  misc_feature 353: r=a or g
tttgttgttgwtgggtgctggtacctccagaattttgtgaccactattgtgggtaaaatgtctctgcatcacttgttaatgctactggtctaactnyattcagtatgcttcattcaccgaactttgtgctcaaaatgcgtatataccattttatgttgtattcctccatttcacttgcaaaacagaagtaaataagagtkcgggacccagggtcnnartggtagcktcatccaatatatcattcaaatgcatctgmtttctaaaacatattacattttatgctgatcttcagttcataattcttccaggrraactcagtcttccadctgcaataaratactgggtagaatcaratgggaaaggggttgggtggggcaatacccatgta

SEQ ID NO: 30434 - DNA, 207 bp, Homo sapiens
ccattagtatccatcttcatagaagataccaatctggggctagagtctcaatgttaacactttctctcagggaaaagttaacatggtaacacaaacatataaataactttgaaccaacatcctactgttcttccatcaggaggcccttaggagaccaacggtttggtaaacacttagaactttgccaaaatacattaggacacggga

SEQ ID NO: 30435 - DNA, 167 bp, Homo sapiens
cagttcttacgtgattttaaccattcaacatgctgttgggttttaattctctaattattattattattgttattattttttaggaccagttgtagtgaattgctactggaaagctatcccaggtgatacagagctctttgtaaaccgcagtcacacattagggtccg

SEQ ID NO: 30436 - DNA, 340 bp, Homo sapiens
ttttatgttctttgtagctattgtaaatgggattgctttcttgatttctttttcagatttttttgctcctggcatattttaaatgctactgatttttgtatgttgaattttgtattcctgctactttactgattttgttgatcagttctaagagtttttttggtgaagtctttctttagagttttctaagtataaaagcatgtcatctatgaacaaggctaatttgacttcttttccaatttgaatgtcctttcttcctcttatctaattgctctagccaggacttctaggatgatactgaatgaaaatggtaaaagtggccatccttgtttttcctcca

SEQ ID NO: 30437 - DNA, 221 bp, Homo sapiens
  misc_feature 107: s=g or c
taagggatgtaggggctgtattgtagctccagtagacatccttaaattcttggagcatgtgtatggaataagatggccctgctgccaagtacgtacagcctggtgasggaccggccacttctactggacattcagtccctgggcgaccgaatgacactatcagaataagtcgaggaagtacttttcaggcccatggcctcttgtgtagtaaacaaggacaa

SEQ ID NO: 30438 - DNA, 250 bp, Homo sapiens
ccagttactgtagcattaggtttttccatagttatggtctttgttttgttttgtagagacagggtctccctatgttgcccaggctggtttagaactcctgggctccagtgatcctcccacttcagcctcccaaagtgctaggattacaggcataagccaccacgcctacccacagttacagtcttaaacacgatcttcaagtagattgatgataaaattttcagttagttatagtctcaacaccggcctc

SEQ ID NO: 30439 - DNA, 450 bp, Homo sapiens
  misc_feature 218: w=a or t
cactgtgaaatgcaattgtgccttgaataagaaggtacctagaagccaaattaaagtaataatgacttcttattggctttgatttttcattgcagtatatgggaattgtacagcaggaaatgcttatcattaatttctgatgttttttaaagcacaactcgaaacatttcgatcatacatacatagcagtagagatctgtgcccttcaggtacattgwatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttctgtccgaagccttgtcagaatctgtcagactcttgtttaggtttagtgtgatcatggcgtcagagaagcaaagctttcaaata

SEQ ID NO: 30440 - DNA, 59 bp, Homo sapiens
  misc_feature 13: m=a or c
caagcaatggggmaaggattccctatttaataaatggtgctgggaaaactggctagcca

SEQ ID NO: 30441 - DNA, 386 bp, Homo sapiens
  misc_feature 173: d=a or g or t
caagtcaaacataagaaatttataggtcttttggcctatatctctttgttcctggtgctagtaaaacactgatacagctggaaaaagaggacaagttgacccacagcacttacctatatatgttcatttggggcactattactctgttccctgtatagttcttgttccctagdagaatctgttgagatcaggaaccatagcatttatttttaaatttaccataatgctaggcatctatctgattattcagtagatatttattaaatgtatgtacttactaattgaattaactcccaacttccaaaaatggatttgtggtcagacttgttgaattgattgaataaagagtagcttaatctgttcacagtatgcagcttgccccagtt

SEQ ID NO: 30442 - DNA, 155 bp, Homo sapiens
  misc_feature 75: r=a or g
  misc_feature 80: s=g or c
  misc_feature 137: r=a or g
atacgatgtactttttttaatgccgttgaaacagagttaatttcctttagcacacaagtcttagagacaaaagaraaaasaggtctgcaacatgaaagtcacaggcatcacaatcctcttttggcccctctccatgrtattattatcagacaaaa

SEQ ID NO: 30443 - DNA, 283 bp, Homo sapiens
ttaattacccttgtgttccttgtgtacccttgcgttccttattgcttagtttctaaaacaaccttttatcttacatttcactgttcttatattgttcttctatgtcttatatcattttcttttcttttttttttatactttaagttctgggatacatgtgcagaacgtgcaggtttgttacctaggtatacatgtggcatggtggtttgctgcacccatcaacctgtcatctacattaggtatttctcctaatgctatccctccccttgccccccacccccaa

SEQ ID NO: 30444 - DNA, 199 bp, Homo sapiens
gatacattaatattatttaaggtgcagttcatactcgaaattttattgttccccaaaatgttgtttatgtaagttgatttcccctgactgaaaccaatgaaaccaatcagggatcatgcttttctgttggctgtcttgtctctttaataaaaaacagcaccactggcttttttgttgttgttgttaatggcattaacat

SEQ ID NO: 30445 - DNA, 64 bp, Homo sapiens
ctttttctggtgttagatcgagctaccctctaaaagcagtttagagtggtaaaaaaaaaaaaaa

SEQ ID NO: 30446 - DNA, 399 bp, Homo sapiens
  misc_feature 305: v=a or c or g
  misc_feature 307: r=a or g
ttggcaccataattggctggcaccgtgatcttgatgacctaatctctctatctcaatttccttctctggataatgaggttaaatacccatcttataaatcccccacagaaattttgttgaggactaatgaaggaatattaataagtttataaaacatgtattgagtgtccgctacatgccagtcactgtgttgcattccagagtgacaaagataagacatgattcctaccttcaatgagatcaaatcttatagttaaactgcctggaaacatccatagatcattctcaacttctctacccataavarcttaggaatttttctagactcagacttcatctctccctggaaccttccatagacacaatcttggccccagcatgaattgacatgcctctcta

SEQ ID NO: 30447 - DNA, 311 bp, Homo sapiens
catcatatgctgtatggagagtgggcagacttctgtggagggcccgatagtaaccatttgaagctttctggacctgtggtcttagtcccagcgattctgcagagcggccatcgggcagcatgtcaaccatttgcatggctgggctccagggaaactactgacaacgacaggtggtgggccatagtttcctgacccctgtgctatgccagaatttctttttcctcttccctatgagtggactaaatatgttaattccttttcacctttcaaaacggacagccccttgaacattaaaaactttgcagacccgt

SEQ ID NO: 30448 - DNA, 63 bp, Homo sapiens
gggagagcgagcagcgagctggctggatcgccgccgccgcctccgcctcccctccgcgaacag

SEQ ID NO: 30449 - DNA, 378 bp, Homo sapiens
  misc_feature 115: w=a or t
  misc_feature 118: w=a or t
caaaccactgctcaatgaaataaaagaggatacagacaaatggaggaacaaacattccatgctcatggataggaagaatcagtgttgtgaaaatggccatactgcccagggtaawttwatggatttaatgccaccctcatcgagctatgaatgactttcttcacagagttggagagggctgctttgcagttcatatggaaccagaggggagcccgcattgccaagagaattttaagccaaaagagcaaagctggaggcatcacgctgcctgacttcaaactatactacaaggctacagtaacaaaaacaccatggtactggtaccaaaacagagatacagaccaatggacagaacagagccctcagaaataataccac

SEQ ID NO: 30450 - DNA, 304 bp, Homo sapiens
  misc_feature 119: m=a or c
  misc_feature 279: h=a or c or t
aagctgttgctacttaaattaaaactactttgggccagacgcagtggctcacgcctgtaattccagcactttgggattccaaggcaggcagatcacttgaggtcaggagcttgagaacmaggctggccaacatggtgaaaccccacctctactaaaaatacacctgtagtcccagctactcaggacgctgaggcaggagaattgcttgaacccgagaggcagaggttgcagtgagccaagatctcgccactgcactccagcctgagcaccaagagcgahactctgtcgcaaaaaacaaaaacaa

SEQ ID NO: 30451 - DNA, 140 bp, Homo sapiens
  misc_feature 117: w=a or t
attatggctaatcccccaaaacaaaacttccctagtttttcaatatcgtgtaattcaactagttttgtttctttgcatatttcccattgcattttattttaataaggatatgccatwaaaagtcatattgaaacaacctc

SEQ ID NO: 30452 - DNA, 398 bp, Homo sapiens
  misc_feature 90: k=g or t
  misc_feature 107: r=a or g
  misc_feature 109: y=c or t
  misc_feature 116: k=g or t
  misc_feature 119: k=g or t
  misc_feature 122: y=c or t
  misc_feature 125: m=a or c
  misc_feature 134: s=g or c
  misc_feature 361: s=g or c
agaaggccgaggaaaggggaaggaaggatctggctttgctgcccacgctggagtgtggtggtgtgatcacagctcactgcaacctctgckctgcgtcccaggttcgrcyggatcckcckggyttmagcctcctsgagtagctgggactacaggtggggaaaccaaggcatgggggaggtgaactaacttgccacacagctgataaatactagagctggtgaagaaggaggccgtcagggaaggcttctggggaaggtgctgcacctgtgccaggcctggagcaggtgatatcaatatggaagaaaggggaaggcatcacgcttagctggggcatggtttgtactggctacatgtctctttsgagtcctgttgccaacctgcccacactgggctcagca

SEQ ID NO: 30453 - DNA, 294 bp, Homo sapiens
  misc_feature 115: s=g or c
  misc_feature 117: y=c or t
aatgagacagcgctgagcgccggaagtggggccgaaggaaaacacggagagggagcccggccgggacaggaagaggctggggaccgcggcgaaggtggtgagtgctcttgggcgscyttctcccaacgtccctgccagactcgcctccgggctgattctccagttggtttcctggactccagagtagctgtccggcctggccccggaggtgcaaagtaagaaaattgaagtcaaagaccatgggagatacagcaaaaccttatttcgtgaagctcactaaagaccgggggacga

SEQ ID NO: 30454 - DNA, 418 bp, Homo sapiens
  misc_feature 135: n=a, g, c or t
caaagaacacaaagtggattggttttttcaaagttactttccttgtgaaggttaaagtagggggacttccttatcaggcaggctaaaactggctgttcggagatgtggctattatctccctctcgctcctgattncttggaaggtcagataacaatgtagttttggcttggtggcctggaactttaccgtgagtaactccattttggtttggtctactggggcctagtgcaggaacttacttcaaaccaatgacctcctataaattttatttaacagagatcataagtttatgagccggtaacttactatagcattcatttctaatttatagttaaaacacatcctgttatttatttttttcacataattgttgaaatccaacacagctacgaatgagtcttaatgttttttaacatt

SEQ ID NO: 30455 - DNA, 58 bp, Homo sapiens
ccacatcctacctcccacatcttggccccaattactaacatataatcttttttttttt

SEQ ID NO: 30456 - DNA, 361 bp, Homo sapiens
  misc_feature 16: m=a or c
gtgattgcatttaggmctgtgatcctttttggattactttgtgtgtgttgtgtaaaggtctaagttcattttgctttgtttgtttgcttgtggtatccagttgaccctgtaccatatgttgaaaagattgtgttttcccttattgaattatctcagcacctttaaaaaatgaccataaatgtaagggtttatttctggactcttaggtctgttccattgatctgtcccatttttaatttcgtggattgtactttggtgttgtatctaaaaagtcatcaccaaatccatgcttacctagattttctcttgtattactgcttaggactttcatagttttgcattttacatttaggtctgcgat

SEQ ID NO: 30457 - DNA, 351 bp, Homo sapiens
  misc_feature 165: k=g or t
tggaggagtctcagtctttatagatcatagttaggatcatctgatgtgctctcaagggtgtcagggagtacatcatgctgacagggcttccaactgaggtcctgcattgcctgtctgcttgacccctgtacttttcaaataatgctgagtccaggtgccatgatkaaaagggatctttaacacaaagattatgtttttgttcagctttcaatggccatgtacttttggagcgcccactatgtgcagtatcctctgctcagcattgtggagacagcaagaaaggcaggaggggcttctgccaccaggacctttcctattagtaaggagataagccacgcacacacaaaatta

SEQ ID NO: 30458 - DNA, 261 bp, Homo sapiens
  misc_feature 148: k=g or t
tgttattgtttcttttctcttgctgcctttaggattccttctttatccttgagctttgggagtttgattattgaatgttttgaggtagtcttatttgggttaaatctgcttagtgttctataactttcttgtacttaaatattggtakctttctctggtttgggaagttctgtattattattccgttgaacaaactctctacccctaactctccctctacctcccctttaaggctaatgactctttgcccttttgaggctt

SEQ ID NO: 30459 - DNA, 389 bp, Homo sapiens
  misc_feature 38: w=a or t
  misc_feature 164: s=g or c
  misc_feature 165: r=a or g
  misc_feature 177: r=a or g
  misc_feature 181: r=a or g
  misc_feature 196: k=g or t
  misc_feature 197: y=c or t
  misc_feature 272: r=a or g
  misc_feature 283: m=a or c
  misc_feature 284: m=a or c
  misc_feature 304: r=a or g
  misc_feature 346: w=a or t
  misc_feature 372: m=a or c
tttacatcctctcccccaatcttcacacacagagccawagagcagttatattcttgggataccatgatacctctgggaaaggaattatattcccaaggagaggtccctttggataagaacaataccatgggacttgagtctgaatgccaacttactattcacasrtccttcttaaaracgracacactgtttcttkytcctgacctagagcattctaaagttctgttcaaataaataaagggcaaaataaagtagatttaaccaagtgccargtggaattcammaaacacattcttccagatarattctacctttatggtatggatttgaaagtactttgcaggawaacagtcagtactctttaaaaagggmctgcagggctgggtgta

SEQ ID NO: 30460 - DNA, 262 bp, Homo sapiens
  misc_feature 182: r=a or g
  misc_feature 183: m=a or c
ttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttrmttgctgctgggaagcctggcagagccaattaccaccctctgctgcttagtgcttgggtacctcttgcaataaccagcga

SEQ ID NO: 30461 - DNA, 230 bp, Homo sapiens
tatgatggcttcaagttgtaaaaatgaaagtgactttaaaagaaaataggggatggtccaggatctccactgataagactgtttttaagtaacttaaggacctttgggtctacaagtatatgtgaaaaaaatgagacttactgggtgaggaaatccattgtttaaagatggtcgtgtgtgtgtgtgtgtgtgtgtgtgtgttgtgttgtgttttgttttttaagggatgg

SEQ ID NO: 30462 - DNA, 184 bp, Homo sapiens
aatgttggagagtttgtggcaatagcatccagaagattaaggaagtaagaatgagtagtctgtaagaatgtgctcttcatttaagaagtttggtcttcgaaagaggcagagagatggggatactaggcttgaaaatgaggctgacaggtggaagaagcctctttattattataggagagactta

SEQ ID NO: 30463 - DNA, 186 bp, Homo sapiens
ttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtag

SEQ ID NO: 30464 - DNA, 233 bp, Homo sapiens
aatttgtaaggaccagaagatttaagttggcaatgtaatctgtatattttgcaaagtttgttggcgctttcttaggttatgttgaaaaaaagtgcctttttgaaatcagttttctatgttgacttaattctaggtattgttttctcttttcttccctgtaatgtctccccaatccatgttttttcctagccttcaagatggtcagcaaggccagcagtccacagcccaggtcc

SEQ ID NO: 30465 - DNA, 166 bp, Homo sapiens
ttttctacaactgtcaaactagacaaatgacagtatccagttctcctcacccagacgcagccattgctgacagctgtcagtgttgaagatggccagcatctcatgcccttggtttcactcgttccctgggtggccctcgtccccctccccacgtcccgcgccccgt

SEQ ID NO: 30466 - DNA, 322 bp, Homo sapiens
tttaaagccatactgaggagcatggtcaagactgatctgacggaccttcatttttcgtgtagttttctccattcctggctgctgttgcatgttatgcataatttttattttgttcctagaaatgttaatggactttaaaagcttaatggcatttagttaggagatccttgtggtatattctgtgatctgttgttttctttgtatttccaattcagtgtcacaacctgggaaaaataaatctctgctcacagattgattcattgtcgaggaatgccttattctgatgttacgcggtttctttcctggctcatgcatgccccac

SEQ ID NO: 30467 - DNA, 455 bp, Homo sapiens
  misc_feature 418: m=a or c
tactctcctatttattttaaagattttaccttaaatatgtttccaaagggagctttcttgatcctcagcaatctaagtcagatccctgctctacttcataacactgttaacttttacttcatagtacatattgcaatatcttatgcaaaatttattagtgtgattacttgtttaaagtttatttttattctcagaaaactttaagttatttaatgggacagaccctgttttatttatcagcttatactgtcttagacacttcagcagtttgattaaggggaagtgaaccttatttgagtcagctccatggtactgttccaggtgttttacctgtatttacatatgtgcctatgtttgctaatttaatgtttagataaacctataaggcaaatattattccttctcttttacaggtgamcatgctgaagctctaggagctaaagtaatttattgaa

SEQ ID NO: 30468 - DNA, 434 bp, Homo sapiens
gatttgttaattgcattgttcaagtattgcatcttaccgttttttttctggttgttatttcacctaccatcatggtggatttgtctgttttgccattcagtgctatcacatttttatattctgagtcttagttattgaatgctcacagatttagaattgtcatatcttttcagcaaattgaattttttatcattatgaaatctccctttttatctgcaataatctgtttcacattaaattctactatgtctgataaagttcagctctcacaaatttcagccctacaaacacagcagcctcttctagtgcaaagtgacttgctctccacatatacgtataggaattgcagtttgaggtcccagacaaacctgacctgcaaatgaatcccattatctaattaaatgactctcaatgctagttacacattagaatca

SEQ ID NO: 30469 - DNA, 378 bp, Homo sapiens
  misc_feature 196: n=a, g, c or t
  misc_feature 236: n=a, g, c or t
  misc_feature 287: m=a or c
  misc_feature 333: k=g or t
tctactcttccaaggaacatgacttcaatactttcagtgattcaggtactgaaaagccttacctaaaaggctgttctttgtttccccctttcatactattcttttccatgacccaggatgcagcaaatgaaacagatttcttctcttaaggggatattaagactgttacttcctagtaagccaagtaataccatanttttattaacatctaacttttgtagatgggtgctaaaatngcatacattttaaccactaaaatagaaaaacaagtggtgctattatgtctmtggcaccagaaatgagctagcacttgggtttgttgttgctgttgtktattaagagtattgtgttaattaaatcattacatacttgaagtta

SEQ ID NO: 30470 - DNA, 388 bp, Homo sapiens
  misc_feature 36: h=a or c or t
tttatttatttttttgtcctgatctgtgaaatagghgcttggttttttacgttctctgttcttttggctgcaagagatcctgccttgtcttgtgctcatcatagccattaacattctttcacgtaacgaggaaaagtgagattattttactatggaaggaacaggttgtaagaatcattacttgttatctttttacctggcaaattatactgattgctgtgtagcctcctgatcgttcttcctagtgttccaaggaagacaggtattctcaactgtgtctgaagtagagtagataaacttcaatcaacatcatttagtgaccatagacactaagatatatgaccaacagtaagaaaaggacacagtttgtgttacagatccataatcc

SEQ ID NO: 30471 - DNA, 392 bp, Homo sapiens
  misc_feature 294: k=g or t
ttgaataatgtgtcgctttcctcatagtctgtcaactttagttcattgtagccacaaagaagatgattatgccaatgaggattaaactaaaccagacaagaggtggcctactgtgtatactaggaattagatttgtgagaactaaacacaacactgaatttgtgaaaatgtgtgcagtttagagtaattagagaaaatgataagtctcactcagaccacatggaaatgggggtagagtgtgtgtgtgttgtggatgtgtgtcttcatctatcctgctagtggaaggttactgtktgaaaaatgtagttccaacacagccactagtttgtgctactttagacaagtatttaaatctttgcaatagagatattataatagagcattccttgctt

SEQ ID NO: 30472 - DNA, 337 bp, Homo sapiens
  misc_feature 29: m=a or c
  misc_feature 36: m=a or c
  misc_feature 50: m=a or c
  misc_feature 81: m=a or c
  misc_feature 85: s=g or c
  misc_feature 102: m=a or c
  misc_feature 113: r=a or g
  misc_feature 115: m=a or c
  misc_feature 129: m=a or c
  misc_feature 131: m=a or c
  misc_feature 182: m=a or c
  misc_feature 202: m=a or c
  misc_feature 306: w=a or t
  misc_feature 307: m=a or c
caaatgatggatggcctggagagctgtgmataaggmagatcaagacatamatagttggggccaggtgcagtggatcatgcmtgtsatctcagcactttgggmggccaaggcargmgaattgcttgagamamggaatttgagaccggcctggacaacgtggcgaaaccttgtctctacaaaamataaaaaaattacccaggcmtggtggtgtgcacctgtggtccccagctacttgggaggctgaagtgggaagatcccttgagccctggaggttgaggctgcagtgagccgtgatcgcaccactgwmctccagccaagacaacagggcgacacctgt

SEQ ID NO: 30473 - DNA, 154 bp, Homo sapiens
aaactggcagaaacagtagacccaaaggggcaccaaataattgcattgtgaggtagactttaagtatgtttactgtattcaaggagataaaagatggaaaatttccatatagaattggaaactataaaaaagtcactgcagatttgttaaaaaa

SEQ ID NO: 30474 - DNA, 192 bp, Homo sapiens
  misc_feature 110: s=g or c
aaggacctgaaagataaaatagtggagaaagcaaaagagagcctggacacagcagcagttgtccaggtgggcataagcaggaatcagagccacagcagccccagcgtcascccagcagaagccacagtccttctggaagccagacccgaagccacagtagcagtgccagctcagcagaaagtcaggaaccgc

SEQ ID NO: 30475 - DNA, 128 bp, Homo sapiens
aaaaatagatttagggctgggcgtggtggctcacgcctgtaatcccagcactttgggaggccgaggcgggtggatcacgaggtcaagacttcgagaccagcctggccaacatggtgaaaccctgttga

SEQ ID NO: 30476 - DNA, 214 bp, Homo sapiens
tgtaatacacagtttcccaggggcccatccatgaacaaaactcttttgtgatgcctgggatgcaataagacacggaatttgaaatggttcttcccagaagacttattgctgagtaggtcacaaaccattgacgaggagtggaatacagtcaagagtgaatgagtagacaatcaggaaaaatcaaagaagaaaatagtgtcttcagctccaaccc

SEQ ID NO: 30477 - DNA, 164 bp, Homo sapiens
tctaattgctcccattttcccagcaaaataggaaacggggtcacataggacaatctctagtgcttgtaaatctaaggaaataaaaagacaaagatggtgataacataataatttgtgctgttgctcttcctaaaatgtgctctaatttttcagaatccgacctc

SEQ ID NO: 30478 - DNA, 408 bp, Homo sapiens
actgaagttgaatcacggtctataatataaagttagtgggaaatataagtttgttatcttgagaagccacttaaatttggaggtaattactataaccatggctgaacactgcaaaatttggtaccaaaagtggggtgctaccttaacaacagctaccaccaaaaataattttaaaatatgtgatataggctttgaaaccaggtggcagaaagcaagaaaactgttactggagaatggaaaaatagcaacccacataaagtggtggtaaataaaactgtcacataaaaaattgaataacttggcaaaaagattataaaagctgaactttagttgtcattaagtagatttaataaagtaccattagattagctcattaaaggaaaaggaatcccccagtcatagccccca

SEQ ID NO: 30479 - DNA, 168 bp, Homo sapiens
ttgtacatcatagctcaataagtgtggaaaaaaataagagtaatcgacaggtcatgtctagccacatgtaaagtttatttaaaactctcttggccactgtttctgactcaacctaggaatggccagagcgattctggccccttgacttctccgaggctcctcccacca

SEQ ID NO: 30480 - DNA, 177 bp, Homo sapiens
  misc_feature 8: s=g or c
ctgcggasgaatgggaacagtctcacagagtcaagagttgcaggtcacttggattataaggacgtttctactttagaccaaaagaggcttttgtgtatgtttgagtgaaactttgcattgtgaggtcagctacgtagatgtgccggctgtgagggatggtaggagcaacggagatag

SEQ ID NO: 30481 - DNA, 262 bp, Homo sapiens
tcatgagtagcatttattttaaatcatccaagaacacctcaagggcaaggatccttaaccttgatcctgggccgtggtgattcacaaaggcttatcctttgtagatttaggctcatctttcagggagctcagtttgatatgcttttctctcctcgaactctgccattcaacattttttttcccatatctattctcactgagtgctaattttagttcaggttgcacctgtgtgtatgtgtgtgtgtaaaccctctgtagccct

SEQ ID NO: 30482 - DNA, 450 bp, Homo sapiens
  misc_feature 368: w=a or t
  misc_feature 369: y=c or t
  misc_feature 407: m=a or c
  misc_feature 427: w=a or t
gtaaaaaatttcacaggtcatttgtgtagaataatttgaacattgtgaggaccaatcttttttaaatcaaaagggatgttgctggtatcagaattgttattgcttcatttagacataaaacacttaagtgttttcttcactccgtgacctggagagttttccattttttaaaatacatgaacttggcaagggtgtgatttttctttatcaagagaacaaaatgccagaatgttaaaacagttaactcaaaatctagtcatctgtgtaggagctaaagcaggtctccagggagagagggtggtcgtctgtgcattccaggttactgcacttgtctgatgtgacgtagcaacacccaggttttcttaaawyaaagtcatcagctttgccaggttacatactttatttamaagtatagtgaggtcgaagwcattccagtgtttcattttaata

SEQ ID NO: 30483 - DNA, 394 bp, Homo sapiens
  misc_feature 232: r=a or g
  misc_feature 326: v=a or c or g
ttgttcttatcattattcagttattaccatagcatttgtttttaagaaatctttttagaacatgcatgtcttgattccagtatctgtgagctttcggtgatctactgtaatgagtttggaccaagatgtagttggcacagacatttaaggaaatatatttgaaataaaaatctcaaaagtacctgggcccagttacttactcagctttcagcctcttaaatgtccataatartaagtataatgttttattcatagtacctactttctatggtttagcggtttaaatgcaatcctatatgtaaagtgtttagcatactatatatttvatgtagtagttgctgttcttattgtaatcatcattttaataaacggcagtatagactgggtgaccaaa

SEQ ID NO: 30484 - DNA, 367 bp, Homo sapiens
  misc_feature 257: n=a, g, c or t
ctttcggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggnagttttctcccagcacccaaaaagagaaagaggaaactactttttctttctgggctccttgcagcacaatagatcaggataagcttccacatttcctctctggagtttct

SEQ ID NO: 30485 - DNA, 359 bp, Homo sapiens
  misc_feature 304: b=c or g or t
  misc_feature 305: h=a or c or t
ccaaatttggtgtcctagctctttcatgttgcacgtaatgcctttaaaagggtccgatctttgtcttctagaacctctgaacccacacagttctgccctcctgggaactcaaagatttggctctctctgagaagcagtagggataggtaaatgtacttgagggataatgcaggatttcatttcagaatcaagagaatacttcctacctcagccttcacttgacagtgaatctgcatgaaaccggctcttgcccacagctgcaagtgcttctgaatcggaactcttcacttccttgcctctcctbhgcagaggcagacacagcccctgccacccacgaggaggatgctgtcagcagggaa

SEQ ID NO: 30486 - DNA, 233 bp, Homo sapiens
  misc_feature 232: h=a or c or t
tagaaaactgccagagcatacttgaaagttggtagatccttttgcctaaagatgtaaacaaaactcaagacagaaggaatcagggaatatgtgctattgtgtgcatcttgtttacatttgggatcagtgatggcaaaagaagtaatgagaccactgaaattgttttcattgttttaaataccaggtactcattttcttgatttgaaagtttaacatgacttctaaggacaahc

SEQ ID NO: 30487 - DNA, 343 bp, Homo sapiens
  misc_feature 64: y=c or t
  misc_feature 74: w=a or t
  misc_feature 75: n=a, g, c or t
  misc_feature 76: h=a or c or t
  misc_feature 100: r=a or g
  misc_feature 332: k=g or t
ggatcttcagattactaaaaagatttgagataatgctggaaaaattggattcacacaatttcaytcaatgtttwnhtgagagatgagacagttttgaaaragctactttattgtaatacattcatcaatattggaaatataactttatttaataaaaagagccccagactggacattggcaggtttgaaatgaattttttctcattagcttttgaccttggatgggatggtaagttttagaaatcagagaacatgtacatttatacattgttgtatctacactgccttgcacattgtgactgcttcataaatatctagaattaacttttatktcttattttac

SEQ ID NO: 30488 - DNA, 191 bp, Homo sapiens
taagtgtactggtactctaaaagaaacttgtttgtataatcctattatatccaaggtatgtagcccagtctctaaatgttatgtttgtggagaaactgtaatagaagatcaatggccataagaagcctgagaattagtgcctacagacccagttcctgatgaattcccggccctaaagaatcaccctgatg

SEQ ID NO: 30489 - DNA, 195 bp, Homo sapiens
ctttctctctctctttcttcttctgtctcttctcttttgtcagaccatgtgacacttcaccaacatataacacttcactcctagaccctttggggcatactaatgctccttacaaggaaggtgttcttcccacagctagagtacccttaccctttcataaaatgatcagcattaattccatgacatcccatccac

SEQ ID NO: 30490 - DNA, 398 bp, Homo sapiens
ttcttctctggttacctctatctacccccgagtcaacaagccctgcctgattacgcagcagcagtttctcctggagagtatatgcccttccctaccagagtggctgtgctctgtggaccaacggcatttgtgccgtggctggtgtttccaccattccagtgggttggctgcagagttatcctttgtgggtgggagagagcaccaggcctcaggaatctccctgctggtcccagcctccatctcctcctccccaaccctgaacctctcccgcaacctgcacctcccccgagaagccagccacagaggcagagagcatcatggctcttatcagcctgccatgcacgacagctttccctttactgtccagcaaggtttcccagcttctcttgcccctcagc

SEQ ID NO: 30491 - DNA, 103 bp, Homo sapiens
  misc_feature 99: r=a or g
  misc_feature 101: s=g or c
  misc_feature 103: r=a or g
ttcatgtctccagtctgtatttgtgatctagactagaatggaattttgtctgtctatatcagtctgtcatggtgtgtttgactgtctctcggagctttrcsgr

SEQ ID NO: 30492 - DNA, 311 bp, Homo sapiens
ctcatttctttctccttccttaatgattcatggccttaccgttttctgatggattttgacagcagctactgtgagagcagagataagaggatttaaaaagagatcacaagttagccaaaatctgactatacctagcaacttttctacagtttgatctttttatgtgaagagaaaaagaagtaatgattgagggattgttgtacttaattaaaaataacaagaaaaaaggactagatatgtgttagggatatcttgattgattgagattagataaaatgctaggtgattatacctgtgttgatgggggaaaa

SEQ ID NO: 30493 - DNA, 386 bp, Homo sapiens
  misc_feature 166: k=g or t
  misc_feature 276: s=g or c
ttgcctcccacaaactagtttccatgcttgtaaactagtgggaaaattgcatgctgtatttatctcacagggttgttttgagatcccaataatgttaaagaggcagtgctttagtgtacagagtgctggtcccctgacagggaaacctgaatgtgtcaatgatttkttcacacttccctccctctgcacatgcccttctccctcttttctgcttgttgaactcatgtcttcaagacttagctcagatatcagcgtccagattttattctaacagtsgaggaatttaggcaacgccgcgtggcgggggggtcgaggggggcacaccagacttgtgttctgaaatgacagctgacttgtaatgcagggaatggagtgtagccgagccg

SEQ ID NO: 30494 - DNA, 266 bp, Homo sapiens
cagaggatgtgcctatagttccagcttcttggaaggctgcggcaggaagatgctggggcccaggagtttgaggccagccagggcaacatggcaagacctttctctttaaaaaaattttttttggctgggtgcagtggctcatgcctgtagtcccagcactttgggaggccgaggcaggcggatcatgaggtcaggagatcgagaccatcctggctaacatggtgaaaccccgtctctgccaaaaatacagagggttggccaggcgt

SEQ ID NO: 30495 - DNA, 210 bp, Homo sapiens
  misc_feature 98: r=a or g
agcttggctgtgaccctttagcgctgggtcgcgtgtggcccaccctcggcctgaggcattgttgggtggttggaggtggttgtagtatttggaaaagraacttgtccctgaagggctcaggggacttggtttctcagctcctaatatggaaaattaaggcatttcttacgagatgcagattttaaagcaggcatatctactcgacggcca

SEQ ID NO: 30496 - DNA, 403 bp, Homo sapiens
  misc_feature 371: n=a, g, c or t
taaaagtctgatgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacgttcttcctccatcagtagccctttatttgatattcagaagtggaaagctttttcattctccagtagaacttttaaaaatngttacagatacctagctcttcacagatatcat

SEQ ID NO: 30497 - DNA, 102 bp, Homo sapiens
agggatgccttccaggtcatcttctctgactcttgttttctttggtttgttattttttcctccccaaaagcttgtccccacttgagaataaatatatcagaa

SEQ ID NO: 30498 - DNA, 280 bp, Homo sapiens
  misc_feature 258: m=a or c
  misc_feature 275: m=a or c
catttttggatttcatttcatatctctgcatttctgagcaagcagtggtctcagtggagattctaacatgtttaaaatgtattttggctaggcgttttggttcatggcctatattcccagcactttggcaggccaaagtgggcagatcactgcagctcatgagttcgagacaagccagggcaacatagtgagaccccatctcttaaaaaaaaaaatcagtcagatgtggtggcactgtattcccagctacttgggggmctgagatatgaggaacmcttga

SEQ ID NO: 30499 - DNA, 329 bp, Homo sapiens
  misc_feature 99: m=a or c
  misc_feature 110: r=a or g
  misc_feature 188: w=a or t
  misc_feature 294: s=g or c
ggcaggctgtctcccggagccgcgccgctgccctggcgggatgcactttcttctgctaaaatcactgccttctcccctaacgccccccaaccagcccamctccagaaagrcaatttaaatgtaagatgcttgggggagggggcctttgatcagtcctttgggaggaggaaggaggaggagtgagcatwggatgggaggaggattctggatttctgcaaagcggaatggagcccagaggaggaacaatgggtcccgggactcacaccccaccccctacccccagtcgaccagcgstgaggcatcgcgacttcagctgccttccacgagcc

SEQ ID NO: 30500 - DNA, 432 bp, Homo sapiens
  misc_feature 100: m=a or c
  misc_feature 111: m=a or c
  misc_feature 348: m=a or c
  misc_feature 381: k=g or t
  misc_feature 418: k=g or t
cattggagagggctttaactttacaaggctgggaggaagtgtttcttatttttattttttttgaaggcaatttaataagatttgagcatagatattaaamcttagcatggmcagagaaacttatttctttggggactggcatagtgaaagaacagaatcagtatgaccagagagagcagaaaaacttacaacagctaatactacttgctacattgctgtagctttaagattgagggaggaggactagagccagcctgagatcttctgggtcagtttgatttaggcgttcttcttcttcttctagatctgcactttaaatatttttggtgtctttatgacttaaatgcmaatagcttaaacttagctttttcttttaagggkttaaggagtgagagcagagccaagtcctggagatggkaacttgctgtcgca

SEQ ID NO: 30501 - DNA, 188 bp, Homo sapiens
  misc_feature 151: k=g or t
agaaaagaggcttaagtcaatagttccttttcttgcctctcaaaactcaaatttatcattactgctcaagtccattgcctcctttttttttgttttgttttgtttttgtgagatggattctcactctgttgcccaggctggaatgtagtakcatgatctcagctcactgcaagctccacctccaccgc

SEQ ID NO: 30502 - DNA, 289 bp, Homo sapiens
gaaatgcagtgcaaggaatctgcaggtaactctataaaggatatatgcagaaataggaatgaaagaatttgaaatctggggaccctaggatattctgcttgcagcttccttattactaggaccttagccaaacaatttaacgttttttctttccaactattattataaaaattttcaaacaaatttgaaagaataatatatagtcaatacctgtgcatctctacataggctcaataaatgctttatattactctgcttatataaagaatagtaccctgtaaaaccacgt

SEQ ID NO: 30503 - DNA, 450 bp, Homo sapiens
  misc_feature 127: s=g or c
  misc_feature 351: r=a or g
  misc_feature 381: r=a or g
  misc_feature 412: m=a or c
  misc_feature 439: r=a or g
gaaggaccgcccttttcttcgtagcctccaagggagctggaacaaaaaacgaaaccaaaacctgcctgctcgctcctctccccatcgcctgcgttccgctggttgtgggctttctgcggccgctgtsggcgcgtctcccctccgccatggcatcagtttgaatgtcaaggaatccaaagctcctgaaagaacggttgtagttgctggtcttccagttgacctttttagtgatcaattattggccgtattagtgaagagccacttccaagacattaagaatgagggcggagatgttgaagatgtgatatatccgacaagaaccaagggagttgcatatgtaatattcaaagraaaaaaagttgcagagaatgtcatcagacraaagaaacactggctagcaaggaagactagmcatgctgaactcacagtctctctcagrgtctctcattt

SEQ ID NO: 30504 - DNA, 271 bp, Homo sapiens
tcggcaatttgtaagtttacatgttatttaaggataaaggtaaatcattcaaggcagttaccaaccactaactatttgttttcatttttgtcttgtagaaggtttatatcttgttttaccttggctcattagtgtttaaaaatgtactgatgatgtgctagagaaattcctggggctttcttcgttgtagatcagaatttcaccagggagtaaaattacctgaaaacgtaagaagttttaaacagcttttcacacaaattagatgcaacca

SEQ ID NO: 30505 - DNA, 433 bp, Homo sapiens
  misc_feature 141: n=a, g, c or t
ttctgttgtttaaaagctacctagtttaaggtgttttgttataggtgcccagacaggctaggacaaacgccaataagctttcgtttatgtgggttgtatccattgatacttgctgtatgaagaattaaaattaataacttnaaaaagatttattgttcagaaacagtaacaaaacttaatatgcgttaacgtacttttatgttggataaaaactatatcccaccccagtatatgaatagagtggcattgttttatgtgtttaatctctggcttaacagaaggcaattggatgatcatacctgcttctatgtttattctgctgccaatatcacacagcttctggaaacttccacggcacacattcatgagacaataagagttaaaaaggtaaacagtgtcttagtagtgtatgaaaatagtttaatctcataga

SEQ ID NO: 30506 - DNA, 376 bp, Homo sapiens
agatttttaaaagtacagtttgatatagctcaattgatcgtttaattaaggaacttgatttgctttaagaggctcgcaattgataataatcatattatcatgttgaattcccagtggtgaggtgagggtgtcagctgttctactggcgcatttttgtttgcttgatttgctgtatgctcagtttatatcgtggtagatgacagatgtgcaagaaggctatttaaaaatcattgctggtgatgggtggaaaagaatgcctttagtttttagtatgatataattaatctttaatagtgatcgactaatgtatgtttatatgattatatctgaatagatatttattaaatatatattattgatatttctgccgggataa

SEQ ID NO: 30507 - DNA, 365 bp, Homo sapiens
  misc_feature 344: r=a or g
ctttgcatctaaaagcacattgcctaacacagcaagtgttgtaaaaagattagttgttgagtaagttacttctctaaatattaccacttaccttctagtgaggaaagaaagaaacagaattacaaattgtgaagtgtactgtaaaggagtcaaagtgctgaagagaccagtggggtggaagggagacctggtgtccaaggataaggagctcgccctttgaagggggaaggagtacatcttagatggaagatgcagccagataaaggccccatgaagtagggatgaatttggactgctctaggacctgaagagtgttgctggagcaaatgggtagtagagagagrcaggttgaagaactgtgcaga

SEQ ID NO: 30508 - DNA, 114 bp, Homo sapiens
gagggtcctgcagcccgtgaatccctggtcccgccgagacttggacctggtgcgaactggaggcgaacgggtgcacccacaacctataggaagggctggcggcgagaccaggga

SEQ ID NO: 30509 - DNA, 351 bp, Homo sapiens
  misc_feature 69: k=g or t
  misc_feature 226: y=c or t
  misc_feature 227: b=c or g or t
  misc_feature 268: v=a or c or g
cacttacagcttttacatgggtttaagcatgttttttaaaagggtcagaatggttaacactcaaccctktttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactaybttcatttcgctcatggccttcaactttctacaggtcttccvtgaagattcagcagtactctctcaaaggtttgacagtactcttgtgggaaatcaccaaatgctgtcatagttttgttttaact

SEQ ID NO: 30510 - DNA, 350 bp, Homo sapiens
  misc_feature 39: s=g or c
aaaggaagtaccaggacttgcacagaataaacagcggasgccccaaacacaagccaggggagctgccttatcagtgtctgctgcatcctaccatcacagcggcgtctacagatcgtttcatctccatgcttttctgagtttatcgactcagtcaaggattctcagcctaggttagcatatgctgaagtcatctggtgtggggcacattacatatcgaaagtgagtttgtgatttgaatcgtgtcctgtgttagttaattagatcgtgtcttctgcttaggaatttcttttgtattggtcatccaataggtttcagaacaaattctagtcaacctcatagagcaagatacc

SEQ ID NO: 30511 - DNA, 64 bp, Homo sapiens
  misc_feature 17: r=a or g
  misc_feature 26: r=a or g
caacatatagccacatrtatcaaatraatcatctccttgtcatactgaaatctttttttttttt

SEQ ID NO: 30512 - DNA, 407 bp, Homo sapiens
  misc_feature 393: r=a or g
ttaaaaataccccttccaggctgggcactacaggtagctcatgcctataatcgcagcactgtgtgaggccaaagtgggcagattgtttgaacccaggagtttgagaccaccttaggtaacatgacgaaaccccatgtttcaccacaaaaaatacaaaaattagccatgtgtggtggtgcatgcccgtagtctcatctagctactcaggaggctaaggtaggagggtcccctgagcccaggaagttgcagtgagctgagatcacaccactgtactccagcctggaggacagagtgagacccggttcccctgcaccccccaaaaaaaccctccctttttccaattacaaatctatataaggctggattttctttatatacttcagccaaaaatgrcaacaacacacagc

SEQ ID NO: 30513 - DNA, 372 bp, Homo sapiens
actactgaggaacgctggactgagagtggccagcattaacaactcttttatttgaaaacgtgggtggctctgaaaagagccttttgagttcacaggtgccccttcgaaacgcgggccgggctgggcccacttgggccggacgtcagcctcacttgccctttgccttgtggtgactctccgtcttcttagggagcagtacggcctggatgttaggcaagacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcagatact

SEQ ID NO: 30514 - DNA, 330 bp, Homo sapiens
  misc_feature 86: s=g or c
tagagcatgggccctggtattaatccactctctgccacttgcttggttagcacgtgtgaccttgggcaaggttagcactaataggscctaaatattctcatctatcacacatggctgatgatagtagtagttaattcatgaagttgtgaaaactgaaagggtttagtctatgtaacagagccgggcacgaatcgagcactctgtaggcatctgttgtttttgtctttttttgcaacaagatctcaatctgtcgcccagggtgagtgcagtggcacaatcatggctcactgcagcctcgacctcctgggctcaagtgatcctcccacctca

SEQ ID NO: 30515 - DNA, 143 bp, Homo sapiens
agttcccatcgagacttcctgtgccccagcctcaacttccctcctatgtctggagagtgatcactttcactcccaaagacatccttttggtgatacttactgtgggattcagagtggggtgcagaggacgaccctgcaaaggc

SEQ ID NO: 30516 - DNA, 116 bp, Homo sapiens
  misc_feature 90: r=a or g
gtagtgcttgtactacgcagatgtttcctcttgagctattttaaaggtgtggaaaaagccaaagcaatgccctctccacggatactaaaractcacctttccactcagccgctgct

SEQ ID NO: 30517 - DNA, 342 bp, Homo sapiens
caaagatagaaaaccatgactctagaatagaaaactctctcttcaacccatgaaataaatgctttggacagccgaagactagattcctcagatggtggagcagagtcttatttaaatctttttacttgctgaatgacttacaaataatactgggtataaaaggagaaaatgggaacatgaattgagcttaaggaatcaaattttaatgaattttttctaattcaggaaacatttatcaaagccaggatctgaggataaaaggcaggaaataacggagggagttcaaacatctttgaattaaattactttaataaataatgtacatatacgatgaaggcaccg

SEQ ID NO: 30518 - DNA, 237 bp, Homo sapiens
  misc_feature 56: b=c or g or t
  misc_feature 59: s=g or c
tgaaattcctggtgcccctgatgatgaagcagtacggatatttttagaatttgagbagsagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaacagcaggc

SEQ ID NO: 30519 - DNA, 308 bp, Homo sapiens
  misc_feature 148: w=a or t
  misc_feature 239: y=c or t
  misc_feature 261: r=a or g
  misc_feature 288: r=a or g
  misc_feature 289: r=a or g
aaacctgatattggactgtgaggacaatacatgagccaccttactctccatccttccctgtcccctttactgattccccaatactaatcgttttttattctggtaacacccagacaagaaatattcgacttttcccccccccttcacwggaaaaggtggacctggactgagggtgtaaaatccctggacacattcgtggggcaggaaaaagaagaggaagattagaagatttttttttyctttgagagaaagcccagcggrgataaacgaatgtcccctcatctccarrgaaaagttcatcggatttt

SEQ ID NO: 30520 - DNA, 244 bp, Homo sapiens
ctaaactctaagactgcctgaaaattgacctttacagtgccaagttaaagtttaccttattctcggccgggtgcagtggctcatgcctgtaatcccaggactttgggaggccaatgcgggcggatcacgaggtcagatcgagaccatcctgccaacatggtgaaaccctgtctctactaaaaaaaataaaaaaattagctgggtgtggcggtgcacgcctgtagtcccagctacttgggaggca

SEQ ID NO: 30521 - DNA, 72 bp, Homo sapiens
  misc_feature 43: d=a or g or t
  misc_feature 44: n=a, g, c or t
ttattgtataatttatataccatacaatgtattaattaaagtdnacaattcagtggtttttagtatattcac

SEQ ID NO: 30522 - DNA, 77 bp, Homo sapiens
  misc_feature 15: s=g or c
  misc_feature 29: m=a or c
aaaggggaaggggasgtgggagaggcacmtcaactttgatgtcccgagccttgagtggccactcgcaagctggccaa

SEQ ID NO: 30523 - DNA, 313 bp, Homo sapiens
  misc_feature 88: d=a or g or t
  misc_feature 93: k=g or t
cagtttctatcattctgcattgccagtttcaacatgccattcatggattacagggtcctcatggtcactcatttctttgagtttttgdttgtkccagccaagagagaccatttgacgtttcacggatggctgcatgtaaacattcaaagcatttgagagaatacagtgcatagggagactactactatcagaaggatagtatgaagagtttggagtatgttccctaagcagggtccccatgaaccaaagcaatcaaatcagatagatcaaagaatgagctatattagaagtctacccattttaaccaagtccg

SEQ ID NO: 30524 - DNA, 69 bp, Homo sapiens
ttactccacagataactctagcatgccagtgaaatccaaatcctggcagtaccgtgtatatatatatat

SEQ ID NO: 30525 - DNA, 98 bp, Homo sapiens
  misc_feature 84: r=a or g
ttacccgtaaagacgtttctgaagttggccatatttatttctaaaacacaaagggaccctgcagtagacttatgcagatggcaractattttcttttt

SEQ ID NO: 30526 - DNA, 74 bp, Homo sapiens
  misc_feature 17: w=a or t
  misc_feature 18: d=a or g or t
aaaacattgctctgcgwdtcctcccgttaaacgcattcaatttttgggtctctctctctctctctctctctctc

SEQ ID NO: 30527 - DNA, 244 bp, Homo sapiens
  misc_feature 28: w=a or t
ctcttgtgttagaaacctgggaccaagwcaaatattaaaacaaaagatgctcctgtcacatctatcactgaggtctttgtaagagctttagaagctctgtgccaggaaccagggacagagattaaatatatatttcttttcttttttttgagacagaatctccctgtgccatccaggctggagtgcagtgatgtgatcatagctcactatagctttggccttctgagatcaagcaatcctccgc

SEQ ID NO: 30528 - DNA, 416 bp, Homo sapiens
  misc_feature 24: n=a, g, c or t
  misc_feature 374: r=a or g
cagacaaaatcactggcaccaaanaggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagaracaggggaagagggatagagggtatagcataaattcatattt

SEQ ID NO: 30529 - DNA, 154 bp, Homo sapiens
aggaaaaaaaaatccctggaccgctccgccgtgtccgccgccgcttcccgcatcctctcccgccgccgccgccttcgctcctcaccatgtgtaaggcggcggggagccccgcctgaggtgccctaaacacactatgaccgctcccgaaaagccc

SEQ ID NO: 30530 - DNA, 223 bp, Homo sapiens
attcattttagagacagggtttcacctgttgcgcaggctagagagagtgtgttagcatggtaatagttcactgtagcctcaaactcctgggctcaagtgatcctcctgcctcagctttccaagtggctgggactgtggtcacgtgccaccattcctcactaatatttttttgttttgttttttggtagagatgagggtctttgtatgttgcccaggctggtca

SEQ ID NO: 30531 - DNA, 246 bp, Homo sapiens
  misc_feature 200: n=a, g, c or t
caaaaacatttatacaaaaattatggtatggtcacatttttacagatccaaaaatgaagaagtatatctgttaaatacgttgtcttgaaagctatggttatattaagtaaaaagttataaaataatatctattttgtatgaactcatgaaatctatataaacatacatatgtttatatatgttaagaatattcaactaantgtaactagcgattgggataataaagatagattgttggtagagggg

SEQ ID NO: 30532 - DNA, 226 bp, Homo sapiens
  misc_feature 86: r=a or g
atctcggagcaaggttggggccaagcccaggtgctgttgcagcccagctgggtgtgcgcacactcagggcagcgctgacacaccartcccctgccgcctcagcctcctctgggctttgggcaccgataagcccgtgagggaggccgcggcaggggctgagggcagctttgcactggcctgctggtgcccctgggccggaaccgcctgggcaccataaaggcgggct

SEQ ID NO: 30533 - DNA, 428 bp, Homo sapiens
  misc_feature 387: w=a or t
  misc_feature 403: k=g or t
aagtatacatatttcattcttctatttcatatatttctatgacattatatcttagatgtgtaatttatgaactactactggattatttttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattgawgtatagcatatctatkattctgctcaattagaagatattgt

SEQ ID NO: 30534 - DNA, 226 bp, Homo sapiens
  misc_feature 171: s=g or c
gaaagtttaactttgcggacaaacaggacttattgtagggggtggtcaaaatagtcccggcggggcggggccatgacccctgacgtcgccggtccggcgcgcagttcagtttggcggttccggtaccgctctcacattggggcgggatgtgggagcggctgaactgcgcasagaggacttttattctcgtctccttcagaaatttaatgaagaaaagaaaggaatc

SEQ ID NO: 30535 - DNA, 342 bp, Homo sapiens
taaaagataaattgaggccccctaatttctttggaagaaaagctccatagcctgcacaaagcctgtaagtagtattagaagcttacatattcatacactataaataaaaaggacttttgtaagccatgtaatggatttgcagtgtttgcacttaatagcacagatcagaactcctttgctcatacagttgtctgaaatgttcttccttcttcagagatagacctgttttttgttttttattatgaaagaaaaataatcctcatatgttctcggtctagtttctaaatagatggtcagtaagctactgtgtgggattacttgggctccatagtttgctgtgta

SEQ ID NO: 30536 - DNA, 370 bp, Homo sapiens
  misc_feature 259: k=g or t
taatttgtaggattgcttcattatacttttacgtatagtctgttcagagaaaaatattaaatttgtccttccccaacaaacttgatattgtagctgcttaaataatggctattgtattccaagcatcagctgagaacataatactcagactgtgtatcaaagttttgaactttgatatttgtctgtgaagagccttctgtgggaatggtggttgctgaggatggtgtatgatcataaatgttaacctaaatcatgcagkaacttgaccatggaatgttgtctgtgatttctctcctttgcctcatcttgattacagagaggtacagaaagcagtcaacactgccagggattgtttcagagatggacccat

SEQ ID NO: 30537 - DNA, 136 bp, Homo sapiens
caaccggtatgttcttgttctattgaaattctcaaggaaagagaactatggaggcatttgaaatgcatagtgacaaaaatgatcttaaaataccttgggaatattttttccaaatttgaaatctattattgaggct

SEQ ID NO: 30538 - DNA, 74 bp, Homo sapiens
caaagacttaagacttgaaattgtcaaaccactagaagaaaacataggggaagaggctttatgacactggctaa

SEQ ID NO: 30539 - DNA, 366 bp, Homo sapiens
  misc_feature 23: k=g or t
  misc_feature 200: r=a or g
  misc_feature 230: r=a or g
  misc_feature 330: r=a or g
  misc_feature 350: v=a or c or g
  misc_feature 357: r=a or g
cacttcagtgaattaaactgtakttgtatcatatattgaatgaatcaggtgttgggttgctcttgatgtcacaaagaaactctgttggtcctgattgtttcccttagatttttcctgtggacatttgaactttaagaaatttatgatagtagtcctaagtggattgagaaatcagtgagcctcatcatctactggtaggrttgcctgtcagctgccctgtgccagaagtrattctgttaatctgtgtgcagctccaaaagctgttgcagcatggactagaacatttcagctgctggttaaatctttctggcatatgtataaacttaaatrattgctaacaaaaaattccvactaggrttataaagt

SEQ ID NO: 30540 - DNA, 135 bp, Homo sapiens
tgggctggttttgggcatggtgctgggctgcctgtctttgatttcacttatttgtttttttcttaaaacaggtactgaggataaaacaatataaaataatatgagagggtctttctcttccttcattcccccctt

SEQ ID NO: 30541 - DNA, 146 bp, Homo sapiens
tactttaagttttagggtacatgtgcacattgtgcaggttagttacatatgtatacatgtgccatgctggtgcgctgcacccactaactcgtcatctagcattaggtatatctcccaacgctatccctcccccctccccccacccc

SEQ ID NO: 30542 - DNA, 85 bp, Homo sapiens
ccacttgatcgaatcggctgctgaagcttgtgcatgcgtcatgtagttctcgagccatgattttcagctccatcaggtcatttat

SEQ ID NO: 30543 - DNA, 99 bp, Homo sapiens
tttcattcatgattactagtgaagttaaacatttttaccccagagcactttagttaccaaaaccagaagttcatttcacagttgtattttgtttgctct

SEQ ID NO: 30544 - DNA, 54 bp, Homo sapiens
aattgtgttcgcagccgccgccgcgccgccgtcgctctccaacgccagcgccgc

SEQ ID NO: 30545 - DNA, 336 bp, Homo sapiens
  misc_feature 94: r=a or g
  misc_feature 97: r=a or g
  misc_feature 317: r=a or g
ttcaactatctggaagctcccagaacccagtccatgtgagtttttatggaagcatcgttgtgtaggagtgattggttaaatcatttgccattgrtgrtcaagtcagacttcagccccgctcccctcctctgaggttgggagtgggcctgaaatcagtcccaaccttctcatcaggttttgtgaccagcccttatcctgaagctggctaggggcccctagtcatcagtcatcttactagcacacaaaggcactcttaccactctggagatccccagcacttcaggagctatctgtcaggaaactaggaacaagaccaratatatatttcacagtact

SEQ ID NO: 30546 - DNA, 82 bp, Homo sapiens
  misc_feature 32: s=g or c
  misc_feature 34: s=g or c
  misc_feature 36: s=g or c
  misc_feature 37: s=g or c
  misc_feature 72: s=g or c
gtctggtaaggtcatgggggaagggagatgasasassagataggcagatgtgggtatggggcccagtgtgasaaggaagaca

SEQ ID NO: 30547 - DNA, 215 bp, Homo sapiens
taagaggaatgtgggtcatcgtagaccagggataatgaaagagtctatgctatcagaccataaaatcagagaaagggaaagaggcttctcacctgactcagatacctgggaaggtgagatatagttgcatttatgcactggaacccaaataggtctgtggaataggaaagaaaccccaaggagagttctgaaagtggggagttaaaggaagaggt

SEQ ID NO: 30548 - DNA, 375 bp, Homo sapiens
  misc_feature 142: w=a or t
aaaaacctcgggtgcggggagcatcttagctgtttgaggttctagaaagcgtttaacgtcttaaaagaaacacctgcgggtgaagacaggtgtcagcggactcttggaagagaggaggtgatgtttcttttacttatgggawatttagggattgaaacctgaagacgaagccgaggtatcctcccagaagaagctcctttcgcacaaattactcgtggttgaaagtcttaagtcgtgattaaaacaaatgcctttaaagtgcccaatttataggcagtaacgcaaccttactttctcttaccgcttttattggggattcccctaggcagtttgctgacagtattttaggtggggaagaaaagtgattaatggaat

SEQ ID NO: 30549 - DNA, 255 bp, Homo sapiens
tccaggagttacatctgttgagcatatattgaagcccaatggactaactcagccctttaattctaaaatggtgaaacctatgtctagagatggaatgtgacatggccaaggtcacacagccagtaggcagcagagccaggactagaacttggatttctcagcttctggtccaacgccatccttacacagaatcttagggtctctctctctctgtcttcccatctctttcaacagtatgtgaaagccaggtccccc

SEQ ID NO: 30550 - DNA, 335 bp, Homo sapiens
aaataatgctgttggataatacaggcaaaaacaggatttaaacccgcacattaaaagcatgactgaaggcccggcaggtggatcactttggcccaggagttcaaaactgacctgaacaatgtggcggaatcctgtctctactaaaaatacaaaaaccagccaggcatgttggcgcatacttgtggtctcagctactcgggaggctgagacatgagaattgcttgaaccttttgggcggaggttgcagtgagccgagatcatgccattgcgcgacagagcaagtctctgtctcgcaaaaaaaagaaaaaaagtttaattctaacattgcccataga

SEQ ID NO: 30551 - DNA, 237 bp, Homo sapiens
tcagtattaatgtctagacagccttaaataggaagcaagagttgtcatctcttttctttatttttttacttatatttttcacattaagatacagaaaaattgagttttttgtgtctagttctatgaactttaacacatgtatggatttgtgttattactaccacattcaggacacagaagcacttcatcccctccagattctctgtcctgatgtcttttataatcagacccccccca

SEQ ID NO: 30552 - DNA, 406 bp, Homo sapiens
  misc_feature 399: r=a or g
ggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggracaaaac

SEQ ID NO: 30553 - DNA, 403 bp, Homo sapiens
acaaggttagagaactaagttcttttttcagtggtaaacaggaaatgtcagtactctgagtaattttccactcatatagcaaatagaattttccaaaagattgttagttcagtcacatttttttcaaactatatttactccaagtgctaagagatattttatgggataatttatttcttcttcagcttgaattaataatcagataaaattcatatgtgatatgatgtgcttctggactggcttttaacaatcttgcaaagaggtcacaactgttgagtttttatctctcatcatttgaaagattaaggagtttttttctctagagaacactttattttctaatatgagaatattttctaacgtgtatttgtttcatttccagtgtaatatatacttctcataa

SEQ ID NO: 30554 - DNA, 179 bp, Homo sapiens
tcatatagtaaatagttaaggctttgtaggcaacacctcagtgaatgaaatgtggcatctcattggtggaattgacatcagaacccatgtgaagttcccagtcttctagcccttccattgagtacaggggaatttaactgaacagtttattcagtgtgtacttccaggggcaccctgcc

SEQ ID NO: 30555 - DNA, 342 bp, Homo sapiens
agataattctggggatggagcttaaaaggacgtcagcgttcaagggccaggtagaggatcatgagctgtaaagggacccaggtggctccagcacagcgaggaaagcatgcgagtgtgatggccaggcttccagggagagaggagggttttaaggagaacaacgtgctaaaagccactaagaagccaagcagagtgagaaatgaagacctccactgggtcttgcaagaggggaggcctttgaggacctcacctgagagctgatgaatgaagtgatggctggaagcagctctggagagggaggaatactgtggggaggggaggaactgaagaagtagagaagat

SEQ ID NO: 30556 - DNA, 207 bp, Homo sapiens
cgtttattttacagaacacttcgttcagtgactttgaacaatcatgactctggcggtgctttttaaacttgccattttataaatttttgctttgcatacgagcaaaccatatttctattgcttatgacatgattttatgagtaagctattagttgagcctgaggtcctgcagtcattcttagtagtaaatttttttttttttttttt

SEQ ID NO: 30557 - DNA, 283 bp, Homo sapiens
caaggccaagacccaaccagccgtcaagaacatgtaccgctcggtgaggctgagctggacaggccactcttgctggggtgacgagggggagggacagaggacactttgacctcccaaggatggagtattttgaccctggcagacactttaaacacaaatgatttaatcagaactgaaccagcagttaaaccattaacaactcttcccccttttattttttatttattatactcattttttgttggaatcctacccgcccccctccgccccgcccacgaccccc

SEQ ID NO: 30558 - DNA, 368 bp, Homo sapiens
  misc_feature 10: v=a or c or g
  misc_feature 167: m=a or c
ttagaatttvcttccttgtttacatttaacaataaggaagctgtggcgtgctcagggattaggtacatggattctggagtcacataaaatgggtttaagtccaagatttttcatttagtagcagtaaaaagttgaattaactgatttccaggtctataaaataagamtaattagtaataattattgtaaatgatgtgacatatgtgaagactctagcatggggcccagtacaacacaagcacccaattggcacttactgttgtaccctaatctgaagatagtcagtcttctacagttggagaagaaagggagtggataataagttgcctgttcagtaaatctgtggtgctacttttcagtgtcttgca

SEQ ID NO: 30559 - DNA, 428 bp, Homo sapiens
  misc_feature 86: r=a or g
tataaagcagcattgaagaagttgtattatatttgagtacagttggaatccatggcagttttatggaggccaaatatatcagatgrataggctaatttccctgagttgctggccttattagtccctactctgttgccccctggttacctaatgcatgttcaaaaggtatagttttcatcacctgcttgatcttgattttcagacagcatcaaatcagttgcaaaacaaatccaagctaaaattttgagtgtatgattaatttacttagcatgtaattatgcagtattttattttttattttttattttttttgagacagagtctcactccattgcccaggctgaagtgcagtggcacgaatctcggctcgctctaacctctgcctcctgggttcaagtgattatcctgcctcagcctcccgaatagct

SEQ ID NO: 30560 - DNA, 347 bp, Homo sapiens
  misc_feature 303: n=a, g, c or t
  misc_feature 304: w=a or t
actctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtgganwgttatctttcccgctctttgctgtggtcattgtgtcttgcaga

SEQ ID NO: 30561 - DNA, 398 bp, Homo sapiens
  misc_feature 153: w=a or t
  misc_feature 161: d=a or g or t
  misc_feature 214: d=a or g or t
  misc_feature 345: d=a or g or t
aacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaawttttaggdcttgaggacgtgaacaacttgaaagagaaaattgattccccttgaggaaagadtggctcaacgtggatttttattcattgtggtgcacgtttcaaattttcttgcaaattattttatatcttatttgatgttaagtaatatttttaaagtatggtttttgaagatagtaggaatggagtacagdaaggcatacagtattatgttacagtggagtgctttcaagagcatttcgtagga

SEQ ID NO: 30562 - DNA, 239 bp, Homo sapiens
tcacccaccctcgtggtggggcaggtcgagggcccaacagggatgctcttgggctttttcactgcaggcctcagccagcacccccaggcagcccctgttgctgctctctggccaacagtctcctaagagtccagggttgcccattgctattgtggggtcacatatctttctacatccatactcctagggaggcggagtcggtcttgaaactgggtggggacccctccattcccccgtga

SEQ ID NO: 30563 - DNA, 188 bp, Homo sapiens
tctaatagattttttaaatagatttcttataatttcttttttcttttttttggagatggagtctcactctgtcacccaggctggaatgcagtggcgttatcttggctcactgcaacctcacctcccaggttctagcaattctcctgctttagcctcttaagtagctgggactacaggcacacgctgcc

SEQ ID NO: 30564 - DNA, 343 bp, Homo sapiens
tgatgaaattctgtagttagcaacccataagggcattaagtatgccattaaaatgtacagcatgagactccaaaagattatctggatgggtgactgaacatcgttattatgacttagatgcttttaccttatctaacatgtaagagtcaaaatcaaacttgcctggaatggcttctatttcccatagctttctacctatctacttggcattttccctttgtgttgtgactattaaattcctatttaaaagaaaatgattgtgggcaattctcgcccttcacttttgcttttaaaagaaaaggccacaaaggagagtatattggcaaatacccagttctgttct

SEQ ID NO: 30565 - DNA, 124 bp, Homo sapiens
  misc_feature 77: y=c or t
aaaaaaaggtctccccagtgctagctgccgaagcacccagataagagctggacggaggctaaagcggcagccccagyttcgcgccccgcccagtccctttcccctgctggggatcccccctcta

SEQ ID NO: 30566 - DNA, 224 bp, Homo sapiens
ttgtttcatgggcacttaggtagaattccctgtttgcaattgtgagttgtgttgtgataaatatatgagtgtagttgtctttttgataaaatgacttctcttcctttgactagataaacccaatagtgggattgctggattgaatggtagatctacttttagtcctttgagaaatttccatgctgttttccgtagaagttgcactaatttacgttcccaccaac

SEQ ID NO: 30567 - DNA, 168 bp, Homo sapiens
tagtccatcttgaattaatttttgtataaggtgtaagaaagggatccggtttcagttttctacatatggctagccggttttcccagcaccatttattaaatagggaatcctttccgcatttcttgtttttgtcgggtttgtcaaagatcagatggttgtagatgtcga

SEQ ID NO: 30568 - DNA, 370 bp, Homo sapiens
  misc_feature 102: m=a or c
  misc_feature 346: m=a or c
tagaactaatctggatcctgaattgtaaaatgtacttttcccccatgtaaaattggggttttctgacagcctatgttctggaaactctcttgcctatccacmcctgctctcagccttgtgaccttccatgtgccctggttgcctatgagagcagatcatggttacccttaaagcacagggcctagcagcccagcccagagccctggcccgtggcagtgttgcatagtgattaagaagccaggggctatgagaccttgggccagcaatgaccctctccaagcctcagtttgtgcattgctactctggagagaaaagtagtgcacagtccctcgggcagcagtgaggmttcaatgagttgaaagtctgggat

SEQ ID NO: 30569 - DNA, 201 bp, Homo sapiens
tgtaactatcagtaagaataaagttgtgttgagttttttcatttaaagggatggaagaacaacaaaggatttggttcattctatcaaagtaagttttggcagaataaggactaggaggtatatttcagagtttttctttcgaatgtaacatggaaaatttgtcattttgaaaacaagcagggtatggaattagagggtcca

SEQ ID NO: 30570 - DNA, 369 bp, Homo sapiens
cctcaaacaagttttttctaacgtcttaaagcatgtggcctgatctgtaaaagaatgatactctgttctgtaggattgtgtgatttaaatgagaacctatgtaaagtagcaggcacacttcatggtatgcagtaggtgcatattaaatgctttttccccctgccttcctgagtgtgctaacaagtgtgattgaataggtaacaagagaatggtcattaccattagatcagtgatttttgtttttatcaagatattgaaatgtctttgtaacgtataaaatttgctcccagtttcagcctatgattttaatatgttcattacatttttctaaaatatctattgcttcatagtcaactcatcccccctatt

SEQ ID NO: 30571 - DNA, 327 bp, Homo sapiens
  misc_feature 267: m=a or c
  misc_feature 272: m=a or c
  misc_feature 286: m=a or c
tacttctttcacaagtagaatttttttaaatgttagcaatataggaagatgtcttgaaggtcacacagttccccttctcctaattccttagtgagcgtgagtgctctggctctcttaaaagtcatttctccccttcgaaccctccccagtctttttctcgtttgagccacaaacagtctggtttctactgtattaaagcaaattaacctagtaagaaacactgactttttttttactggctacagttctaagcacaagaaaaggggmaaggmgaccaaataaagamataggaaaaatgaggcattaaaggggagccaacacggggtc

SEQ ID NO: 30572 - DNA, 418 bp, Homo sapiens
  misc_feature 391: m=a or c
taaaatgactatactcttttatccttagggaaatatgcttaagaagtaaatcaggttattaatatgctgtgaagagtttgaaaacagtggtgctcagttgagcatattttagactatgcaggttaattggacacatttttaactataaaggattaactaaaattgtggcaaccttttcagccttgagattccattaaattgtagtgtgtttgcttgtttgtttttgtattgataatttttgtgaaaaccttcaggtcagagtcacttttctagatcagaatgtcaaaattaactgagagagaataacttaaaatattcagtggaattagacagcattgtagttttctttttcactttaaatgaagttgcagtaacatttgagtcccaagtmttgtggtttgctaaaaatttgaacaga

SEQ ID NO: 30573 - DNA, 382 bp, Homo sapiens
  misc_feature 44: w=a or t
  misc_feature 264: m=a or c
  misc_feature 355: y=c or t
  misc_feature 365: v=a or c or g
ttgttcctgcattagttcacttaggataatggcttccagctgcwtccatgtcgctgtaaaggttctgtgtcattttaaccagaagacaactttgtgaggaagtcagcactgttgtcacccatctcccccattacaaaaaccgtgaattaaagacattaatatgttaaacagccttaggttttaggagtagtatcatgccatgatccactgtgatgagactatatctgtcgttagatgcgtttagctctaagaacagtgcttgamagaaccgctgaccaagaggtccaggaccagagagaaagactcgtaatgggagagaaaacatacggctattagagaatctagtcatgtcatygcagaagagvcaaattggaggagtcat

SEQ ID NO: 30574 - DNA, 250 bp, Homo sapiens
cggcaggctgttatcgccattgactgtgaaagaacatccagtctcaacctgtggaagaaatattcttagatttccttttagtagttccacagaccgttgtatttcagtttcatcacatcatcacataataggaagtcactgtctatattttggcaatataacttcttaggcgtgttcttcttccctcacctaaaaaggcagtgatacacacacacacacacacagacacacacacacacacacacacgcc

SEQ ID NO: 30575 - DNA, 228 bp, Homo sapiens
attgccaatgttacttcacaataaattcagtcctatttgtgttggagtaaatctcatagaagcacatgaagaacagcagtgaaaccaagggattctagcaaggccagctattagcaaagcagtaagcaggaactggactagataccaaatgatggggaaacagactcatagacctaagaacataggaagaagagatgtaacatcaacagaaaggcaaaaggggctcaa

SEQ ID NO: 30576 - DNA, 363 bp, Homo sapiens
cattattctctaatcatagtctcattgttcttgtaaattcttcttcctgtatttattgaagccttacacctttttatactgtagtcaaaccatccaaaagtaagaaggcatttccccctctaataactttctctgcagttatcagtcagttaaaagagcccatgtagttttagaattagagatatagggtggaaaagataaaatactaatttgaggtgtgcgtgtgtagtgtcaggctccgtacttgagagccaaaggtttaagagtcttgattttatgccagggatgccttcactgaaactcacccaaatagcagaagactgttttcatcaatttactaatatcaatgttatctagcaccac

SEQ ID NO: 30577 - DNA, 402 bp, Homo sapiens
  misc_feature 90: w=a or t
  misc_feature 371: n=a, g, c or t
ctagctgactgccttagtcctttgagttgttgtgaatatcagtatcaattcaaaaacaactatttaataacaactttcttaaagaaaggwagaaaaatataattttatgaaatgaccacttttattattcttgagtgtctcagaaactttagtgtaaagtgtcctttgctatccaggatataacagctggttccagataacatggtatgtctcattagagagatactagatctaattatgcaacatataagcaagatcattatagaaacattactcgatgaggtaagtaaagtacatgtgaaatctaactctgctgttgaaagaatttttgaaagcaaatgtaaggaattaataattacttaagtgtatgnagaaaactgttgcaactacttatgaatcttt

SEQ ID NO: 30578 - DNA, 365 bp, Homo sapiens
  misc_feature 115: d=a or g or t
  misc_feature 116: v=a or c or g
  misc_feature 117: n=a, g, c or t
  misc_feature 118: n=a, g, c or t
tatctaattcttcatcagtgcaaatgccataatacctacttcagagacttttgtgaggattaaatgagatagaatgaccttggacatagaaggcacacaatatctattggtggtdvnncttacctagtatggaatcttggtctttgtaatttttgaaataaattcctttccagaaaattggagtttgcttaaattaatttcttgtatgtttggaaactataattgatttttttacattggggaattaagggaatgtcagttctacatagtttccctgtggctcattgttacttgtttgactcacacttctatctcaatgtgaaggtgacctggaaagtgaactggaaaatattttctcaatattt

SEQ ID NO: 30579 - DNA, 404 bp, Homo sapiens
  misc_feature 277: k=g or t
  misc_feature 279: n=a, g, c or t
acttaacgttttaaaggtgattgtcaagtaactgtgtggggttctaatgccagtttcctaattccatctcactggagatgtttaaagttggcctctatccctaatgactcaaaacttggttcttaactaccatgattgcttttgagggcccggaattataaatatatattatattttaattgtttgagattattttgacacatttctttgatacgtagagtgttttgtttttaatttaaatctgtcctcatgcaaccctccatgaggggcagcgackgncagggagcagactggctttgtaggttcagcactcggccccccactgcgggagaggcggaacccacttgcatgtcagcgtttttgattcgagaaaagaaatactctcaacgttttaccaagtgatg

SEQ ID NO: 30580 - DNA, 181 bp, Homo sapiens
  misc_feature 97: r=a or g
tggagttgataatatttcagctagaacctagtagaatctgtttttttcctttggaggtcctcaaagcattattggagttcataatactgaagctagraccaagcagaatctgtttttttctgaggagtatcggtagcataaatgtgattataaacatagtacacttgatatatggaggtga

SEQ ID NO: 30581 - DNA, 365 bp, Homo sapiens
  misc_feature 97: n=a, g, c or t
tgttaagttatgttataaatcattccatgtgtttttataagttgtctcatctttatttgaacaagattgagtataaatcgttttgagtaaaaaattnccctgcttatattattgtgtaaagcatttttgtaaaacgttagcatccagtggattctagggtctgtttggatttagagaagttagtgtatcactttcttttccagtgttgcttttatcaggttactttatttatttatttatttatttatttatttattgagatagagtctcgcctgtcgcccaggctggagtgcagtggcgcgatctcggctcgctgcaatctccacctcccgggttcaagtgattctcctgcctcagcctcccta

SEQ ID NO: 30582 - DNA, 133 bp, Homo sapiens
ctggatggatggggactataggggcatttcagacagtggggataccatgaacaattggcattaagctgggtgttatggaaaggaagaggctccctgcctgaggtaacttgtgcttaggaataacagaggccga

SEQ ID NO: 30583 - DNA, 222 bp, Homo sapiens
caaacattttaaaaggagaaaaaaaaaggatacagaaatttcccaccttgttccctttaattccctcaatgttaccaattcctcatttcccccttactccccaggtaactgatgtaattaatttatcagttattactctgagtaaatatgaatatatatttttgtcccaccccacccccacaaccttttctttttaacagatgaggtaacataccccacaac

SEQ ID NO: 30584 - DNA, 173 bp, Homo sapiens
aagttaaaacctccagctccccgagccctcaaatttaaatgattttggtgcactgagatctaactgctgattctaggttgctgctcacaaggtgtgtgatatattggtaggtcttttcatctttcctggcctcagtttcctactctgtaaaatggaaataagaatgtcccccc

SEQ ID NO: 30585 - DNA, 199 bp, Homo sapiens
  misc_feature 113: r=a or g
  misc_feature 114: r=a or g
  misc_feature 115: s=g or c
  misc_feature 118: w=a or t
  misc_feature 194: w=a or t
  misc_feature 195: k=g or t
aaaaaacacaaccacaagttatgcccgtgctgtgcctctagcagcaaagacaagcggtgtggggttggatgaatctacacttctcgtcgggggagaaagggattccttgcggrrstgwatttactttacatccatgtgaactgctgtcatcactactgtgtccaagcccagaggatgaactggaaaagaagtgwkgggg

SEQ ID NO: 30586 - DNA, 91 bp, Homo sapiens
  misc_feature 35: h=a or c or t
  misc_feature 71: y=c or t
ttgattgaatacaattgtattttagggggattgchtggcagcaggatggagaaactagagttaaatcagcygagagaccattgtgatgtgt

SEQ ID NO: 30587 - DNA, 381 bp, Homo sapiens
  misc_feature 194: w=a or t
  misc_feature 267: w=a or t
  misc_feature 268: k=g or t
tttctttgtaaattacccagtctcgggtatgtttttatcggcagcatgaaaacggactaatacagtaaattggtaccaggagtgggatgttctgaaaagatacctgaaaatgtggaaacgactttggaactgggtaataggcagaggttggaacagttttgagggctcagaaaaagacaggaaaatgtggatawgcttggaactttctagagacttgttgaatggctttgccaaaaatgctgataatgatatggacaataagacccwkgctgacgtggtctccgatggagctgaggaacttactgggaactggagcaaaggtgactcttgttatgttttagcaaagcgactggcagcattttgccctgcctagagatgtgt

SEQ ID NO: 30588 - DNA, 365 bp, Homo sapiens
gtttacatttctaacagataaaatctaaatggtccagctaatcataattgtctccattgagaaagaacttttcagtcagaccacctcatggattgtctgctctgggctgtcaacgatgagagaagaagtttcttattggaggcagcaggggactgtgcaactgtgcagcaggaggcagcaaagaacaaatgtccatttcacacccaggtggaaaggccattagagtctaccagtgaggaaatcattttctaagggtgattacacacgcagatgtcaaaaccctcaggtaactctctgctctcctgccttggttggacagtgccctgaacttctgtccttctcagaagattctccccttgccaccc

SEQ ID NO: 30589 - DNA, 306 bp, Homo sapiens
catatcttatgtaattgctaaaataagagcttattattttttaaaagaatagcagagtgtgggaatgtttttggtttatcagtagtctatataaaatatttgcttaatcactcatacctgctccttttttcttgctttattacataatactgtcagctattcagaatcatgctggataattctagtgctgttaatcgttaagctacggctctttcttcatcactgtcacttggccagagcctagcctactcacattggtctctggtcttactttcacctgcttcctacattcaatcatggtcacgt

SEQ ID NO: 30590 - DNA, 316 bp, Homo sapiens
  misc_feature 263: n=a, g, c or t
gttggttgagttgacttgagcctctcctacaagatgactcataagcccagtgtggggtaatatacagaggtccaggagcgtgcctcttttcccctctgggcttgtgttgggtggcatttgggcacgagggcctcttctagccctcctagctagcttcaacatcataagcgtcttgaacgcagagtgttacctgaaacagattttacatcctacttctcattttacagtttcagagactcctccactctctgggaatgacacgnactccctctcctgcgacagtggcagttcggcaactagcactccgtgtgtgtcc

SEQ ID NO: 30591 - DNA, 212 bp, Homo sapiens
  misc_feature 123: k=g or t
tattaataatttgcagacttttatctaacctgcactcatgtacagattattaaaagttttaaaatgtaactgatcagtattgatcaatcattgtcttgatttttttttacagcgtatatttckaatcatattttttaaagccaagagaactggttgaatgaatgtttattttcctgaaggtatttttaagataaagcttcctaatggcgcca

SEQ ID NO: 30592 - DNA, 323 bp, Homo sapiens
atttcaagttgtcataaaagttcagacaaccatcactggacctacagattgagtgattattatagtggggatgtccttgggttagtaagcctaaaggaagtaatttctgttaaaggagatgttagtggccatttgcatcttaatgtcaatcttatcagatgttcccagactacaaactgggtgggtcatatctcttagcatttcaactggtatttctcagagcaactagtggctcatgttccaaatatagaaggcatttgcataacatcaatgttagacctgggcttgttagactcttgggctcatgtatacaaaagcaacct

SEQ ID NO: 30593 - DNA, 113 bp, Homo sapiens
aatttgacaacagccgcctgttgagtctcctccagatcgcagctgaaggatctgttgagcgcttcaggaaaggcggacaggcgacactaacaggtgaagatctcgggagacct

SEQ ID NO: 30594 - DNA, 236 bp, Homo sapiens
cctgattacttcacttagaataatggcctccagctccatccaagttgctgcaaaagacttttattttgtggtttttctggcctactagtattccgtggtatatatacaccacattttcttcatccctcattggttgatgggcacttaggttggttccgtatctttgcagttgtgaactgtgcagcagttatttttgagcccaggatgtgctaggccaggtattttgagagacaccg

SEQ ID NO: 30595 - DNA, 379 bp, Homo sapiens
  misc_feature 79: v=a or c or g
  misc_feature 81: w=a or t
ccactgtgaagttacttttttaaaatttgagggggcgtgcgcctgtgatcccagcaattagggaggctgacgcataagvawcattttgaacctgggaggcggaggctgcagtgagctgagatggcgcccctgcactctgatctggatgacagagtgagactctgtctcaaaaaaataattaaatattatattaaataatattgttatctattacatatcacatctgttaaaaagctaataatagtagttgtagtgtcatttattagatagtgttggataccatattacataacgttgttatctaatctgcagcttccatatttaaatttattcagtttcttcttttggtccttataactatcccttgccccacttttta

SEQ ID NO: 30596 - DNA, 325 bp, Homo sapiens
ttttttttaaagttaactctaaaagaagtaataatcagttgggctactggaatatcctttaagaacatctgtattattttctttgtgctttagtgtagttttcagatgttcagtagtaatctctaagtgagtagttgaagttgggcttagaattggaagttctctgcatttctcctgacttcaaaaataagcccttcagcaacttaatttggaaatagtgggtaagagagtgcgttatgtcacttctttaagaatggtgcactatttatttaacttatataaagaaaggtgtttttattttgttttttggtggtttttttttttt

SEQ ID NO: 30597 - DNA, 402 bp, Homo sapiens
  misc_feature 167: s=g or c
actcttgttgcccaggctggagtgcaatggcgcgatctctgctcaccgcaacctctgcctcccgggttcaggtggttctcctgcctcagcctcccgagtagctgggattacaggttttgttgattgaagagtacagatgtgtgcagcaacaggtttgtcaggcgtasggtcactgcttgtattttggctttgcatcctagaattagtaaataacgtaagacaaacctgagtataatcagtaacattcctttccaatcaaggagtgacatgtagtgttacctagcacctcagtctaatgtgtgccattactgaggaaccccacttggggtaagtcaatcccttctagcctagcagttgctttattagaagctgggaagggggtgtttgtctaagtaacagggt

SEQ ID NO: 30598 - DNA, 142 bp, Homo sapiens
  misc_feature 87: r=a or g
acatttggctccctccagctccgagagaggagaagaagaaagcggaaaagaggcagattcacgtcgtttccagccaagtggacctgrtcgatggccctcctgaatttatcacgatatttgatttattagcgatgccccccga

SEQ ID NO: 30599 - DNA, 116 bp, Homo sapiens
  misc_feature 4: r=a or g
cgcrttactcttatttcttcagcgcactaaaaggtggccactcatcaaggtctgtggaactagaaagaagtaagagttttagagtattctgagtaagaaaaagttcatgccacaca

SEQ ID NO: 30600 - DNA, 264 bp, Homo sapiens
ttattcattgtgcatttgtaatgttacaggtactataaagataatagttttgacagctcctgcatttttgttatctaagtttttttgcatcttattacttttttgaggtttcacttacagtaaagtgtatacatcttaaatgtacagttggataatttttacctatgtgtatgtcctgagtgactgccacctggatcaatgttgttagcaccccagcgctccctggtgccacctactggtgaatcattctccgtacccctacca

SEQ ID NO: 30601 - DNA, 247 bp, Homo sapiens
taaattcaccttttggccaggcagttgctcatgcttgtgatcccagcattttgggaagccaaagcaagaggatcacttgaggccaggaattcaagaccagcctggacaacctagtgaaaccccatctctacaaaaaaattttttaaaaagccatgcgtggtggcatatgcctgtagtcccagctgcttgtgagacagaggcagaaggattgcttgaccccagaagttcaagtccagcctgggaaact

SEQ ID NO: 30602 - DNA, 438 bp, Homo sapiens
  misc_feature 9: s=g or c
  misc_feature 392: d=a or g or t
  misc_feature 393: k=g or t
cttttctcstctctctcttttctttcagcagccagatccagggctgaattttctccgcggctgctaagaaagtctcaacctttctcttgtcttcctttcttgttatttttctttctcccattaatttttttaagtcctggaagatggcctatcccctctctcggggcttctccagctattgttactctcctggctctccctggggtgtgcttggcaaggtggggttcttgcggggggctcatctcccttctccagcgagaccctggggggaagccggcagccaccgtctccctccctccctcccgaggagccatatggaacctgaatttttccaacatggaggcaagggaaatagatctgtttggcttggtagagttgttccccacccctcdkgttctggatcccagatcttgggtccccttagcactttctctcttc

SEQ ID NO: 30603 - DNA, 225 bp, Homo sapiens
  misc_feature 131: k=g or t
  misc_feature 132: v=a or c or g
tacataaatttaaatgtattttgatttactgaagtttctaaaatgtactgagtacagacatacaccacataacgacgtttcagtcaatgacgggccacatgtacaacagtggtcccataagattataatgkvtttttactgtaccttttctgtgtttaaatacacaaaaccatgatattacagttgcctacagttttcaatatagtatttgtagcctaggagcat

SEQ ID NO: 30604 - DNA, 383 bp, Homo sapiens
  misc_feature 350: v=a or c or g
  misc_feature 351: b=c or g or t
cctttttttgtttgttaccacatgtacagtaaaggaatgggcagtgtggcacaggccaggcagaggacccacctgcataataaaatttggttaggggtgaccagcttttcataccctatgcaaatggcacagctattcctaaccagtttttagtgtctatgcacacctggtctaatcaatcttttgcaccctatgtaaatcagaaactgcctcctcaccaggcacctataaaaacccctgcatttcactgcagatccagcaacttatttctctaggacccctctctctagcagggagctattctttctttcacctattaaacttacgctctcttaaactcactctttgtvbgtccatatcctttatttccttggccatgagac

SEQ ID NO: 30605 - DNA, 433 bp, Homo sapiens
  misc_feature 90: k=g or t
  misc_feature 410: m=a or c
tactttccttgatgctgctacagccaaaggtatgatcaagtacaaattagtgttataggtgtcttaggtgatcttctttctttatatatkaaaataacatgtcttcatatatccagaaagctcctaatttatgaaataaatcttacatttatgttatttaggagcgcaagcaatcaaataaaacataatcattataatcccttggaggagagaatagtttacttctctgagaaacttcccatcttatataaatcagtagccatttactcagccactcatttctttagcagatatgtttattgggtacctattgtgtgcttaacagtgtgcatcgggctaagtataaagtgataaatacaactgaggtggttcctgttctaacagaaggtagatatttaacaactaaacamatatatcatttcaaattgtgata

SEQ ID NO: 30606 - DNA, 324 bp, Homo sapiens
attattttataaaacttctggctggatttaaatactaggcagtattccaagggatgataaaatgtttttacaaacttaattagacccatttttgtaattaaactttattatacatgtgctatgaggattaaactttgcctcataaaagtattctgacaggtgctttgcacagagtaagtccgccaaagtggacgttctcatatgtaattctgagcttactcatactggccaggaaggacgtgcacatgccacctttggcagctgtgatggggagcctgcctctgctcttgtgcatggaccttccacattctgtcctgtccaact

SEQ ID NO: 30607 - DNA, 407 bp, Homo sapiens
tactatataatttatactgtcatataaaatgctgtttgccacttacttagagctatgctaattttgcattgatggggagtgatagtttgtattgagccaggttcctagcttagggtgacagctgggctgctgcaagtccggcctgatagacatgctagctttatctcatggagccatagggtaacagatggctcattacttattcagcagtcattgaatgtgtgctgtgtgccaggcatttaaagatgaatcaaagtccctgccctcaagaggttgatagcctaatcccagccagaaagccctcatataaaattttagcttttgtcatatgcaaatagaaaggatcatgtgaaattcagtgaacttgttacatgattgttaagattcagtatttttataaggtggct

SEQ ID NO: 30608 - DNA, 305 bp, Homo sapiens
aaccactatatataaagaactaatcttttcttaaaaccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaac

SEQ ID NO: 30609 - DNA, 389 bp, Homo sapiens
  misc_feature 337: v=a or c or g
  misc_feature 338: d=a or g or t
ctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctvdtggcataatagtttacaaatggttttttcagtcctatccaaatttattgaa

SEQ ID NO: 30610 - DNA, 273 bp, Homo sapiens
gactcaactatccacactgccagtgtcttaaatcaactaagatgcagttctaaaagaaatatagctttttacctctccctttaaccctgtaaggtgtaagccccctaggatgaattatgtggcatagacaaggaagagaagttgaggatggaataggcttgtgttttgctgtgggcagtcgaaggagtgggctctggacctttgttcgggaattgagtgttttaggaagaattgcctatagaggtagctaagaagtggaaaaataaggtggca

SEQ ID NO: 30611 - DNA, 409 bp, Homo sapiens
tatattgtgactttttttaaaacaatgtaaataaaattctattgagtggctgcaccataatttattcagggaacccactatggttaggtaactaggttgttaccaatgttctcatgataaataattctatgatccttatacatcattaagtgcatcctgattatgtccagggtacgttattagaatagcataactggaccaaaaggaccagaacaatgaaaagctttttaaatttttaaatttttttttttattttttagacaagagtcttgctgtcaccaggctggagtgcagtggagtaatctcagctcactgctacttccacctcccaggttcaagtgattctcctgcctcagtctcccaagtagctgggactacaggcgtgcaccaccacttccagctaattttt

SEQ ID NO: 30612 - DNA, 302 bp, Homo sapiens
tttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtaaaaccatttcttaaaatacttaacagaattggcacatatgccactggctaaagtcacctggccacacaagcgtgtct

SEQ ID NO: 30613 - DNA, 259 bp, Homo sapiens
  misc_feature 144: n=a, g, c or t
tgatttattatctttcggagtgaataaattccatttactgatggctgagattactcactgtcatactacagaaatgagcagcattccagtttgtttcctatattaattttggggcattattgaaaagaaataatcattcgtttncctttctaccattgcgcataaatgccatttaaatgtggagaaatctcttccaccttaaaaaaaaagccctcctttgacactgagcctttctaccccattcttaccctctgcccat

SEQ ID NO: 30614 - DNA, 418 bp, Homo sapiens
  misc_feature 84: w=a or t
  misc_feature 309: n=a, g, c or t
  misc_feature 391: s=g or c
  misc_feature 393: k=g or t
ctctttctccattttctgcagtcaagagacaaaggaaatctcagtattcctgcaaaggctccaaactcagacatgccagatctwctgttataaaaaggaaaacagcagataaaaatctgctggcagagctgtaccagtattccaacttcaacagctccaagccaaacaagcttccgaatggcgtggacttctgtgacatggtgggcaacgtggtccgggctgagagagactgccttagtggcaaggtgaggaaaaagcagtgcctgccctgagtttgccaacccatggggcaaatgcagctgtcacccnttcacaccccaggagaaactgaggaactcacctagggccacaggcttgcaggtgtctgagctgagctaggaacctagcccasgktcactgcaaaactagattccttcta

SEQ ID NO: 30615 - DNA, 378 bp, Homo sapiens
  misc_feature 78: r=a or g
  misc_feature 79: m=a or c
  misc_feature 239: d=a or g or t
  misc_feature 255: r=a or g
  misc_feature 355: s=g or c
gtatgttgtaaaggctaccaacctggctcctgcagaccccaatggcaaagcagacccttacgtggtggtgagcgctgrmcgggagcggcaggacaccaaggaacgctacatccccaagcagctcaaccccatctttggagagatcctggagctaagcatctctctcccagctgagacggagctgacggtcgccgtatttgatcatgacctcgtgggttctgacgacctcatcggggagdcccacattgatctggraaaccgattctatagccaccacagagcaaactgtgggctggcctcccagtatgaagtgtgggtccagcagggcccacaggagccattctgagtttctggscaaacacattcaagctcacattc

SEQ ID NO: 30616 - DNA, 290 bp, Homo sapiens
ctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaaca

SEQ ID NO: 30617 - DNA, 309 bp, Homo sapiens
  misc_feature 109: n=a, g, c or t
gcttaggattgactggcaatgtgggctcttttttggttccatatgaactttaaagtagttttttccaattttgtgaagaaagtcattggtagcttgatggggatggcantgaatctataaattaccttgggcaatatggccattttcacaatgttgattcttcctacccatgagcatggaatgttcttccatttctttgtgtcctcttttatttcattgagcagtggtttgtagttctccttgaagaggtccttcacatcccttgtaagttggattcctaaggtattttattctctttgaagcaattgt

SEQ ID NO: 30618 - DNA, 191 bp, Homo sapiens
taaaatattttgaccatcttctcaagatcttgactcctacccccacttgtacacgtgcacatacttgtgcacactcacacacaatacccttccttaagtcctgctcaccagcttgcttcctattgcattgagagcattcaacctgtagaccaagaacttctaccatatttttccacctctaccccaaacac

SEQ ID NO: 30619 - DNA, 145 bp, Homo sapiens
acaacgccgacgactgtcaagagagttggggagtggaactgccggaagtgtctgcgcgccgtgagagaaactttcctgctccggccgcggcccggagcctcgccgcccccgcgttccgaacgacgatgcgtccagatgacaacgc

SEQ ID NO: 30620 - DNA, 65 bp, Homo sapiens
caaatatgtacatatccgatggaggttattgaagacccaggatttggtccttgatttgtaggatc

SEQ ID NO: 30621 - DNA, 354 bp, Homo sapiens
  misc_feature 313: r=a or g
  misc_feature 346: r=a or g
tgttaatgtcatttcagtgtcttggggtctcgttttcatctaatcctgtgtataatatgttaaaaaaaatttaagtgattctgtttgttatctttgaagcagatgtttgaatggtaaaacttataaagtctagctttttgtcatatgttttcaaaatttgatggtttaggataatgagttaatcaaaagtaaatgtgatctatactgtgtaagagttcaataacttttataggaggaatttataaatgggggagagtaggtaaatccttggatatattgtgattaaattggaaatgttcatgttttattatgrtaaatgtgtttttgatattttagctataagtgraaagtact

SEQ ID NO: 30622 - DNA, 321 bp, Homo sapiens
  misc_feature 234: k=g or t
taaaagaatttggccgggtgcggcagctcatgcctgtaatcccaacactttgggaggctgaggcaggcggatcacgaggtcaggagatcgagaccatcctggccaacacggtgaaacctcgtctccactaaaaataccaaaaaaattagctgggcatggtggcacacacctgtagtcccctgtagtcccagctactcgggaggctgaggcaggagaatcgtttgaacctgggakgtggaggttgcagtgagccaagatcatgtcactgcattccagcctgggcaacagaggaagactccgtctcaaaaaaaaaaaaggaaa

SEQ ID NO: 30623 - DNA, 326 bp, Homo sapiens
  misc_feature 184: r=a or g
  misc_feature 185: k=g or t
  misc_feature 303: w=a or t
cagatggttgtagatgtgtggtattatttctgagggctctgttctgttccattggtctatatctctgttttggtaccagtaccatactgttttggttaccgtacccttgtagtatagtttgaagtcaagtagcatgatgcctccagctttgttcttttggcttaggattgacttggtgatgtgrkctcttttttggttccatatgaacttgaaagtcgttttttccaattctgtgaagaaagtcattggtagcttgatggggatggcattgaatctataaattaccttgggcagtatggccawtttcatgatactgattcttccta

SEQ ID NO: 30624 - DNA, 309 bp, Homo sapiens
acaaccgaacccaacaccggggcccaacggcaggggcttgggcaggagcaaggtccgagggctgccaggtccacgctgcttttatgagctgtaacactcaccgcgaagatctgcagcttcactcctgagcccagcgagaccacgagcccaccgggaggaacaaacaactccagacgcgctgccttaagagctgtaacacttgccgtgaaggtctgcagcttcactcctgagccagcgagaccacgaacccaccagaaggaagaaactccgaacacatctcaacatcagaacggacagactccagacgaa

SEQ ID NO: 30625 - DNA, 270 bp, Homo sapiens
  misc_feature 47: s=g or c
  misc_feature 80: r=a or g
  misc_feature 98: m=a or c
  misc_feature 99: r=a or g
  misc_feature 126: m=a or c
  misc_feature 131: s=g or c
  misc_feature 140: w=a or t
tggagggaactagagacatggggaggcagtgagtgcagtaagcgtastgtgaaatgaaggggagaagatggtggtcccargctgcaagcccatggggmrgttttctaacagaccagggagggaagmatgasaggaaaaawagctaaagctctccccaaaggaggccaggcgcggtggctcacgcctgtaatcccagcactttgggaggccgaggcgggtggatcacaaagtcaggagatcgagagcacggtgaaaccccgtctctactaa

SEQ ID NO: 30626 - DNA, 78 bp, Homo sapiens
aaattgcattgtttccctgattgtcttattgggttgtagtcttcatctgtgttatgtgtcttcatctgtgttgtgtct

SEQ ID NO: 30627 - DNA, 121 bp, Homo sapiens
caggtagatgttgttctgtttctctttagagttgagaaaatagaaacagacaggttacgtaacttgctgaaagtgacacagccgatttgcgctaatcagtgtgacttcggaagctgcactt

SEQ ID NO: 30628 - DNA, 332 bp, Homo sapiens
  misc_feature 89: r=a or g
gtccgaaataaaaggaagaggaagacaagtgacgatggcggagattctcccgagcacgacactgacattcctgaggtaaaggtcaaagraaccagttgcggaactggaagaatggattctaatctgattctcacctctggcctggtctgctttttgtgttaagaagtaattttagtccttttgttttgctgtggattatttgaaaagtgaattatagtaatatggaatctgagagctaaaagcttggacacccactggtcagactgccccatcattttacagacaggcacagagagccgaggtcatgtatatagtttggaggctctagtcta

SEQ ID NO: 30629 - DNA, 182 bp, Homo sapiens
cagagtgggtggcagaaagagatcaaggacaaggccaggcacagtgcctcatgcctctgatcccagcactttgggaggctgaggcagggcagatcgcttgagggccaggagttcatgactagcctgtcagcatggcaaaacatcatctctaaaaataaagagagggagatcaagaacaatac

SEQ ID NO: 30630 - DNA, 133 bp, Homo sapiens
cactgagcccaggaggttgaagctgcagtgagccatgatcatgtcactgcactccagcttgggcagtagagcgagaccctgtctcaaaaaaagaaaaaaaatttaaaacttatattcttcagaaggcagccct

SEQ ID NO: 30631 - DNA, 328 bp, Homo sapiens
  misc_feature 84: y=c or t
  misc_feature 90: r=a or g
  misc_feature 93: h=a or c or t
  misc_feature 267: w=a or t
  misc_feature 275: w=a or t
ttgtaagtaacataaaactaatactgtataataaagattctgaaataatgaatctaggagtcttttttgaatgctatgtaatcyttgtgrtahtaagtcttttatgtattacatacttctttgctttggtaaacaaggttcttaaagataatttaacctttctttcatgacttaggcttaattattaaaatggccaattttcagaggctaatttgtgagaactgcatctcctaccctgagtggaagtaactgctttagtagtttgtwtgtttgtwttctctatccttcctcccaccctccttatcatcacagctcactgcaacctcaa

SEQ ID NO: 30632 - DNA, 213 bp, Homo sapiens
  misc_feature 96: k=g or t
attaatatctaccacattataatttaaaactgagaaaatttaaactattaattatttaaaaacaataggctgggcacgatggctcacgcctataakcccagcactttgggaggctgaggtgggaggatcacctgaggacagcagtttgagaccagcctgagcaacatggtgaaaccttgtctctacaaaaaatttaaaaaattagcccggcgt

SEQ ID NO: 30633 - DNA, 143 bp, Homo sapiens
cctctgaactggctactgaggttcatttttatggaaaaacaattccatggtttgtttctgatactactatacatgattttaattggttaatttgaacaggtaaaacacagtaatcataagtggatgtccaagtgtgggggctt

SEQ ID NO: 30634 - DNA, 317 bp, Homo sapiens
  misc_feature 84: w=a or t
  misc_feature 296: r=a or g
  misc_feature 302: r=a or g
aaggactggggagactgcccccgaattatatgtttaatgctgtcgcagtctatgtacttatgtacattaaaaattgtgggccawttaaatgcttttcatttgcattttatctttaagacacagacacttttataacatagattcattctcaaattacccaattatagtttctggatatggtttataaattttcctttgcctgacatcagttcaggaaagaacttgcgatatctgtaggactggagaagaacacattgacaagataatctttcaaaagatatctgaatataaatagrtaaagragctccatgataaga

SEQ ID NO: 30635 - DNA, 244 bp, Homo sapiens
  misc_feature 90: r=a or g
  misc_feature 95: d=a or g or t
  misc_feature 97: y=c or t
  misc_feature 103: r=a or g
  misc_feature 122: v=a or c or g
cactgtttttgacaaccaatgaaatagcgtctaaatatcttgtatattttttagcatcaaaatgttttggtttccactgctgacaggtgrcttgdtygtttarcctaatgtggatatttaavttgttaacataccaaacacacatggtaatagtttgggacaaaataactagtaaaatgttgatttctcggctatttcactgactgcggcatgtcctcgtgtcttctctgattttgtggtacat

SEQ ID NO: 30636 - DNA, 238 bp, Homo sapiens
  misc_feature 93: r=a or g
  misc_feature 169: w=a or t
  misc_feature 170: k=g or t
agtcctccaagttgtggtcggcgccatcatgacgccggcgactgtgttcaatagctcactgtgattgttgagaagtcaacacagggacaaggraaatctcagatggttgtctacagttacaagggggattgttggactgatttgtgatttttctgggaatgcaactcawkttagaagaggccattatctgaaagaagaagaagcaccagctgatgtgttggttattttagggcaactg

SEQ ID NO: 30637 - DNA, 270 bp, Homo sapiens
  misc_feature 94: m=a or c
atttttggtaaagatggggtagcttcagcatgttggccaggctggtcttgaattcctgagttcatgcgatccacccacctcacaaagtgcttgmcataacaggcatgacccagtgcacctggcttttctgaacttttttagcttatattaggtttgtctgttctagaattttgtatacatttatttatattataggacactttttagcttagctttccccactcggggttagaaagattatattgatccatgatcatgatgtcgattcgt

SEQ ID NO: 30638 - DNA, 134 bp, Homo sapiens
  misc_feature 82: y=c or t
  misc_feature 88: m=a or c
  misc_feature 89: y=c or t
  misc_feature 92: y=c or t
  misc_feature 93: d=a or g or t
aacaaaagcaaatgttgggttctatggaatcttttccatgtgcatgtatttgtatcctttcttgttcttgtgatcttgtgaygaagamytcydataactaaagcttggtttagattttttgttctgcttttttt

SEQ ID NO: 30639 - DNA, 310 bp, Homo sapiens
  misc_feature 109: s=g or c
catctatgttccctttcaatttagcaaaataaatgctacattaccatttaaacagatgtctaataaatgcatattggaacctattgcacaaaagcataaaaaatgctcsttcatccacataaaaacataccaattaaaagctactcaaagtaaaaagaagcttgcaaaacatctcacaatttcattttatatgcctgtaaataaagctggaccactgaaaccaaacaattggatgggaaaatatgatagaaggcttaaaatagaataaataattttataaagttaagttttcttttttaacccccccgaa

SEQ ID NO: 30640 - DNA, 304 bp, Homo sapiens
  misc_feature 150: n=a, g, c or t
accatcatttcacccatttaattcaatggtttttagtgtgttcacagagttgtgtaaccatccccatagtcaattaaaagacattttcaccaccttaaaaagaagccttgttaccctttagctattgcccctctttatacttccgtctcnctctccaacagctcctggcaaccactaatctactttctgtctctatatttgcctattctagacatttcaccactgtgatcatggaatacgtggtattttgagactggcttttttcactaagcataatgtttgcaaggttcatccatgtcatagc

SEQ ID NO: 30641 - DNA, 77 bp, Homo sapiens
  misc_feature 51: v=a or c or g
  misc_feature 69: r=a or g
cagcctggcaaacatggtgaaactgtgtctactaaaaatacaaaaattagvcagttgtcttggcgcatrgctataat

SEQ ID NO: 30642 - DNA, 56 bp, Homo sapiens
taagtgatcctcccacctcagccacctgagtagctgggaacacagacacacatcat

SEQ ID NO: 30643 - DNA, 156 bp, Homo sapiens
  misc_feature 63: s=g or c
  misc_feature 111: m=a or c
  misc_feature 112: b=c or g or t
  misc_feature 116: w=a or t
  misc_feature 121: k=g or t
  misc_feature 143: k=g or t
cactcattggacactggtgtagcaaataatccatctatagaaacacttggtgaatagattgasaccaagttataagatttctacctaggccacctgatcatcaatgactgmbtttwaactktctcccagtcttagtcagtatkattctctctctct

SEQ ID NO: 30644 - DNA, 225 bp, Homo sapiens
  misc_feature 111: d=a or g or t
  misc_feature 114: w=a or t
  misc_feature 126: k=g or t
  misc_feature 128: n=a, g, c or t
  misc_feature 169: k=g or t
catatatatataatttttttctgcatactaataatagttttcaagaatacaagaggtgatgggataaaatatctataatcattcatttgctttatccaacaattcacattdtawtagtcttaagakancaaaactcaccccaacagaagagtttgtaaatgtctgtatkatatgtttttcccaattttgcactatgtctacattgtcagagcatatagccagagg

SEQ ID NO: 30645 - DNA, 325 bp, Homo sapiens
  misc_feature 15: b=c or g or t
  misc_feature 77: r=a or g
  misc_feature 97: m=a or c
  misc_feature 122: k=g or t
  misc_feature 144: s=g or c
  misc_feature 148: s=g or c
  misc_feature 167: m=a or c
  misc_feature 270: s=g or c
  misc_feature 320: r=a or g
cttccttgtaagatbgcggcgcccaggtggagcgcgtcgggcccctggatccggggaaacggccaaggttgcgggartctcttcactctcgtctcamagccattttgtgcccgcttgccgckgcctctacggccataaatgccsggasattagcggagaagctccgmgcccagaaacgggaacaagacacaaagaaggagccggtgtccacaaacgctgttcagcggagagtgcaagaaatagtgcggttcacacggcagctgcagcgastccaccccaacgtgcttgctaaggcactgacccgacgaattctccaccargacaa

SEQ ID NO: 30646 - DNA, 393 bp, Homo sapiens
  misc_feature 94: r=a or g
  misc_feature 361: m=a or c
  misc_feature 362: n=a, g, c or t
catcatgttgttattattgaaggctagtagtgagcccagcaattatgttcagcagacagaccatttgggaatctctttcccatgcattcatagrtaatgtggagtggagttgggcttaaaccagctaagtgccagtttttaagtgggaacactgctatgggcgttggtccatgatcaaacggctggcatgactcatcatagtcacgaacagttattagccagccatggctgtggttgcttgccttagcagtcctgtgttagcattgctttactctgggcacatttttcttattctctattctgggatagaagtagtttctgacttctagccacgttcagtccaggctggagagatctacamntgtttctaggattctcgttttcaaggtttct

SEQ ID NO: 30647 - DNA, 422 bp, Homo sapiens
  misc_feature 135: k=g or t
  misc_feature 136: d=a or g or t
  misc_feature 317: k=g or t
aagaacttggaagtttgatttatagaacctcatcccttctgcttttaaggcaatccagtgtacaaggttggtcttcctgcaaaatctggagttgctgggggcattcttttaggttgtccccaatgttatgggtakdatgtgctggtctcctcctctggataagatgggcaacagtgttaagggaattcacttttgtcacgatcttgtttctctgtgtaatttccataactatgataatttgagacactttgcaaaaaacttgatcctcgaagagaaggtggtgatcaaagggtaaagtcagtgataaatcttttgtktgctgcatatactggagatgtgtctgcacttcgaagatttgctttgtcagctatggacatggaacagcgggactatgattctagaacagcactcatgtagctgct

SEQ ID NO: 30648 - DNA, 269 bp, Homo sapiens
tgggaattgtgcatctataaatgtgtgtgcaaatatctttttcatacgacttcttttcctctgggtagatactaggagtgggattgctggatcaaatagtagtcctactttttagaaatctccaggccgggtgcagtggctcacgcctgtaatcccagcactttgggaggctgaggcgggtggatcacgagttcaggaaatcgagaccatcctggctcacacggtgaaaccccgtctctactaaaaatacaaaaaaattaggggggtac

SEQ ID NO: 30649 - DNA, 253 bp, Homo sapiens
tctgggctctctttgcttctctgcaaactgaggataataaaacagtgcctacatcataggcttgccaggaggattcaatgaaatgatgcatgtaaagggcttagcaggccggggcggcggtgtctcgcgcctgtaatcccagcactttgggaggccgaggtgagcggatcacttgaggtcgggagttcgagactagcctggccaacatggggaaaccctgtctttactaaaaatgtaaagattggctgggccc

SEQ ID NO: 30650 - DNA, 244 bp, Homo sapiens
  misc_feature 88: s=g or c
  misc_feature 92: k=g or t
  misc_feature 109: r=a or g
  misc_feature 110: m=a or c
  misc_feature 131: r=a or g
  misc_feature 136: r=a or g
  misc_feature 160: r=a or g
  misc_feature 161: m=a or c
  misc_feature 162: r=a or g
ccccttcaagtactataatttccatgatttctagctcccagaatatttggtttctgcctttaaatgaaccttatttctctatacatasaggktgagtcccctatctgarmactcacaatttgaaatgcttrcctgrgcattttctttgagagtcatgtcrmrttaatactaaaaaaatttcagattttggagcattttggattttgaattttccaattaaggatactcaacctgcgttatgaca

SEQ ID NO: 30651 - DNA, 379 bp, Homo sapiens
  misc_feature 71: w=a or t
  misc_feature 343: v=a or c or g
caaattgagagacaaagctggaaacaccacagaatccaaaatcaatcatgaacccaccacatttcagaagwatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattctttgcccagagttgcagttgtaactgttgccaggacacatggccataaataatagvaagaaagctacaaccacaggctgtttgaaagcttca

SEQ ID NO: 30652 - DNA, 329 bp, Homo sapiens
  misc_feature 241: n=a, g, c or t
agaactccatctcgggaaccatggtttgccctggagagcttagcactgggctgagcacaccgtgtgggaattcaacgtgctaaaatgcagaacctgatgcccagcaaaggggaaaggatagcaggagccttgatccacccaggaagaggtgccagctggatcagcaagaggctggtggagaacaagaagctgctatgaaccaatctttagaaaacagcaggatctccgaggagagaaagantttctctccagccaaaagcttcatgagatggaaggggatatcctatctcctatattgtatcctcatcatggtctcaataaacccacgt

SEQ ID NO: 30653 - DNA, 324 bp, Homo sapiens
  misc_feature 248: n=a, g, c or t
  misc_feature 307: k=g or t
ttcttttttttgttatttagttttttcttttcttttttttgagatggagtctcgctctgtcacccaggctgaagtgcagtggcgccatctcggctcactgcaagctccgcctcctgggttcacgccattctcctgcatcagcctcccgagtagctgggactacaggcacccgccaccagacccggctaatttttttgtatttttagtagagatggggtttcaccgtgttagccaggatggtctcgatntcctgacctcgtgatccgcctgcgtcggcctcccaaagtgctgggattacaggcgtgakccaccgcgcccgggccg

SEQ ID NO: 30654 - DNA, 146 bp, Homo sapiens
atacttaagttatgtgcaggggtgggtatgctcgtttctctcaatttgaaacacaagaattacactaatagtaacaggccttgagcacaaaatttggtcaagaaatgagtctgtttgaaatgcttagttggtgaaacccagaccgt

SEQ ID NO: 30655 - DNA, 146 bp, Homo sapiens
  misc_feature 96: k=g or t
aatgaaggatgggaagaaattaaaatagtcttcaaacttcttccttattatatttggttgctttggaaaagattggtcctatcctcaatctaattkattcactattaatattttaaaacattcctgagatacttaaaaagacccac

SEQ ID NO: 30656 - DNA, 252 bp, Homo sapiens
  misc_feature 87: m=a or c
agaaagaaaatgacattattttgaatggtactttgtggaaagaggggagaataaagttatgctgtgtacatcacttgcagatcaccmaaaaacactccgctgcccgtgaccgccggtgggtgtgtccccgctcccgtcgtcccgcccacctcaaacccctcaggtgtgcctcccagcggattatttattgtagaaagtgtattcatttgctttataatgaaaaatacatttgcaaaggtatattgatatgct

SEQ ID NO: 30657 - DNA, 181 bp, Homo sapiens
tattttggacaacataattcttttttttgtgggtgttggggggcgggtggtggcagagagcagagtctcactcttgttcagactggaagtgccatggcgtgatcttggctcactgtgacctctgcctcccagtagctgggtaacctcctgagtagctgggattacaggcatgcaccaccac

SEQ ID NO: 30658 - DNA, 317 bp, Homo sapiens
gtagttgtgtccttaacatttaggaatgacatagcctctggagtctacaaactgaagaaactttcatctgatcagccttggaaatccaaagttaaagagcctatgtgtctcttgaggcgggggttagaggattcaaatttgggatgatgctcattgattcctgaccatagcagtgagaggccattttttgtgcaggaaatgtgcttaggactcagtcttgttttcgattatccaccacagaaaccctgagacacagagcagcttagaagtctctacccaggcgtaaatagagctccctactccagaccacctgcccc

SEQ ID NO: 30659 - DNA, 122 bp, Homo sapiens
ctacatgcttcctgctgtggctgtctcggaacccgtggtcctccgcttcattctgccgagttcctgggattgcaggtgcgcgccgccactcctgactggtttttgtattttttggtggagac

SEQ ID NO: 30660 - DNA, 380 bp, Homo sapiens
tatatttttatgtgtatataaatatgcacgtagatgtatacatgtatagaaaaagcctggaaaaatgcacctgaaacttttacagtgatcttctgggttgggagtgacaaaagggccttaccctttttgtaatggtttccttttgtataacagaatgtaccatgtattacttatgtaaaaaattttaccctcacactgtatttactcttacaattggcgtacagtattttattgtatagatggtcattatttattcagtctgttaataatggtcatttaagtttttctccagttgacaactctaaataacattgagataaatgtagatatatcgttgtacatttgccttggtttttcccatgggataagttctggaaaat

SEQ ID NO: 30661 - DNA, 383 bp, Homo sapiens
  misc_feature 78: m=a or c
  misc_feature 84: b=c or g or t
  misc_feature 337: r=a or g
  misc_feature 342: m=a or c
  misc_feature 348: w=a or t
ttgaaggtgtttttgtatatagatttagattttgatgtttactgtagagcaacattaaacctaaagtccctggctcamtgtggbcacaagtagagtatacatgttggctgactttattattcagaatttagttaaattttagatattttagtaatatagattagagtaaaaaggaaaataaccattctctaacatcctctcgacttaaactttttattaggttttcataagtttcctttttgatattaaagtaactgtagaatatctctgcataggccataatgccttaagctttaccaacccaaaagttgtttgtatctctgcatcttttaattaratgamacatawaatttaagggctttgggatttccaaagagcgctca

SEQ ID NO: 30662 - DNA, 57 bp, Homo sapiens
caatgagccagtgcggcagttggctattttctgtccccatgtggcactccacacaac

SEQ ID NO: 30663 - DNA, 407 bp, Homo sapiens
  misc_feature 73: b=c or g or t
  misc_feature 81: m=a or c
  misc_feature 161: s=g or c
  misc_feature 163: n=a, g, c or t
  misc_feature 217: b=c or g or t
  misc_feature 235: r=a or g
  misc_feature 236: r=a or g
atgtaaatttcaggtccatcgcatcaatgcatgaaatattagaaaaccaaattccaaagaatcaggaatttcbatttccamccaaaagtatactttattatcttctagcagttgtctgttaatataaaagcagcaaaatctcagctacttatataattttstncttttatttgaaagttacacttagagattaataatatgtacagagaagcttttbctgcctactctgtttatrrctctgtccaacttgcccacaaacactgccctccttcaacccatctgatgtgggcaaagccactgttttcttaggcccataactcagtgcagctgttttatttttataatgccggtcaacctttttgtgtgtgtgtgtgtgtgtgtgtgtgtgtgtgtgtgtgtgtgtgtgt

SEQ ID NO: 30664 - DNA, 364 bp, Homo sapiens
  misc_feature 182: s=g or c
  misc_feature 346: m=a or c
tatatatatcatattgcatagtgttgactttttgtcagtttaatcgaccagggcagcagctttccccaagccctcttaatccctgagctatgtctcctccaaccgtgcctccgatgggggtagatggcgtgtccgcatacctgatgaagaaaaggcacacccacaggaagcaacggcgcaasccactttcctcactcgtaggaacatcgtgggctgccgcattcaacacggctggaaggaaggcaacgagccagtggagcagtggaagggtactgtgctcgagcaggtttccgtgaagcccactctttacatcattaaatatgatggcaaagatagtgtgtatggmctagaactgcaccgcctc

SEQ ID NO: 30665 - DNA, 281 bp, Homo sapiens
  misc_feature 72: w=a or t
  misc_feature 82: w=a or t
  misc_feature 99: m=a or c
caggtagatcatggcaaccatagaagaaattgcacatcaaattattgaacaacagatgggagaggtatgtcwagtttacggwtgatgcactggcccacmaaacttttctaattcctactaaatgcatataccaggttctggagttccagaaataaaagatattccctaacttaagatagcttttcaagctactgagagatagttgaataatcagacaattcatagtagaatgtggtaagttctgtgacaggtcattgtatcaggtgcaatgggagcacaga

SEQ ID NO: 30666 - DNA, 271 bp, Homo sapiens
tgtattttatttatttatttatttatttatttttgagacagagtttcgctcttgttgtccaggctgcagtggtacaatctctgctcactgcaccctccacctccctggttcaagtgattctcctacctcagcctcccaagtagctgggattacaggcatgtgccaccacgcctggctaattttgtatttttagtagagatggggtttcaccatgttggtcaggttggtctcaaactcctgacctcaggtgatccacccaccttggcccccc

SEQ ID NO: 30667 - DNA, 56 bp, Homo sapiens
caactttctactcgcccttgatctacctgtaatgtaaatcaatctctcacacaaca

SEQ ID NO: 30668 - DNA, 262 bp, Homo sapiens
  misc_feature 71: v=a or c or g
gaaaaactcaaagaaaggaatggggaggaatggaaacgtaacaggacatgttgcctcagtgagtcaccaavggctttggagttcttagcccaaaatgtggttctgtggaggctgaggacaaacttcaggacagagcatgccttaatcgatgtgctaagccactggctcgggcagtccttaagcaagggctcctctgatcagacaaggaattgtttccttcccttttactccagatgacacctaaaggtgcaaaagaaaacca

SEQ ID NO: 30669 - DNA, 190 bp, Homo sapiens
cttactaagtgcccccctatgtgtgtggctaataataagggaattcaaggtggaaggcactcacatgtattaaataatggtagtcactacatcaggcaattttgatacatgtttttggacttctggtgaggaaaatgcatcatgattaaaacctttcctggattcgggacagtctttttttttttttttt

SEQ ID NO: 30670 - DNA, 349 bp, Homo sapiens
  misc_feature 236: r=a or g
gtacagtgtaaaccacatctcagtcttcctagaattgcttcgttggctctatatttagaatggtagtttatattaatatcaaataaactgttaaaaagctggtttcaaattttatttcttgagtggaagagaatttgtgaccacagctgcataaaaagtcagtatttccttctaataaaatttttaatttcagttgcctcttcatgctttcaggtttcatggactgtaaccttgaratgatcccattaacagccttttccttgggctcttaatctcctcaattttatgccattccaaaatagaagtctctctgatgatcaagcctttcaatctttacagatggctcttt

SEQ ID NO: 30671 - DNA, 278 bp, Homo sapiens
actggaagcagccgcagccacagccttggtgaggagcaaccgcagccctgccagctccctcccagttctcattgagaaaaggggagacggagcaggaggagggggaggagatgctccctgcaaagctgcctccccccacagatccaaagagcctcttggaatgggcactcgactgttctgacgttgtgattctctcgggagtttgaagacagaaaggaaaggggagaaacctgcagagagcatcaaaggatggggggtgctataaaagaagcaggggt

SEQ ID NO: 30672 - DNA, 336 bp, Homo sapiens
aaggtacaggtaacaagtttagaaaccaatttgtgaaatgctaccgatctatatctacatattttcagtgaggaggaccctctactaggagcaggctgtatgcattgcctctgggttgcaatttgatgataccaaagctgggaaggtaagagaaatggttgagaacaggattctggagggactgctgaatggtttgctgaatgttggtagaatggtcaggtacaaaaccagcaagctcgtgctgccatagaacttgatgtgaggccgagcgcagtggctcatcctgtaatcccagcattttggggaggccgaagtgggcacatcactggagacaag

SEQ ID NO: 30673 - DNA, 428 bp, Homo sapiens
  misc_feature 263: w=a or t
taagaatctagtacgtttgtcaccaaagtttcttaaggaggaatttcttgacaaagccataaaaactgagctttcttgaagggtaagggatttggagtgtggtaggggagaagaaccaggcattatccaaaacttaaaaatgggtgtgggtgtgggtgtgtgtgtgcgcgcgcacgcacgtgtatttatttatgtttatggtcatgcattcctatttagtcttcttgagttaccatttgtaatcagactagggtcctgggaawgttttttgcacatcatttagtacatatgaatgtgagctgtgtttactttacaaataggttatatttcaaaacgtgattctgggctgggcgtagtggctcacacctgtaatcctagcatgttgggagtccaaggctggcagatcgcttgaggctaggtgttcgaga

SEQ ID NO: 30674 - DNA, 323 bp, Homo sapiens
  misc_feature 37: s=g or c
  misc_feature 229: d=a or g or t
  misc_feature 276: k=g or t
  misc_feature 319: y=c or t
gtcacgagaggagcggaggcgaggggtgaacgcggasactccaatcggtctgtcattgtttctattggcacaatgggaggccccgcccctcacggcggactcatcgcatgggggagggggctccgcgggttgccggctaaccgtgagagagtccgggaggtacactatacggaccggcctccaaaggcggaatcgataacgagctgcagcgccgggtgcagaggacgcdggcatcccgaagcccaggaagagctcccaactagaggtccacccaakacccagagacctggatttgaggctgctgggcggcagatggagygacc

SEQ ID NO: 30675 - DNA, 122 bp, Homo sapiens
  misc_feature 86: r=a or g
  misc_feature 89: r=a or g
  misc_feature 94: v=a or c or g
  misc_feature 97: r=a or g
tagaggtcaacctttcaaaattctttattttaaaggtaggagaactgaagccaaaaagagggagttacttgcccaagatcacaggrggrtgggvtaraagaatggttaccacgggacggggg

SEQ ID NO: 30676 - DNA, 270 bp, Homo sapiens
  misc_feature 211: k=g or t
ttttcctttcttttagatgtttctgactgcctaatgtaaacatttctcagcaatttatattagaccctgaagtttttctctgatatggtcagttctatttattgtatgatgatactacatatgaaagcactgttttctgttctgccgattaacctagtctttccagcaaactttctccatacgacgatcacaatttaaaattttctttcckattattataaatgtcacagtcccaatgatgtctttcagactttgaactaaaagcagcta

SEQ ID NO: 30677 - DNA, 395 bp, Homo sapiens
  misc_feature 87: r=a or g
  misc_feature 164: d=a or g or t
  misc_feature 238: y=c or t
  misc_feature 239: n=a, g, c or t
  misc_feature 360: m=a or c
tgtaggatcttagtccaatcagagcagatatttggtgtagggcattttctaatgtagtaccaataaattagacgcatacctcaaccraaaaaacagcccatatccagtaagtaataaggcaatgatttacatttcacatattaccagagtaatgactaatagcdtacatgtataaactgaaaagtgactgatgcttattttcagatgggtccaaatttattggataattatggagaaynatgtatgttttctgagagttggtagtaagaaaatattgccattgctggccaggcacagtggctcacacctataatcccagcattttgggagacttgaggtcaggagttcatgaccagccamctcagcctcccaagtaactagaactactggtgcat

SEQ ID NO: 30678 - DNA, 343 bp, Homo sapiens
tgctctattaacattaaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaga

SEQ ID NO: 30679 - DNA, 254 bp, Homo sapiens
cccgctaaagcaccccctaaaaccccttcatcactttcattctcagcaaaaagtaattgagcacctcctctaggcgctggggagtccacactgaacaaaagaaacagaaaaccctgtcttccagcagttgagttctagggcagggagacagagtttacaagataaggaaaatatatatgtagtatgctgcaagttaactgctgtgtgggaaatccagcagggggtgggatgtgtgatttgaattgagggcctct

SEQ ID NO: 30680 - DNA, 335 bp, Homo sapiens
  misc_feature 87: s=g or c
tagttatatgtgctgtaatgttgctctgaggaagcccctggaaagtctatcccaacatatccacatcttatattccacaaattaagsctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcggtca

SEQ ID NO: 30681 - DNA, 436 bp, Homo sapiens
  misc_feature 396: n=a, g, c or t
attgaaggatataaatacaaatagcaatgcaaatattcatgtatgtaccacctagcttcatgtgtagaacatcagtgattttcttttaaaaaagctctgtggatggttcccatttcttcttcagcattcaaagatcacgattaccctgaatggcatcttctcttctcttgcttttttcaatagtttaatgatatttgatgagtccctaaatgttagatcatttagctctgtgtgctttttaagtttctacatgtgaaaccaaactacatgtatatatttgtaacataatttttttttgctcactcaaaaatattttttatatattttttaatattcacaaatatctatacctaagagtgtgtttctagtgttctgaaaaattctcaggtactatgngttcaaaagttacattcctcattccagaattcctcatcct

SEQ ID NO: 30682 - DNA, 138 bp, Homo sapiens
  misc_feature 112: k=g or t
cataatacagtagtccccgttatctgtggtgatatgttctaagacccccagtggatgcctgaaaccagctatagtactgaaccatatatgtgtgtgtgtgtgtgtgtgtgtktttttttccccccccttttttttttt

SEQ ID NO: 30683 - DNA, 202 bp, Homo sapiens
  misc_feature 133: s=g or c
gcacgtccgggcgtccagttcggggcagcttctccggctggtgggtgggtggggcagcctttcaggcagggtggcaaccaactatatcctgaggaccagagccattttggggcaccagagcttgtgacctctscatctccacccagctgggtccaggggccactctcagcactcacctcagcagctgacatcataaagcggc

SEQ ID NO: 30684 - DNA, 156 bp, Homo sapiens
  misc_feature 84: s=g or c
  misc_feature 85: r=a or g
caattgaaagaaactttggagaataactctttcctcatcaccactgtaaacaaaaccctccaggcgtataatggctatgtcacsraatctgcagcaagataccagcgtgctccagggcaatctgcagaaccaaatgtattctcataatgtggtcaa

SEQ ID NO: 30685 - DNA, 300 bp, Homo sapiens
  misc_feature 85: r=a or g
gaatttcttacagactgccaaatggaacagacaagcaggttgtcttgtgttaaagaaaatgagatataagtcagttactcccggraggcaatgctgctgttcagctcttctgtttttgtggccagggtcttcatgaacactaataggggtaccaggccctcttcctcgttagaagaaatcaggataacaaaggcatattgggcacccctacaaaaggaatctgtatctgtatcaagatgatctgaagaacagcttctacctttaggaatgtctagtgttccaaaatgactagcatcatcc

SEQ ID NO: 30686 - DNA, 209 bp, Homo sapiens
  misc_feature 87: k=g or t
gggaaacaagattcgtggttgccaggtcttgggactgaagggaaggagaatgtggctataaagggagccttgtggtggaaaagttckgtagtttgattgtggtgattacataaatatacatgtgaaatgttagaagtatttatagctgaaacatattagtatgttggtatatacatatttctgactaattaatttcgccatgttgccca

SEQ ID NO: 30687 - DNA, 336 bp, Homo sapiens
cttggcttatgttagtttatgttagtttattatgaaaacatcaaagatttttttgactatattatcagttaaacaaaaaggagtcagattttaatttgttttttgaagcactttgagaaattaattttaattaacttaatgagcaaatttttattactactttatgttcaataccaggttcttttcatttctctggattattttgcaaatcattggacagagaatttgggaatataaatctgtaacaggtgtttgacaccagtaggtctctttatttctgggaaatgtgtacctgtactttctgatatacagtgttcctaagtaaaaatcaattca

SEQ ID NO: 30688 - DNA, 326 bp, Homo sapiens
  misc_feature 88: w=a or t
aatgcaaatgtgggaattgagattacatggctataataagattgccctccggatggcctaggatatgcctacattattatatattaawttttaaaaatcatcataaaaagaaaaaaagaaatagtttctaaatctcagacagaccactggggaaaatgtccctggacttcagttaggaaagctttggataactttacccattttaacacctcacttagcagagactgtgccatcttggtaagacttgggagttcctgccttgaactgattatttagagggggtattccctgctatggtctatgcactccaactattatatgcggag

SEQ ID NO: 30689 - DNA, 285 bp, Homo sapiens
  misc_feature 86: k=g or t
  misc_feature 90: s=g or c
acactttctatattttaaccataatatgtaatctgtaaatatttattgaaggaagtagtcatctgggaattgaggaacattatttkgagsttcaaaataccattgaaaatcttttagggtattgtgaaatttgggaggccaatttgtcgagaatacaaaatagacttaaatacagtaacaaggccaggtatagtggctcacatctctaataggaggctgaggcaggaggattgcttgagctcaggagttcgacaccagcctgggcaggcaagttagagagacccc

SEQ ID NO: 30690 - DNA, 392 bp, Homo sapiens
  misc_feature 87: m=a or c
  misc_feature 336: r=a or g
  misc_feature 346: n=a, g, c or t
  misc_feature 347: s=g or c
aggtattatactcttacaagtgattatgactttctaggcttattttattatttattgatttattttgagacagagtctcgctctgamacccaggctggagtgcagtggcaggagctcaactcactgcagcctccacctcccgggctcaagagatcttctcgcctcagcctcccaagtggctggaattacaggagcccaccactgcgcccggctagtttttgtattgttagtaaagacggggtttccccatgttggcctggctggtctcgaactcctgacctcaggtgatccgcccgcctcagcctcccagagtcctgggattacaggtatcagccrctatggccgnsctttattttagttttacataactttgcagcaactgtgaatatgta

SEQ ID NO: 30691 - DNA, 209 bp, Homo sapiens
  misc_feature 90: r=a or g
  misc_feature 93: s=g or c
tttttctccggtacagcctgggaacgtaggtcccgcgcctgtgataagtaaggttggattttctcttccctgaggtgaaggatgcccggragscctcggcaggaccgcgcggaaacgggccttctgcccaaaagatgctgcttctctccttattctttcccctcagaatctcgctgtctccttccaaccacctgtggtcggcatcctcc

SEQ ID NO: 30692 - DNA, 269 bp, Homo sapiens
  misc_feature 216: n=a, g, c or t
tcctccatagctatatccatttcctgggacatgggttggcccaagagggaatgagaaggacctgcgattgcacaggaaattctggggcacatttaacgttaaatcattaagcttctgccaataaatccattactgttaattacactgagatggccaacgatctgctgacaatattccttcattgattttcattctcagtgaatcgatgttctggcntggctctctttggtgttttcattctttcatttctttctccctgtcctcatcac

SEQ ID NO: 30693 - DNA, 292 bp, Homo sapiens
ctcttatctaggaatgtgggtgccggcaggacaggcgattggtaagtccttgtttatagagcaaaggcggggacagaagccacatggcaggctgactcgccaggtgtcctggggcagccggcaaagcctggttcccgtgtcctgagtgctggagaggaagagagggtgaggggcctgctagggcccctggcaggcctgggtctaactgtggccagtctgtgttgtccagcgctctctgtccatcacccccgtactgtgtgtttcaggtggctatggaccgcccctgcaggaa

SEQ ID NO: 30694 - DNA, 101 bp, Homo sapiens
tagaattactctgaggagcttttaaaatagattcctggagcctacccctggaaaattgtctcgctggatctcgagaggggcctgagagttctggctttttt

SEQ ID NO: 30695 - DNA, 389 bp, Homo sapiens
  misc_feature 2: d=a or g or t
  misc_feature 21: w=a or t
  misc_feature 22: n=a, g, c or t
  misc_feature 43: w=a or t
  misc_feature 44: n=a, g, c or t
  misc_feature 45: w=a or t
  misc_feature 66: r=a or g
  misc_feature 74: b=c or g or t
  misc_feature 75: n=a, g, c or t
  misc_feature 76: b=c or g or t
  misc_feature 83: h=a or c or t
  misc_feature 98: m=a or c
  misc_feature 111: k=g or t
  misc_feature 132: k=g or t
  misc_feature 159: m=a or c
  misc_feature 163: b=c or g or t
  misc_feature 171: r=a or g
  misc_feature 183: k=g or t
  misc_feature 224: b=c or g or t
  misc_feature 225: k=g or t
  misc_feature 336: k=g or t
  misc_feature 373: v=a or c or g
  misc_feature 378: k=g or t
cdttggtaaggggacaatacwnttaacatgtaaataaaatatwnwgtattgcacataataatatarctatgggbnbaattgahagggaagtgctaagmcagtgtttgggtkggaggtcatcttggttcattktctgttgcgtgtaacaggattcctgamactbggcaagaraaggaatttatktcttacaattatggaggctgagaagtccatggtcaaggggbkgcatctggtgagagccttcttgctggcagggactctgtgcagagccctgaggcagcacaggccatcacatggcaagtaggctaagtgtgctagttcaggtttctcttcctkttataaagcctacccagtctcactccatgataagtavtagtkcatgtacccat

SEQ ID NO: 30696 - DNA, 221 bp, Homo sapiens
tgatttcactgatcaagtgcaagggtgaaaggtcatggcttatttagggaataataagatgttcagtatgactggccacagagtatgttaaaagtcacatcatgggacattattacaaactagtctaggcctctctgccagttatgccaaatgaaaatgttctaggcctttttaaaacaagtaattaacacttatctgcttgcggcacagcaccaaggcct

SEQ ID NO: 30697 - DNA, 284 bp, Homo sapiens
caagaaaagaggaaaagtaaaccctcatggagtgggtagaggtgagtggggttaactcttgggataatggaaaggagaggtagttgacagttactcttccccgaaaatattctgacatcttgatttgcaaggctgaaatatagtgtaccaacttatgttgtagcttctattaaagtggtttgaaaaatagatccagttttgcttaagataaagctagagtctattagaattaagagtatgctgttatagaaaacagtagttattttaatgaagaacaagccagt

SEQ ID NO: 30698 - DNA, 292 bp, Homo sapiens
  misc_feature 169: k=g or t
  misc_feature 245: r=a or g
  misc_feature 278: s=g or c
tttatacacacacacacacacacactcatattcattacatgtgtgtactttctggttgcttcagtaggacttttctaggcttctttggactatgtgtgatattttacttcagggactgaatttcacaactgcctactatgcaactttgtgattttcttgaaagcacaaktactatatataaatgaaaatgtccaccccctccccgctttctaaaaaagtgctcagaaaccaggtctcaagattgrttgcgttgctttccccatacgctttcactctgsctcgtcttgcctca

SEQ ID NO: 30699 - DNA, 122 bp, Homo sapiens
accccctttcctccacagagcccttctccctggtttcacacattcccatgcatcctgatccttaagattatgctccagtgggagaccctggtaggcacaaagcttgtgccttgactggaccc

SEQ ID NO: 30700 - DNA, 327 bp, Homo sapiens
tttaaacaaagatatacaactagccattaacacatgaatatgatgctcagtgtctgtgatgattaattttatgtatcaagttgactaagtaagctatggtgcccagatgtttggtcaaacatcagtctagatggtggtttttagatgtgactaacatttaaatcagtaggctttgagtaaagcagattaccctctataatatggatgggccttagccaatcagttaaaggccttaagagagaaaagactgacgtcccctgaagaagaaagaactgtctccagactgccttgggacttgagctgcaacaactcttccctgggcctgca

SEQ ID NO: 30701 - DNA, 344 bp, Homo sapiens
ttatcttaacatttttaagtgtacaattcattagtgtaaattgtattcatattatgcaacagatctatagaacttttcatctcacagcactgaaaatctataccagttagatactatttcctcccccctcctcccagcccctggtaactacctttctaaattttgttcctataattttgactactttagatacttcatgagtagactcttacagtatttgcccttttgtgatttgcttatttcacttagcataatgttctcgaggttgattaatgtcgtgccatgtggcaggattttcttctttttaaaggctgcataatattgcattgtctgtgtacagcttt

SEQ ID NO: 30702 - DNA, 263 bp, Homo sapiens
attcattactcacggctagatcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccc

SEQ ID NO: 30703 - DNA, 208 bp, Homo sapiens
taaattctgggacacatacaccctcccaagactaaaccaggaagaagttgaatctctgaatagaccaataacaggctctgaaattgaggcaataattaatagcttgccaaccaaaaaaagtctaggaccagatggattcacagccaaattctaccagaggtacaaagaggagctggtaccatcccttctgaaactattccaatcaata

SEQ ID NO: 30704 - DNA, 127 bp, Homo sapiens
ctggactctaatttagtttaattcactccaggatggcacgcaggattcctaattcttaaatgccattcagtctggacttcaaatcacttgtcttcagaaaataaaagatttgttccacccgggagta

SEQ ID NO: 30705 - DNA, 168 bp, Homo sapiens
caagagccctgctcctggagctgagaactgcagcgcggaggcttcggagcgagccggggcagtcggggtgaggatctcctttagaagaggagaagccttgcatcaacctcttgggcctcagccaagatgtctgagataccgtccactatagtctccaagaacatgacc

SEQ ID NO: 30706 - DNA, 53 bp, Homo sapiens
tttcctgcagggccagtttcttacacttttttcttctctctctttgtctctgt

SEQ ID NO: 30707 - DNA, 72 bp, Homo sapiens
cagataacaggccctaaaaaaatgaaaatattttaccccgaaatacatttctttgacctttttttttttttt

SEQ ID NO: 30708 - DNA, 281 bp, Homo sapiens
tttgaaaatagaagttggaatgtctttgtcctccttggagttgagcatcagtactaaatgctatttcttccattgtgttggactggtcatgctgtattttgatcatttattgtcaatacctcgtctatagttaggtttgcaatttattgaatagatacctaagtacatgcattaatgaatcaatgaaagaagctaaaaggatgagaaagacaaggcatcttagaaatggagactacttagttagaaccttctccaattccttcttttcacaagtgagggac

SEQ ID NO: 30709 - DNA, 263 bp, Homo sapiens
cttaatttcaaagaggaaaagattgaggtactcactggaaacttttgtgttggtgtataattttaattcaaacagaaagatgtgtaagaatatcttagtagctccctttcctaggagttgttctgtccacctgtagacctataagcttctgagctccaggagaccattttgtctcgttcatcattataataccagtgcctgccagtgtctacctaatggatagatgccaaaaacctgtttgataaataaacactcccagaacc

SEQ ID NO: 30710 - DNA, 360 bp, Homo sapiens
tggttcatttttcattattatatttttcattacttatatgttttaaatatatattttcaataatttcacaaagttatttattcatttactcaaactcctacatataccagccactgtgctggcttctggagatctgaataataatagttactccttatagaatgcttattttataccagtagatattttacatagattacctttttaccttcttcatctataagtatttattgagtacctacaatgtattgtgctgggtgttggggcgatagtggtgcacaagacagtcgtgattcctgcccttatctaggtggggaatctaggcaggaaataaaatatattgctaaactaatagcagct

SEQ ID NO: 30711 - DNA, 173 bp, Homo sapiens
  misc_feature 82: r=a or g
  misc_feature 84: k=g or t
  misc_feature 85: d=a or g or t
  misc_feature 88: r=a or g
  misc_feature 99: k=g or t
caattatctttggatcgtagactgcactttggggagcctagaaaaatagactcatttctacctcaggggcatcctttccaartkdagratgcgatttakacaataaaatgcaatggctaacctagagactgactactttctattttcctttactactgaatcgccccctccaa

SEQ ID NO: 30712 - DNA, 334 bp, Homo sapiens
  misc_feature 83: s=g or c
  misc_feature 92: k=g or t
  misc_feature 95: k=g or t
  misc_feature 102: s=g or c
  misc_feature 309: r=a or g
  misc_feature 310: n=a, g, c or t
cttatatgtcatcatgaaaatattaggtgtttaataaatagactttcttggagaagtcggttgtaagcaggtagaataatgastttgggatkcckgcctggsatgttgccccttatgatctgttcacagaacgtgcttctggatgtccagatattaaccgttgtgatcatagctacctcttatatcaaatgccccaacaaaatcgtgtgatgtcttcagttcaggacagagctttccttcttgggagtaagaattactctttcagtttttctagaggacgtgaacatgattagataaacaaaacatgarngtgtacatatatttctctacctcc

SEQ ID NO: 30713 - DNA, 397 bp, Homo sapiens
  misc_feature 81: r=a or g
  misc_feature 85: s=g or c
  misc_feature 92: r=a or g
  misc_feature 93: k=g or t
  misc_feature 97: b=c or g or t
  misc_feature 106: m=a or c
  misc_feature 160: r=a or g
  misc_feature 196: k=g or t
  misc_feature 197: r=a or g
  misc_feature 305: r=a or g
  misc_feature 328: r=a or g
  misc_feature 362: k=g or t
  misc_feature 363: s=g or c
  misc_feature 371: r=a or g
  misc_feature 375: r=a or g
atctgagacagccatatccagaaggaagaggagccgcgttccgtggctcacacctgtaaccccaccagtttgggaggccgrggcsgggcggrkcacbtgaggctgmggccgggggtttgagaccagcctgaccaatatggagaaaccccgtctctactaraaatacaaaattagccgggagtggtggcgcatgcckrtaattccagctactcgggaggctgaggcaggagagtcgcttgaacccgggaggcggaggttgcggtgagccgagatcgcgccattgcactctagcctgggcaacaagrcgggaaaactccgtctaaaaagrataagagggttacaagtagcctgaattttcctcksttcaaatrgggrcttctcaaagaaggtgaatcta

SEQ ID NO: 30714 - DNA, 173 bp, Homo sapiens
agaaccttcctgccgtcgcgtttgcacctcgctgctccagcctctggggcgcattccaaccttccagcctgcgacctgcggagaaaaaaaaaattacttattttcttgccccatacataccttgaggcgagcaaaaaaattaaattttaaccatgagggaaatcgtgcacact

SEQ ID NO: 30715 - DNA, 314 bp, Homo sapiens
tttatccttggtgtgtctcagtacactcttaggcagctggtgcttttttaacctctttggctggctgtaatggtagagaaatactgggaggcaatgaatatttcgactaatgtagagtctcaatagatagcctctttgaatagaagctttctagaatgttttaaatcacagagtaagatttgggttcttgttaccctttgcatcagtcttcaagatgctgccaaaaagtataactttcttaggaaggtgatttgagattctgaaaacacttcagtaatgaagttgcaggctagattgtaaatattgagagatcc

SEQ ID NO: 30716 - DNA, 338 bp, Homo sapiens
  misc_feature 19: r=a or g
  misc_feature 85: y=c or t
  misc_feature 255: h=a or c or t
  misc_feature 256: r=a or g
  misc_feature 269: m=a or c
ccagctactcgggagggtraggtgggaggatcgcttcagcccaggaggttgagattgcagtgagccatggacataccactgcacyaacagcctaggtaacagcacgagaccccaactcttagaaaatgaaaaggaaatatagaaatataaaaattgcttattatagacacacagtaactcccagatatgtaccacaaaaaatgtgaaaagagagagaaatgtctaccaaagcagtattttgtgtgtataattgchrgcgcatagtaatmtaattttaaccttaatttgtttttagtagtgtttagattgaagattgagtgaaatattttcttggcagt

SEQ ID NO: 30717 - DNA, 262 bp, Homo sapiens
  misc_feature 83: s=g or c
  misc_feature 86: s=g or c
aaaagaggaggtgccccccatagaaagagcctttgcccaaaaaacacgtcctatcaagccgcctccagactcccaagagacgstcsgcgctcccctcgctggtcccgcaaaactacacggaaaacaagaatgaaggagttgatgtaacgtcgctgaggggcgaggtggagtctctaaggagggcgctggagctgatggaggtgcagctggagaggaagctgaccgacatctgggaggagctgaagagcgagaaggaggcacc

SEQ ID NO: 30718 - DNA, 363 bp, Homo sapiens
  misc_feature 86: y=c or t
  misc_feature 303: b=c or g or t
  misc_feature 314: y=c or t
  misc_feature 345: w=a or t
tgaccttcattgtctctttttactattttgacttaaagcttgtcttagctgatataaatatagctactgctgctcattttgaattyccatttgcatggcatacctttggcatcttttcactttcagtctatgtgtgtctttacagctgaagtgagcttcttgtaggtagtgtgtttgcatctttttcaaaataatttattcagtttatttatccagcctatcttttaattggtgaattaaaactttctatttaaagttattatttacaagtaagggcttactcttatcattttgttaattgtbttctggttgtyttatatatacttcgttcctttattaattttwtttacagtttcgtgggtt

SEQ ID NO: 30719 - DNA, 333 bp, Homo sapiens
  misc_feature 86: y=c or t
  misc_feature 90: y=c or t
  misc_feature 215: y=c or t
  misc_feature 230: s=g or c
  misc_feature 273: m=a or c
atggaatgaaaagccttgtacaagaggcttcgtgccatgttcagcctgccccttagccttccactgtgtgaggacacagcattccytccyttcaaagtgctgcagctctcacaagacaatcaaacaagcccgcaccttgatcatgatcttcctagcctccggaacggtgagaaaatcaatttctgtttttttttataaattatctactctgtggyatttcgttatagcascacaaacagattaagacaaggaggtaaaagaagaggagtgggmaataggtttggtaaaatgccatcacacatctggactattgagacacatccatggcaacat

SEQ ID NO: 30720 - DNA, 323 bp, Homo sapiens
gactgccatctctggcaagatttcaggtaaagaatctcttcttaatttctaccttccttttctctgaatcagcccataggtgttgatgagtggccactcttaaagagtcactcagtatcagggatctactgtctttgttcaaaggtcaaataaaaacctagtctccttttattctactttctattcttagctagaatgaaactcagcatatatacacttctggacataataatattgaatagtaattacctttactagatgaaagaaattttcattacaaacttaaatcatgtaaaactcaacaactcagattcctggtacca

SEQ ID NO: 30721 - DNA, 164 bp, Homo sapiens
cacttttttgtcattatggtataaggtaaggcactttaaagtggaggggtggtgatctggtttttttcttgtcctgtgaagacttggaatgttctggagaagttccactagctctaccaaatactgcattataccgaagtaccccacttttttttttttttttt

SEQ ID NO: 30722 - DNA, 386 bp, Homo sapiens
  misc_feature 288: k=g or t
  misc_feature 306: n=a, g, c or t
atttttgtatttttagtagagacgggttttaccatattggccaggctcgtctcaaactcctgacttcaggtgatctgcctgcctcccggcctcccaacgtgttgggattacaggcgtgagccaccgcgcccggcctatatatatatataaactttaaattaaccaaatatagagagattcttattctttaatctttggttaaatggaaagatatgaaatatgccacaactttttaaaaaataatttcgcttttattttagattcaggggatgcatgtgcaggtttgtkagcatggtatatagtgtngtgctgaggtttggggtacaattgatcccatcccccaggtgctgagcgtagtacctaataggtagtttttcaactcttgc

SEQ ID NO: 30723 - DNA, 169 bp, Homo sapiens
gaagggagcgggcgagcggcgacggcggcggcggcgggcacagattaattaaaagaagaatgaactataatccttgaagataactgggcaattttttaagtcggaggctgttcttactggtgtgaggatttacacacgtcttcagtttttcagcacagaccagaagacc

SEQ ID NO: 30724 - DNA, 273 bp, Homo sapiens
  misc_feature 84: r=a or g
  misc_feature 229: w=a or t
  misc_feature 230: s=g or c
attgattaaccacagaatgtgaacatgatgctcagaagtagagcagctttcttaaggccatgaggaagaaagctgtacgttaargatggaagataatgacaacagaagaagcctggtttcctaatgactcccttgagcagctttgatagccctgaccacctaccttccagatttttgactgaagaaatttaatcaacttattatgatgatgaagcaaaaacattatagwsgtgtgatagttagaaatagtagcaatgtttgaaaaagggtaat

SEQ ID NO: 30725 - DNA, 318 bp, Homo sapiens
  misc_feature 131: h=a or c or t
  misc_feature 199: n=a, g, c or t
  misc_feature 200: r=a or g
  misc_feature 281: m=a or c
aaaaagaatgttacagtaacaaataaagtgcagtttaaaacccaactcttactcttaatttgttcctaatacgtatttttggcagggagagggaacggtccatgaaatctttatgtgatataaggatttthagtttgggccagtgaacagggtaaataaaatttaacttttgagcatatggaattttgattgcctttanrgttactattctgtatcattgattcatcaagaaaacctagatctgcactcacctcactgttcaatcattgagtggtaaaggmcagaagtattttctagttctggtcagatgatataatt

SEQ ID NO: 30726 - DNA, 308 bp, Homo sapiens
  misc_feature 240: b=c or g or t
  misc_feature 252: w=a or t
ataccattttgtccagatgcaaaaacattccaaaagtaatgtgtttagtagagagagactctaagctcaagttctggtttatttcatggatggaatgttaattttattatgatattaaagaaatggccttttattttacatctctcccctttttccctttccccctttattttcctccttttctttctgaaagtttccttttatgtccataaaatacaaatatattgttcataaaaaatbagtatccctttwgtttggttgctgagtcacctgaaccttaattttaattggtaattacagccccttgc

SEQ ID NO: 30727 - DNA, 301 bp, Homo sapiens
  misc_feature 197: k=g or t
  misc_feature 199: w=a or t
  misc_feature 204: y=c or t
  misc_feature 211: y=c or t
  misc_feature 214: w=a or t
  misc_feature 218: y=c or t
  misc_feature 220: w=a or t
  misc_feature 224: y=c or t
  misc_feature 228: m=a or c
  misc_feature 229: r=a or g
  misc_feature 233: w=a or t
  misc_feature 262: b=c or g or t
  misc_feature 264: k=g or t
  misc_feature 270: k=g or t
  misc_feature 284: m=a or c
atgaggttgcagtcatctgaatacttgctctgggatgtaagatctaattctatgctggctcccacatacatgcccggcctcttttttttttagctgccaatctttttgaaggaatattcttacctctactttgtcaccttctactggctccttaactaaaatctgccatttggctctctggttaacagtcccttcckgwaaagyctaaaayctwaatycwaaayccamrgttwaattcacaagctagtacttgacttttttbckgtattkgacatttttgacamcccctactttaaagatt

SEQ ID NO: 30728 - DNA, 382 bp, Homo sapiens
  misc_feature 295: n=a, g, c or t
cagttgttccgtaactagaagcattctttgattttaaatttgaagctgttcagtttgcagctggggatatgtgcatggttgggaacttatacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcnattgtgtgtggactctgagaagcctgcttgataacttgtcttaagttctattaaggcagttagactgagatttctaatgacttcacc

SEQ ID NO: 30729 - DNA, 362 bp, Homo sapiens
  misc_feature 295: k=g or t
  misc_feature 296: h=a or c or t
caaaggttttggccatcaggccctttcgagatgatttccccacatgagctttgctgacagctcaaacccaactgtgggtcatgggtgcaaaggagccctttgccgggttgagttcatcttacacccttgcagacggttccttccatttgacctgcaatgagaagaccacaaacagctatagccacactagaatagagccccttgttgggggatacatagttctctgttaagaaaacatcacaaaaaagaaaatgtccataattttttggttgtgtaacactttcttataaacagkhtgcagtcagggctgtgctgaagctgtcctgggacctgttggaatattttcttagtcctctgtctcc

SEQ ID NO: 30730 - DNA, 405 bp, Homo sapiens
cttgacttctgtgcactcacaggcttgatcaacaccacaaggaagctgccaaggccatcctctgaaaccacagcccgagctctatgttggccccttttagccatggctggaatggctgagacacaggacaccaagtccctaggctgtacacagcactgggaccctgggccctgcccatggaacaattttttcctcctaaatcttcaggcctgtgatgggaggggctaccgcaaaggtctctgacatgccccagatacattttccctattgtcttggggattaacatttggctcctcgttacttatgcaaatttctgcagccagcttgaatttctcctcaaaaaatggaattttcttttctttaacattgtcaggctgcaaattttccaaacttttatgccctttt

SEQ ID NO: 30731 - DNA, 338 bp, Homo sapiens
agtctaatattcttgtcttccacaaaatgcacacttctcaggggacgtgtcataaccgaggcactgctgtgagggagtttgggtcatagtgggtagaaactgaaatgtgcagtccctaagtttctttccattgtgaacattcagttattggctaactgtaaaaagaggatgggattataagacaattggggacatttgaacattgtaaggacatatttgctagtataaggaaatggcttttcattgttaatgtttggtaatggtattgtgatttttaaaaaaatccttatcttttatatactgaagtatttataaataaaatactatgatacctgggt

SEQ ID NO: 30732 - DNA, 367 bp, Homo sapiens
  misc_feature 345: r=a or g
tctggcttagtgtaatgatgtagagatagtgttacatagtttcagttccaatctggttttccctaaaacggaagatatttagtaacatttgtatctgctattacttgttcttgtataagaaaaagaaagtaaagaaatggttaactttctgtttgcaaggaggaagaaggtgttcacttgctttttcaaaagtgggagaaaagtgctctatattcccttttgcttttcttggaagaaatatgtactgtagaaagaaaaaacaccataattagaacttcttgaaaaaacaagatggtatttcagttatacctcattttgatgaaggatgggtatctggaagcaggrccgggtacatggtcataaggaa

SEQ ID NO: 30733 - DNA, 359 bp, Homo sapiens
  misc_feature 171: n=a, g, c or t
  misc_feature 172: w=a or t
atgtattcattagcggcaaaattaatcaatatgggtataattttgattaaaatataaaaccagaattctactcttcaaaaaggcctggctcatgccccacgtggtggctcatacctgtggtcccagctacttgggaggctgaggtgggaggaccgcttgagcccggaagtnwgaggctgcagtgagctataatcacaccactgccctccagcctgggcaagagagcgaggctttgtctcttaaaaaaaaagaatgccaaggaaaggatgagctcataggaagcctcagctaccagaggttctattaaataccagacctcagtgtgaaaggaatctttatggtagtagttaaaattcatt

SEQ ID NO: 30734 - DNA, 358 bp, Homo sapiens
  misc_feature 252: b=c or g or t
cactttttatcttattgcaaacttcattttgcccacaacacctgaaaaggtatgtaacattccccagctgccaaacagagtgtcagtttttcagcccttcatcctccataactttcgtgggacaattcttgcctcttggactctatgtcctctctggcttctagaccacggttcattcacttctattctgctcagtctccttttctgggctatccttattctcccctccacagttctcaaatggtgtttccbagggtccacacttcagcaccttcatcttcctgtccttgattctcctgggtcatgtccattcaaagatactatctacttatccattatagactcctaaatcattatc

SEQ ID NO: 30735 - DNA, 345 bp, Homo sapiens
gtatctgggtatggaaaagaagttaccccatacatttttaaaagtccatcagctgatcaaagaactgttcagtcatttgaacagatcatcctgaaccagacatttaagtaaccgttaatatctgttttcagcagttaatacctgtatttcaacaagtagtatgttgatcctgactcagagcaaaagtgagtgaaatagaaaaccatgtggacttccactgaaaagctgtgggcactcccaaaccagtccacatgctattccctctacctgaaacaccctcttcctccattccacgtgtcttttaaggtgtagctcaagtttcaatataacctttccttcccacgc

SEQ ID NO: 30736 - DNA, 389 bp, Homo sapiens
agccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtaagtcagtgtatttccattggcatggggaaagagagagctacaataggtagaagggggtagcattttcacagtagtcattgaatttgatatatcaaatgccacattttcagtctggaatggatgacttcatctgttcagtgccaccagtcctgaataatga

SEQ ID NO: 30737 - DNA, 280 bp, Homo sapiens
  misc_feature 75: r=a or g
  misc_feature 173: b=c or g or t
  misc_feature 201: k=g or t
  misc_feature 205: k=g or t
ctaatgtcaaaagtcaaaacctcctaggggttgtcctgggagtcaggttcacgggtacagaagatgaatctcagrtgtcactcaacctgagccgtcattctctgtggcagggctgccctgggtttctcttactcaatccctggagtgtaagcatttggattgtgtcacagatbacctttttaccttttctttctttttttktctktttttcaatatcagtgcccacaccttactgagtattgagttttagagctttcgcttgatgtgcttgaccaagaga

SEQ ID NO: 30738 - DNA, 118 bp, Homo sapiens
taaatttttaatgaaatgcaaattttctgtgatggggttctctctctctttttttcggggggtggagtcactaataaatttgcaaatgaagttaaagacaaggcaaccatctggccac

SEQ ID NO: 30739 - DNA, 352 bp, Homo sapiens
  misc_feature 74: r=a or g
  misc_feature 91: r=a or g
  misc_feature 258: v=a or c or g
  misc_feature 313: k=g or t
  misc_feature 319: k=g or t
agtatttggcagagttgccttctacctgccagttcaaaagttcaacctgttttcatatagaatatatatactaraaaatttcaggtctgtraaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacavcctttatctcttagtgttataaactccacttaaaactgattaaagtctcattctkgtcatkgtgtgggtgttttattaaatgagagtttataat

SEQ ID NO: 30740 - DNA, 375 bp, Homo sapiens
  misc_feature 311: d=a or g or t
  misc_feature 312: r=a or g
  misc_feature 316: r=a or g
aaaagaaatgagcaaagcctccaagaaatatgggactatgtgaaaagaccaaatctacatctgattggtgtacctgaaagtgatgcagagaatggtaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagtcagagagaaaggtcgggttaccctcadrgggragcccatcagactaacagcggatctctcggcagaaaccctacaagccagaagagagtgg

SEQ ID NO: 30741 - DNA, 347 bp, Homo sapiens
  misc_feature 108: b=c or g or t
  misc_feature 111: k=g or t
  misc_feature 112: n=a, g, c or t
  misc_feature 183: s=g or c
  misc_feature 184: k=g or t
taggattttcatggtaacaagctctggtataagctaaggctggcaagttcagatactaaaatattatttgatcatatcttggatccttttgaaaaagttaagactatbatknaggtaaattagaaataagtatgaatattaataaaatagcatttatcttatttctctattttatgttgtgasktaacctaattttatttttttaacattttcttatttcttataatatgaatgctgatatttaaaggtagatctatgtggtattctttgtgtttcttaattgtttaactcttaagattatttgtgatctggatttatgtatttgttagatacatacgaattgttaa

SEQ ID NO: 30742 - DNA, 159 bp, Homo sapiens
cttggccctagaggattgagatgtttttctatatcttagaactatttttggataaattatatattttccttcctagtagaagtgttactgcctgtaactagctcaaaataccaatgcagtttctgcattctgggttttgtttttccttttttttttttt

SEQ ID NO: 30743 - DNA, 174 bp, Homo sapiens
taactttatgaacatatttatgtatgtatgcatgtatgtatgtatctcatgtggtgttttagacactgaaaaataactcatttctattataaaactgatatctttagatgttcagaagcaacttcctaaaaggaggtagcagtaatggagctatgtctatcattctttcccatc

SEQ ID NO: 30744 - DNA, 434 bp, Homo sapiens
gaaaaggttccataatttggccaaactgcatgcatgtaatgcttatttagtaatggtcactgtatgttagataaggataaaaatatatttgtgaattacttctgaggaaatgctaacttccacagcattgtatttaattataacaataacaggaacattaaatctttatctttgctgtttcacctcaaagtcatagatcatctggctttttaggcaccttcactaaaggcaaaaatctgattttagtttttattagcatgtaccttgaaattatttgaccaagaagctcaaagaaaagaagtacgttaaagaaaaagaaaaaacctcacttttcctttatagtgtcccttcctgttttaattcctaaagatcctgacttttatctgaggaagtctaggtagttttccttttggatctggcattggtgcgtgttt

SEQ ID NO: 30745 - DNA, 176 bp, Homo sapiens
  misc_feature 155: k=g or t
  misc_feature 156: k=g or t
actattgactttgaatttagacttaatacccgatagttctgccccagagacaagtatgaataccacagacaacggtgtcaactgtctgtgtgctatctgtggggacagagcaacaggaaaacactatggggcatccagctgtgatgggtgcaagkktttcttcagacgcagcgtca

SEQ ID NO: 30746 - DNA, 145 bp, Homo sapiens
ttatgatgtaggtactgttatttgtcccattttacagaagagaaaactgcggcactgaggggttaagtaacttgcccaaagttatgtaactaacaaattataaagttggtattcggacttagataatccaaattcaaagcccctt

SEQ ID NO: 30747 - DNA, 367 bp, Homo sapiens
  misc_feature 258: d=a or g or t
  misc_feature 259: s=g or c
  misc_feature 260: n=a, g, c or t
tctactattaactctactttgaagtaaaaggcaagaaatattattttaaagacaggaaatacttctgagtctttggagtagtattatgacgtgttgttaaaacatctttttagtgcagattttttttccctgaaaatatcccaaatgtaatcatttttagggatcctggatatggatggcattagtattcctggtactttaaatcttttgcttagtttgaggaacatgtgcatgttgatcatcttgctaaaacacaadsnaatcttctaatatccttatggtaactaatttattgtctttcccaacttatgctttttgagatggtgctaatgataaatataagctattactattgagaatatcacta

SEQ ID NO: 30748 - DNA, 260 bp, Homo sapiens
catatatgattaacaagcagaccataggccagtgtctgactttcactgggaggtcttggcacccttcctcaccttgatggtaaggccccaggacaaggtggagaggtaatcaagggcatcttagttaggatcagttggcaatgaaaatgaaccaaggtaattaaaatacaataaaaagggaataggaaatatgggaagcaatggcaaagaagtggtttccatttgatttcagtgatgtgggggtttagaggccaggcttc

SEQ ID NO: 30749 - DNA, 235 bp, Homo sapiens
acacaatatttaacatcttaatgaccaccaaggcctgggctctagggctctctctgcctcttctagtccttaattgggtttaaagggagaaacatcattaacagagaccaagtcagatggagtcagctgatctttgataagattgtcaagaatacacaacacaggaaggataatcttcaacaaatggtgttgagaaaactggatattcacaggcaaaagaatgaaactggaccac

SEQ ID NO: 30750 - DNA, 258 bp, Homo sapiens
agaagtcgggtggagctgaagagccaagaggctccgagtctgcagcagcagccagaccagtacctggagccccagtcccacaaggagcttggatgtgcggacaagcagggtggactccccaggagcacccaggcttgagtggagaagctgttggtacaggagaggcggcaggaggagcaggagaggctgcatgccattcttttcgggctgcggagaacagggagctaaacatcaccatcatctaagagcgggtcaatt

SEQ ID NO: 30751 - DNA, 172 bp, Homo sapiens
ccaatagtattctgaatgggctctgctttatttatatgtttgagtttcgtgcatgttttatgttattaattagtagctttttgtttcagttttaaataactccatttagcaattcctgcaaggcaggtccagtgatgatgaattcctttagcttttgtttgtctggaaaaac

SEQ ID NO: 30752 - DNA, 189 bp, Homo sapiens
aaaaactctgacctttattgagttatactttttttgtttgttttatgacaccagaaatgtagctcgtgtattctcataacgtactgagtatacaggatcatgagtgtttgtgaccatttgctcagcagcagagcttaactcctaaagagccatttttacactttttctcacttcctcttacagccaggt

SEQ ID NO: 30753 - DNA, 267 bp, Homo sapiens
ttgatttcctggtgaatctgaatttagctttagaaatgactcggggaagtggttctcagacttcttggtctaaggactcttttacatttttaactattacggaccagagattgaaggtttccatcaactcaaagatctgtattctgttaaacaccccctgccaattaagccacctgaaggcaggtagggaagcacctgacagtgactgacagtccactgcatgccagccacctattttttcttggtgaatcccaatgactcccttaa

SEQ ID NO: 30754 - DNA, 295 bp, Homo sapiens
tattttatccatcccctaatcaagatggagttgctctgggtcaaatgcctctgacaatgttagctgttaagttttcttatagaagccttatatcatattgagaaagtttcattctagtcttagtttgatgagacttgttaaaaagtatattatgaatggatcttgaatactatcaaatgctttcttttatatctgtttaattgattacatggttttatttattattctgattgttgttcattgattcattttcaaatgttaagccaactgtgggaaatattctaggaatgcagtt

SEQ ID NO: 30755 - DNA, 73 bp, Homo sapiens
caaccttttaattttttaaagaattgatacgattctataaaaataataaaatttgaaggaagtcagtaaaata

SEQ ID NO: 30756 - DNA, 300 bp, Homo sapiens
  misc_feature 141: b=c or g or t
  misc_feature 142: k=g or t
tgccataaaaagactttcatggagttttgatgatagcttgttttaaccttgcccttaacctaattctttttagaacttattttcttactgtattatattgctcattttcaagaaaaagacatatttgtaatgttggaaacbktatagtcttatatggatggctcttaggtttttcagatcattcatccatttgaagacctgcagaaagctttggatggtctcctagaaaaaaaagcacccatacacgtgctcctaaaactctgtacaattgtgggaggtaaagctcacctgtacagatct

SEQ ID NO: 30757 - DNA, 172 bp, Homo sapiens
tcaataaaacatagtcctctagccagaccaaggaagaaaaaaaagagaagaaacaggctggatgctgtggctcacacctgtaatcccagcactttgggagaccagtgcagaaggatcacttgagactaagagttcgagacccagcctgggcaacatagcaagaccccatcgg

SEQ ID NO: 30758 - DNA, 135 bp, Homo sapiens
  misc_feature 26: y=c or t
attcgcctctgggaggtttaggaagyggctccgggtcggtggccccaggacagggaagagcgggcgctatggggagccggacgccagagtcccctctccacgccgtgcagctgcgctggggcccccggcgcctca

SEQ ID NO: 30759 - DNA, 379 bp, Homo sapiens
tgactcaaggtagaaaacctgaaaaggtctctggtccagggaccaaagtgagaggttgtcagggagccacccttgtgactccaaagagcttgcagctcagagactccacaaaggaagccaccccatctgctccccagaacccacgtggcccaggtgtgggaatgagctgcaaggggcaccagccactgtgccatgtacttggcaggagcgagcgaaacttcaggacggccccgaggaaggcatctcttcatctctgccctccacactcggaggtgaagcatcttgcctgagggctccagctcgtacgcagcaggactgagatcggaagcaggcaggcttgttcgagaacctgtggctctcatcactgtgctgcagctaa

SEQ ID NO: 30760 - DNA, 421 bp, Homo sapiens
aatgattgtatttgctctttgaaaaaattacacttatagaggatggattggactggactgaatagtggcagactagacaggagtccaggcaagagatgatagtgacttgattcaagaggagggtaattatgggtatggagagaagtggctggatttaggtggacagattcttggagccacttgactttgggagataatgatggtatagatgtgtctttctgagatataaaacttcatctttaatatggaaaaagagtggttacattagattcattgggaataagaggcctctgttctacaggtttgtttaatctcaaaataaccccaacatcaccagacctggattgtgatatttttgtcctggtttagtcttagtgcaatatttgtaattccatatatttttccaatcatacactgtggt

SEQ ID NO: 30761 - DNA, 246 bp, Homo sapiens
agtaaccccagcagtgggcagggcagccaggtatccatcaagggtagagctggctcgaggctgcacttaagctttccccctattttagttgacctgttcctaggtcagagtcccctccagggccccaggactgcctctagcaggctctgtaccccagattttactgtcccagtcctgaatctgccttaaaaaaagttttaacagcttttcagcttcttagctttccttttctgctcagcgtctact

SEQ ID NO: 30762 - DNA, 259 bp, Homo sapiens
  misc_feature 229: n=a, g, c or t
  misc_feature 230: n=a, g, c or t
tatagattattatctggaatgtgactcatcaccctttaatctcattcaagactatatgtagggtatgtcttctgtaaaacagtctgtatctttgaaacaggacttgtgttagaaaatgaaagttttaatttcaaactccaaccctaaatatttatttattgagaaacttgcactgacttccttgtgagagtaatggacttatctcttggtatattaacataagatttannttaagaaagtgtattagtccattttcaca

SEQ ID NO: 30763 - DNA, 418 bp, Homo sapiens
  misc_feature 145: n=a, g, c or t
  misc_feature 360: s=g or c
atagttacccgtttcctaaaactggttccagaccttttggccattgtgcagcgtaagaaaaaggaaggggaagaagaacaagcaatcaacagacagacagcgttgtataccttaaagcttttatgcaagaattttggtgcagaanatccagatccttttgtcccagtgctgagcactgctgtgaaactgattgctccagagagaaaggaggagaagaatgtcttgggaagcgcgctgctgtgcatagcagaggtgacctccaccctggaggcgctggccatcccccagcttcccagcctgatgccatcgttgctgacaacaatgaagaacaccagcgagctggtctccagcgaggtctasctgctcagtgccttggctgctctgcagaaggttgtggagactctcccgcacttcatca

SEQ ID NO: 30764 - DNA, 422 bp, Homo sapiens
  misc_feature 87: k=g or t
  misc_feature 88: k=g or t
  misc_feature 89: k=g or t
  misc_feature 93: k=g or t
  misc_feature 107: k=g or t
  misc_feature 258: w=a or t
  misc_feature 259: v=a or c or g
  misc_feature 337: s=g or c
  misc_feature 342: k=g or t
  misc_feature 348: s=g or c
  misc_feature 349: r=a or g
  misc_feature 351: s=g or c
  misc_feature 355: s=g or c
  misc_feature 363: w=a or t
  misc_feature 370: k=g or t
  misc_feature 379: k=g or t
  misc_feature 380: k=g or t
  misc_feature 381: k=g or t
  misc_feature 383: r=a or g
  misc_feature 404: w=a or t
gcttcatccatatccctgcaaaggatttgatctcattcctttttatggctgcataatattccatggcatatatgtatcatattttckkkatcktagtccctcattgktgggcatttgggttgattccatgtctttgctgttgtgaattgtgctgcaatgaacaaacacatgcacatatctttataatagaatgatttatattcctttgggtatataccctgcaatgggattgctgggtcaaatggtatttctggttcwvaatctttgaggaatcaccacactgccttcctcattggttgaaccaatttacatttccaccaacagtgtaaaagcattsctatktcttasrasctcscagaatcwgttgttkcttaacttkkkartaatttgcattctgactggcwgagatggtatcttattgt

SEQ ID NO: 30765 - DNA, 284 bp, Homo sapiens
  misc_feature 70: r=a or g
  misc_feature 84: r=a or g
  misc_feature 86: m=a or c
  misc_feature 97: k=g or t
  misc_feature 104: b=c or g or t
  misc_feature 251: w=a or t
taatattacttgaaatttcaaaaggaattaatatcatggctaaagatgacttcaagcaattataattttrattatgcttttccramaatctctacakcctctabctctttggagattccagtccttttgtgccccgctaccctttgttgaattggctactgctttagatcttccttgtaccagaagcataaaaatagattactgaaatgcagtatagtgtttatgcctagagcccttaggccattattttwtgtgttccactggtcaccacatagtttattaga

SEQ ID NO: 30766 - DNA, 135 bp, Homo sapiens
cctcagccgggctctttgcagaagcagcaccgctgactgtgggcccggccctcagatgtgtacatatacggctatttcctattttactgttcttcagatttagtacttgtaaataaacacacacattaaggagat

SEQ ID NO: 30767 - DNA, 276 bp, Homo sapiens
  misc_feature 254: r=a or g
  misc_feature 255: r=a or g
cgaggcaagcagatcatttgaggtcaggagttcgagaccagcctggccaacatggtgaaactccatctctactaaaagtacaacaattagccaggcatggtggcgggtgcctgtaatcccagctacttgggaggctgagggcatgagaatcagttgaacccgggaagtggagattgcattgagccgagactgcgccactgcactccagcctgggcaatagagcaagactcagtctcaaataaaataaaataatrraataaaataaaaagaaacctt

SEQ ID NO: 30768 - DNA, 177 bp, Homo sapiens
ccattttgcatattttcattacacattcctcttgtatgataagcctgtgaaaatgttttactcatttgccactggggtgttaccagctggctatattatattagtaagttcacagaagtttagaattgttatattccattggtagattgtatcgattattattgtataccgactcca

SEQ ID NO: 30769 - DNA, 334 bp, Homo sapiens
tgggaattgcaaggtgttagaagtttagtaagttgatttttattgaaatgaatactttttgagtaagttagtgtaaatttggaaatagttctatgcagcaaaaacaagcttgagaggctaagatataatctaatcattgaaaagttgaaaatgtgacatttgggatatgcatgcagtgatttgctatatgtgtatgttttttcaattagtagatcttataaatcaattagttttgacagttactgatttctgtacccaatgaggtctaattatagcattggataccatgtagtgtttagaaaagttaaactactggtgcccaagtttttttttt

SEQ ID NO: 30770 - DNA, 423 bp, Homo sapiens
  misc_feature 94: k=g or t
aagacttgtttctgatctaatatcccagaaaaagtaactcattgctctgttaataatctcacatatacaagtagcttccctcccctctagtttkttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaaagatgctttttgatctacctaggtggagttggtggtgctgatatttaaattcaggctactgcttcaatctcaattgctttgta

SEQ ID NO: 30771 - DNA, 348 bp, Homo sapiens
  misc_feature 201: r=a or g
acacctagaaagttcattcattcatttgttcattcaacagatatttattgagtgcttactttgtattaggaactcttctaggccggggcgcggtggctcacgcctgtaatcccagcactttgggaggccgaggcgggcggatcacgaggtcaggagatcgagaccatcccggctaaaacggtgaaaccccgtctctactaraaatacaaaaaattagccgggcgtagtggcgggtgcctgtggtcccggctacttgggaggctgaggcaggagaatggcgtgaacccgggaggcggacttgcagtgagccgagatcccgccactgcactccagcctgggcgacagagc

SEQ ID NO: 30772 - DNA, 97 bp, Homo sapiens
taataatagacttattcttaaggcactgcatcagatagttgaagggaagacatagtttttgcctcagtcactcatgtgctgtacagtttaaagccat

SEQ ID NO: 30773 - DNA, 329 bp, Homo sapiens
  misc_feature 91: r=a or g
  misc_feature 272: k=g or t
ttgtatatcacctattagcttctaagtagtatcaatattaataaaagaagtcttaagctctctgtgactcatggtcatgtgaaaattagarataccttagtttcctaggattcagtcaaccttgggattatgggtagtcagcctgttacgagagtcctggtctttaaagatctacttttagcaacaattcaggtatttagcaatatctgaaaactctcaagccctgctcttttagtgtatatttactgttaaagcacagaacttcctctttkatattagtagaatttgggaggatgctgattcctattgaggtttttgttcgattgttt

SEQ ID NO: 30774 - DNA, 327 bp, Homo sapiens
  misc_feature 88: r=a or g
  misc_feature 124: d=a or g or t
  misc_feature 125: r=a or g
caggtactgttttaagatcctaatggatattaactcattggatcctcacaagtccatgaggcactttctattattcctttttatagargaggaaacagacttctgaagctaagtaacttgtccdrgctaacatagctaataagtagcagatccagtatcaacctaggcagtatggctccattcctccaccatgtgccatcagttagtacagaaatagaaaccatcgctatgatagcaaatatagtgtttagtattcctttcagcttatcgttttatgcttccccctgttaagttacgctggggagaaaacaaataaatgaactgagt

SEQ ID NO: 30775 - DNA, 324 bp, Homo sapiens
  misc_feature 176: w=a or t
agtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgwtttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgccgaca

SEQ ID NO: 30776 - DNA, 298 bp, Homo sapiens
cacaccaagccattacttgagttttaaaaatctgccaatatccttggcatagtaaggatgccccaaattaatgctgattcgcttttggacagcaaatgaacccatctgttttaatgaaaggggaaaaaaatttccctcttactggccacatagaaccagaaatactgactgcagtatcagggaatggttactgtccttccaagagtatttacttttaaggttcatttgttagatctattcggtgaaaacacagcatcaaggctgacagaaacctggatcatatgagatacgccgttag

SEQ ID NO: 30777 - DNA, 152 bp, Homo sapiens
tatacagagctgaagctcaggaggcaaatctgggccagaaattgggatttgtgaaccattcagaagcaaattatgatggaagtcaaatcccaacattttaatttaatttatttattttttgagactgagtttcgctcttgttgcccaggctt

SEQ ID NO: 30778 - DNA, 266 bp, Homo sapiens
gcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggat

SEQ ID NO: 30779 - DNA, 285 bp, Homo sapiens
tgaagagataattatttgtctggtaagcatttttataaacccactcattttatatttagaaaaatcctaaatgtgtggtgactgctttgtagtgaactttcatatactataaactagttgtgagataacattctggtagctcagttaataaaacaatttcagaattaaagaaattttctatgcaaggtttacttctcagatgaacagtaggactttgtagttttatttccactaagtgaaaaaagaactgtgtttttaaactgtaggagaatttaataaatcagc

SEQ ID NO: 30780 - DNA, 170 bp, Homo sapiens
  misc_feature 16: y=c or t
  misc_feature 86: k=g or t
  misc_feature 87: r=a or g
  misc_feature 98: n=a, g, c or t
  misc_feature 115: d=a or g or t
  misc_feature 116: n=a, g, c or t
  misc_feature 137: n=a, g, c or t
  misc_feature 138: n=a, g, c or t
  misc_feature 139: n=a, g, c or t
  misc_feature 140: b=c or g or t
ttgcattattaatttyacatattaatttcacattaattttatattaatacatattttatgggggaatattcattttcccccatatkrtacatgaaggnaaatcacagagtgaatdnacttaatattccagtggggtnnnbgatgcttgtataccctacttcttttttttt

SEQ ID NO: 30781 - DNA, 174 bp, Homo sapiens
  misc_feature 156: s=g or c
  misc_feature 163: m=a or c
cgtgtgcaccggcttggggggctggagttccggttttctttgttttttctctttattcgtcctttctcaaagatgggatactgatcagaattgctctgtatatgcttgggactggatggaaagactttggagcagctgtggggggtggggggacascgacaamcaaacagacgt

SEQ ID NO: 30782 - DNA, 266 bp, Homo sapiens
acatccgggactccggcggtgtcgttgcccgggtaattttctggcagcgacctaatgcgcgcggggccagaggcaccggctagagctgggagcttgcggaaggggcccctgcctggtcttgagaggtcgaaggtctccaggaggcctccgcctccctctttttcattcacacaccctagcctcacacgttaggaggacccccccaacagaccgtgagctggtgccgggagggtggaggtagatgtacctcacctccacgctaccac

SEQ ID NO: 30783 - DNA, 263 bp, Homo sapiens
tttgagaaaatgttatttttactgaaagcaagcagtggcctataaagaacattcttaggagccttttctatttgcgttcaaaactgtgtgttctctttctattcctatttgatagtttgagtcatggtcttagatattagctatttgtgagaggaaactggtttgtaacaatactgcaaatagaaaccccatttctactgaacatcctagttttaaacagaagaaaaactgtaatcctggggttggtatgtaggaggtctatc

SEQ ID NO: 30784 - DNA, 264 bp, Homo sapiens
aaatttcaagaagtaagaattgtatttggaggaagcagggattttctgagttggatttgaggaataagataacagtatcttgcatttaaataacagtttaatatttttatcattattatcattaatcgttgtttgtatctcgctttacaatttttaaagcacggttcatatgctatgacatttggccttcacagttagtttttgagaaaaagaaacaaaattgatgttatccctagtttacagaaaggaaactgatcagtgagt

SEQ ID NO: 30785 - DNA, 240 bp, Homo sapiens
  misc_feature 126: m=a or c
  misc_feature 129: d=a or g or t
  misc_feature 137: k=g or t
  misc_feature 139: n=a, g, c or t
ccactgtgcccagccattgtctatacagtttgaataacacactgaaaaaacagatcagtgcatatcttccacaattaacaatgcatttgtttagagcatgttgctgcattgggtgcgctctcaggmtgdcagcgackcnaagctttggttgagtttgctagtgccaagttgtttatgtgcctccccttggccccttccttccctgccactccttcttcctcccagcttgctgagcttgct

SEQ ID NO: 30786 - DNA, 117 bp, Homo sapiens
agtcagtgagcgccaccctctccaggaacagatgtcctgcgttctaaatgaagagtgcagagcccacagcaaacaactgtccccagcagcccggatccctctgacatcagcccccca

SEQ ID NO: 30787 - DNA, 273 bp, Homo sapiens
  misc_feature 107: w=a or t
  misc_feature 250: s=g or c
  misc_feature 269: d=a or g or t
tactactttaaaactctgatccgtgctcctattaatccaaattattaagaaacaagcaaattcattcatccaacaatattgagaaggcattgctgtgtgacaggcawgtgctgtgctgggagttttgcaccaaatgagacagttatgttctcctgccctcagggacattgagactagaagacagtatggtcaccttataagtacatggtgtaattacaaaagtgttggtgactgctacagacattttgastgtacagaggcataagagdgtcc

SEQ ID NO: 30788 - DNA, 259 bp, Homo sapiens
ctactaaaacaaaaaaatttttctactaaaaatagagggtgtggtggcatgtgcgtgtagtcccagctactcgggaggctaaggcaagagaatcgcttcaacctgggaggtggaggttgcagcagtgaaccaagatcacaccactgccctccagcctgggtgacagagtgagatttcatctcaaaataaataaataaatacaaataaataaaagaataattttggccaggtatggtgactcacatctgcaacccccagc

SEQ ID NO: 30789 - DNA, 255 bp, Homo sapiens
attttagaatgtaaaaatgagagttttaaaaaatatttgtttttattaaagtagcagttatatttacttaaaatttctaaacttatcccatattaacataaatatttgttcttatttcttttttcttaaattagcacccttctgcctgatactctttttttgttttgttttgtttttttgagacgcagttttgctcttgtcatccaggctggagagcagtggcacaatcttggctcaatgcgacctccacctcga

SEQ ID NO: 30790 - DNA, 424 bp, Homo sapiens
  misc_feature 312: r=a or g
  misc_feature 330: r=a or g
  misc_feature 331: r=a or g
  misc_feature 375: m=a or c
  misc_feature 378: r=a or g
caccacacctggctaatttttgtatttttagtagagatggagtttcaccatgttggccaggctgatcttgaactccttgacaggatactttacaagagtgatttttaaaactctcccagacacaactcaacacctacccctattataatattttatagcatcacttttcaatcttcaaatgaaaatcatggatgatgaagcttaccttcactcataaaaacatcactccatttactattctgaaatgaaactagcaggtaatataactagcctctaaaacatacccatcagtgacgttctaactgaaacagrtaagatattttataatgrrataattattttcatatgtacatattctagcatggttatattacmagrtgtaattaaactactaagcagggacatactttgtatgtgtgtgtat

SEQ ID NO: 30791 - DNA, 299 bp, Homo sapiens
  misc_feature 166: y=c or t
  misc_feature 167: b=c or g or t
  misc_feature 218: n=a, g, c or t
  misc_feature 271: w=a or t
ataaacttaaatgagagttcaaggtatttaaactctcattaatttagaagttaatcaaattaatgaatccgattgatctgattcagacctatactttgatccaagggctgcacagatatctatcaatctatgctgaggagcaagagaaaggatttggaaggctggybtctgatggtcaaactgcaggccagctactttgttaactatgggatcatgangcaattaatcagctctaatccataattgtttatttaacagtaggttatagggwcacagatgttatgatggctttatgagat

SEQ ID NO: 30792 - DNA, 283 bp, Homo sapiens
  misc_feature 178: n=a, g, c or t
aatgcaagatgccaagaaaggtacaatctgttctacagtgtgtatttatggaatgcagtttttcccaacaaggtattattttgaagctaccaggggtaaattttctcataatcaaagagaacccttagcaatataaaaccttataacaaagttgaaaatcttaaaaaccgcttccttnagagtggctagtttaatggcttcaaaaatatttactccattatagtaagctatctgaggaatcagagtgcagttgaagaagctgcagagacatctcttacccccc

SEQ ID NO: 30793 - DNA, 251 bp, Homo sapiens
  misc_feature 103: m=a or c
  misc_feature 166: m=a or c
tgtgggaatttagtaatgatagaggtggcatttcagatcagtaggaaaaatatggattatttaataaataatgctgtgacaactgagtagacatatggaagamaatatagatttgcacctcacaatttagaccaaaataaagttcagatggagaaagacttaagamattgtaagtatgtactcagaaaaatataggaaaaaattttaacggtgtagaggtctttctaaatatgtcacaaaacccggagccc

SEQ ID NO: 30794 - DNA, 459 bp, Homo sapiens
  misc_feature 412: n=a, g, c or t
aataataacagcaatggggtagaatttccccactccccaattccctcaggtggcaatctcaggtctgctcttctgcttaccaacagggaaagtttaaaggaagaggaaatgatcgcagggaaaagctccagtcttttgactctccagaaaggaaacggattaagtactccagggaaactgacaggtaagccaggaactcttcattcagcctaggcctcaagcctaatgataaaaccacctcctccttcaactgtactgctgttttctgtctcagggagatgatattatgagtagattctgtttgaactgctaaaacatgaggtctatgccagcctttttactatctgtctttatacggggagtgtacatggaaggttggctggcagcttcgccttcccaaagccagggctgnaggtagccatgatcgggaacctttctgtcttcatcagtaatactgca

SEQ ID NO: 30795 - DNA, 232 bp, Homo sapiens
gttagtttagtattgtttccactttttaggtaacatatttcatatttgttctaaaatgatcccttttaaagtttcaataatctacagatttttaaagaacatattcatctatctgaagtagtagttagctgaaggaattccaccttttcttaaagttgaacagtttatttgatgtgatcttttttaaaaaaacaaactttctaaagaatgtgaaatatttatttccaagtgc

SEQ ID NO: 30796 - DNA, 219 bp, Homo sapiens
  misc_feature 200: n=a, g, c or t
ctctctaaatggacatgtgcacatttttgattttacaatcaatatgacaatgaataacttgtacacatgtcattttgaacacgtgagtatatgtgtagaataaattcgtagatgtaaattgcatttgtgaccttgatactaccagagtattctatcagctaccagtttactcacaccagctcatgtttagaattgcgttntcattagtcttgccaccct

SEQ ID NO: 30797 - DNA, 162 bp, Homo sapiens
cggctagttcccatatgctgataagacatatcaacagctaggtcttagcatttccattaaacaacagctaggtcttagcatttccattaaaaaaaaattacttggcctggtgtggtggctcacgcctgtaatcccagcactttgggaggccaaggcgggcag

SEQ ID NO: 30798 - DNA, 325 bp, Homo sapiens
caaatagcataaaaataaaggtataaagaaagatataccatgttaatactaatcaaaagaaaactggagtagcagtattgatatcagataaggcaaacttcagagggagaaaaatgatcagggataaagaggggcattatataataagagggtcaatactccaagaagacattgttaaatccttaatgtgtatgcacctaacaacagagcatcaacgtatgtgaagcaaaaactaatagaactgcaagagaaatagacaagtccactattatagttggagacttcaacactcttctatcagtaattgacacatttagcagggcgt

SEQ ID NO: 30799 - DNA, 401 bp, Homo sapiens
  misc_feature 269: h=a or c or t
  misc_feature 270: n=a, g, c or t
  misc_feature 271: y=c or t
cccttttaatttttaattttaattttttgtagagatggagtctcactatgttccccaggcaggtctcaaattcctgagctcatgagatcctcctgccttgacctctcaaagtgctgggattacacgtgtgagccaccatgcctggtccatagatcctcttgattcgtttgttggttgattgactgactgactgactgacaggatctcactctcacccaggctggagtacagtggtgtgatcttggctctctgcagcctcggccttctghnytcaagcgatcattctgcctctgcctcccaagtagctgggactacaggcgtgtgccaccatgcctggctaatttttgtattttttgtagaggtgggatctcactatgttgccaggctggtctcagactctt

SEQ ID NO: 30800 - DNA, 355 bp, Homo sapiens
atgttgaccgcattcttcttaaaatagaaaagaaaggagtttttagccatccttggtgattgtaacttactagggaccatttggaattagtaagcctttctactcactcccaaacatcatcttaatctcctcacttttataacagaagaacccaggttccaaaatgaacaggactcaagctgtttgcctagaacctcacaattaaatgactcttctgaaatggatccctcaacacagatttctttaaatagaagagcagtagaatgggacaccacgggacagaatcttattaagaaagtgagaaatcttcgccagagactcactgcccgggctcgtcacagatgtcaaacccctc

SEQ ID NO: 30801 - DNA, 380 bp, Homo sapiens
  misc_feature 190: k=g or t
  misc_feature 191: w=a or t
  misc_feature 209: w=a or t
  misc_feature 210: h=a or c or t
  misc_feature 323: n=a, g, c or t
  misc_feature 324: n=a, g, c or t
  misc_feature 326: s=g or c
  misc_feature 344: s=g or c
attttagccaaacaacctttaattcattgagctcaaagcttagcagcttcaatgttgttgttaggcataaacagcttgcaaatttcaattttttttctctcctcacttttgaactagatttgggcaatggaggtgatgacagcattttagaagacagaacaggaattctaggtgtttaggcacgttgaakwgaaacttgctagaggtgwhtaagtggaaagaaaaagacaattcactatagggttcaacattattgcagttctgcaaaggatattttcttttaaaacatccatatctcttctttgccatggaaactacacccnntstacctgaacctgcggcasccctctgatgacccatttggattctctgatttcact

SEQ ID NO: 30802 - DNA, 275 bp, Homo sapiens
  misc_feature 31: s=g or c
  misc_feature 87: v=a or c or g
  misc_feature 90: r=a or g
  misc_feature 92: w=a or t
  misc_feature 105: s=g or c
  misc_feature 106: m=a or c
  misc_feature 112: s=g or c
  misc_feature 116: y=c or t
acatatcccctcctggaaaggctgcagtgasgcagctctgtttcattctactgccaccgcctctggtcctagaaaacactgagtttvctrgwcctgcatcacttsmacggasataycaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagacca

SEQ ID NO: 30803 - DNA, 290 bp, Homo sapiens
atttcccttttttggttacactaatggtagtatactataaaaacaattataattatacacctaggttttgttatacttttaatatattgaggaaatcattccatatttatatttattatagagctacccagtattaaaacctgcctagcattctatgctaatagtgccatattaacatttaatacatgttgtttgctgtattttgccgctacaaattacactacaaataggccgggcgcggtatctcacgcgtgtagtcctagcactttgggaggtgcggcgggcggatg

SEQ ID NO: 30804 - DNA, 383 bp, Homo sapiens
taccgttgcatggccagaagaatttttagagtctatgtaagaacagtagcatttcaccttgattttttgggtcctttgatttcagaataaataccaacactctagttcaggaacttttatctttttatgagaaatgttgaacatttcacagttagttcaacaattcaacaaacatttgtcaatggtctgctttgcataaaaataccaggcttccttcaaagagcttgcagtcatacctcttattccataatacataccatagtatactctataataaatttaacttttaagcttaagggaatataaattgtctttttagatcattaaatggaattctttaagattttgaatataccctgtactgttgatgaactccttagtgt

SEQ ID NO: 30805 - DNA, 134 bp, Homo sapiens
aagataatttctagagaaaaagatgtacgggtgattcctggtgaaaagcagggaccgtgggcctcatattgagacacatttcacgctgtttagattgtaatggcaattatgtatgacttttgtacgttttttaa

SEQ ID NO: 30806 - DNA, 73 bp, Homo sapiens
catgatagaaattgggaaaaaaaatggggaatgaagtttatcagcatttcagacttgtttttttttttttttt

SEQ ID NO: 30807 - DNA, 431 bp, Homo sapiens
  misc_feature 197: b=c or g or t
  misc_feature 198: w=a or t
  misc_feature 199: n=a, g, c or t
  misc_feature 207: n=a, g, c or t
  misc_feature 208: n=a, g, c or t
  misc_feature 209: n=a, g, c or t
ctaaaaccataaaactgttagacggaaacaggggtaaatccccgtggccttagatttggcaatagtttcttacaagtgataccaaaagcacaagcaacaaaagaaaaacagataaattgaactttatcaaaattgtgagtttttgttctttaaaggacactatcaagaaagtgaaaatacaacccacacaatggaabwngaggtttnnnaagtatacactgggtaatggcctagcacccagaatctataaagtacccacaactcaataacaaaaggacaaaaatcggaaaagggtcaaagtcaacatttctcaaaagaagatgcacaaatggccaacaggcacaagaaaagattctcaatgttttagtcattaggaaatacaaatcaaaaccacaatgagatacaactttacgtatactacaatgcctata

SEQ ID NO: 30808 - DNA, 373 bp, Homo sapiens
  misc_feature 18: s=g or c
  misc_feature 325: r=a or g
cctaagctaatttctctsagaccagtattattctgattagtattagtatgaatccatcccctgtgcatctttttccatcccctgtgcatatgttacgtataaactttttgaaatttttctacagttctcgaattcctattgttttaaaattttcagtcatttttattgtgaagttcctattgacatatttttaagtcactgactcttggcagaatccattccactgatgagcccatcaacaacattcattatttcctattagagtgtttcgatttgtagcctttcctttttattctttcttagtatttttatctctttgattacrttgtccatccaattttgagtattgccttctttttctatgagagccctt

SEQ ID NO: 30809 - DNA, 190 bp, Homo sapiens
  misc_feature 104: y=c or t
taggctgaggcttattttaagagatctattttaatatatggcacctatttcattttgaaaatcagagctaacttttaagaactattgaaaagtctctgaggggyaagattgtgctggtctaagatcaaatcattgtttaaaatattttccttatttcagtttttctttcctttcaaggaataagtgggca

SEQ ID NO: 30810 - DNA, 155 bp, Homo sapiens
agccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccc

SEQ ID NO: 30811 - DNA, 156 bp, Homo sapiens
atacagtcattatcaaacaacatatttttgataaagttattattacaaaacataaactatattttgtttttaaaattagccaatttgttctgataagtttatatatggcaagataactcagtattctacaacacattttctttattccaaggagca

SEQ ID NO: 30812 - DNA, 190 bp, Homo sapiens
caacaaaaggcaaaatagacaaatgggatctaattaaactaaagtgcttctgcacagtaaaagaaactatcaacagagtgaacaggcaacctacagaataggagaaaatttttgcaatctatccatctgacaaagggctaatatctagaatctacaaagaacttaaacaaatttacaagaaaaaaaaaaa

SEQ ID NO: 30813 - DNA, 282 bp, Homo sapiens
agcaacagaagaaaagtatagaacctcgtgtcaccaactgctttctgtggagagggggatggagctggagctgagatggaggcagcagaatgggcaaaccttcagtcctaacaacctgcctgccctagcctccacacttttccttaaaaaaaaatgtatataatttataatataggcagctctttcaggatctctcaccatccctgagccctctaaaaactgtaattgatgggggtgggatgtatagatatgaatgttctagagcagaaaaacccggggctg

SEQ ID NO: 30814 - DNA, 164 bp, Homo sapiens
actccaattacagccctgtcctcagctggtcactgtttatgctaacagttataaacagcttgaactcgctgttctgagaggcaacacgccttccattctcactgcaatgcagctgctttggtggatggaacatgcctctcttccctccctccctccccctctta

SEQ ID NO: 30815 - DNA, 258 bp, Homo sapiens
caaacatcccaatagaaaaacatctaaaaatataaaaacaagcagtttacaaaaaggaatataaatggttcaaaaaatgaaaggaaaaaaaggctatcctcattattaatcaaagacataagttaaaacattttatcatttttacataaaactggcaatgattaagaaaaacagcacaatatctagtattagatggagctagggactctggattctctctcatggaatcaaaattaccataaattttaaggcccgtcc

SEQ ID NO: 30816 - DNA, 145 bp, Homo sapiens
  misc_feature 109: y=c or t
caaatgttttagcatcttcatatgcggtgttaacccctagttccgtacagcatattctgttcaagtatttttttacaagcttgtgctgtaggcacatgccttctgctgyagaagtggacgcccgtggcacactcccccccccccc

SEQ ID NO: 30817 - DNA, 466 bp, Homo sapiens
  misc_feature 296: n=a, g, c or t
  misc_feature 332: v=a or c or g
  misc_feature 335: r=a or g
  misc_feature 453: r=a or g
agaggttggctgggctccgggagacaggacgtgaggctggagtggctgcagcctcttgcagacagtggaggctcaggctaagccagcaagaccaagaggagcacggagagctggcaagacgctggcccgatgatatcgcctgagccgtgaatcctcctggccaacgccagggcttcctcaggctttgtcattgcagggacacttccctccctccctccttctctgtctctctccccactgcctctctttctagcttaagccaatttgagatggattttctgtcacttgctgttganggagtcctggtccagcccaggtggatttcgtgcaavtgraaccacataatgcaagtctgtgtggaagtgatcgtctgcgatcggcgcgtgccttcgccttatgaacaggagccatgggtgacacgagcgcctcggctgggccgcggggtcgtctgargtcatctgtctca

SEQ ID NO: 30818 - DNA, 406 bp, Homo sapiens
  misc_feature 387: y=c or t
aaacagcattctgagacttcatcactgcttccacttatttttaatttagaaattttgtgggctgtttatgttttcttttctttgtgcctttattgaatactttatctcatttataacatttatagttttatataattaaatgtattataattcttttacaatttttttatcctaatttaaattttttaatatgggctctcactttattgcctaggctggaatgtagtggctgttcacaagcactatcatagctcattgcagccttgaattcctgaagtaatcctcgtgtctcagcttcccaagtagctgggactataggaacatgccgtcacacccggttaactgtactgtatttctttgagtatgattgcatgaaagttttccaaycctataattaatatagcat

SEQ ID NO: 30819 - DNA, 381 bp, Homo sapiens
  misc_feature 276: w=a or t
acaaacaaaaaacaaaaagcaagttcccagaagagaaaaaagaagttccagacctagtgaatcaaaaactctgagcgtggcatctcacaatctgtgtttttgtaatccttccaggtgactgattcatgctaaagtttgagactcattgctctatgccagtcatcattccctttgctcaggttagaatcatctggagagcttataaacgtccccatgcccaggctgcgcacagatcaattaaaaggaacctctgagggtgggactcaagcagcagtwaaataaagttcattgagtgattctggtgtgcagccgcagttgaaaatgttatatagcatttaaacaagacactatttaattaaacactatttaaattattaaatt

SEQ ID NO: 30820 - DNA, 243 bp, Homo sapiens
aaccaggaagaagttgaatctccgaatagaccagtaacaggctctctgaaattgtggcaattatcaatagcttaccaacaaaaaagagtccatgaccagatggattcacagccgaattctaccagaggtacaaggaggaactggtaccattccttctgaaactattccaattaatagaaaaagaaggaatcctccctaactcattttatgaggccagcatcatcctgataccaaagccggact

SEQ ID NO: 30821 - DNA, 327 bp, Homo sapiens
caaaaatatttggaaaacaaaaagggtagttgcatctgtactaaacatgaacagacattttttcttgtcattattccctaaactatatagtataataaatatttacatagcatttacattgtattagaagttataaataacctaatgataatctatataggaagatgtgtgtaggttatattcaaacactatgcctttttatgtgagggacctcttgagcatcagatgattttggtatccacaaggggtcctggaatcagtcccccacagacaccaagggatgactgtagtgcattttatctatttttacttctgttacctgggctc

SEQ ID NO: 30822 - DNA, 277 bp, Homo sapiens
caagcaaaacaacgttttggttaactaaggattgtgctaaagccgataccaggtccttcacacgtgtgcactaggaacaggagcgaacagcacagagagacgctccctgtgggacgcagcagccccgtggccccggcccagttcccagccaccctccctggctctgctcacaccagagatttccatagcaggagcggttggtgcagaagtaggttcagatgaacctcagttaacgtcgccacccctcctcccaccatggtaccctgtagaagccctt

SEQ ID NO: 30823 - DNA, 300 bp, Homo sapiens
ttgtttcacttcaagtcacagttatttaaggtgttaagtgagcacttaccgtaaatctgttgaatcttgttaaatattccagtggactctaaatactatagaggataagatctatcatttatttgaagaaatacaatgaacaagcttttttttaatcattagaaattttacattgttctttctttatctgaactcatatttctattctatttccccactggttttaatcctaatacatatttatggttgaaagtttggctaggtggggtggctcattcgtgtaaccccagcactttggga

SEQ ID NO: 30824 - DNA, 315 bp, Homo sapiens
  misc_feature 222: y=c or t
  misc_feature 223: k=g or t
  misc_feature 224: n=a, g, c or t
cctcagtagtgcatttttcagtccttgagccaagttgccttggttgaccaaagcacaagctgctttggttcctctactggctctccctcttctgctccatacggtttgcgtggcctcacgttacttgtccctcgccactctgcgctccactcttttatttcctcttcatcttttttgtcttttagtgatctcactcactttacagcttcagctgtagacacykncatctttatccccagctgtggtctctgttcagatccaggtatacatttcatgctggactccagacatccctacctggatagcccccagcgt

SEQ ID NO: 30825 - DNA, 308 bp, Homo sapiens
ttggattcctgttgttgttctttaaagtctaatagtttttctagtgcatgtcttagagttggtggttatgagtcaacttttccctcatatcccataggccctttcatatttagattcaggtaattgtttttaaaatgttttcttacattatacttttaaatatttccgttgttttggtatctaggaactaattatatgaatattacttctttgtctgttttcctttccagcttctttctctctgatcctttttacttcttatttcacttcattctcttgttttctggctattactaagtgctcgccat

SEQ ID NO: 30826 - DNA, 262 bp, Homo sapiens
taaggcagctttcagtttgcttagaaggcaacattggaatgttagagttcatcagaaacatagaattttaaactgtgagttccactgaatacattttaatgtctgtaggaagaatcaaaacacctatttaaagatggcaatgtataataatcattttaaaagtatttgattaaacctgataattttccagaaatgaaaaaaaaaatcagctctaaaaccaaagctgattttagaaaatttgaaaatgtaaatcagccctgga

SEQ ID NO: 30827 - DNA, 181 bp, Homo sapiens
  misc_feature 89: m=a or c
cccaaaaacacgagatttttctcctatttcagcagttggccacaacttcattgctgggaaaaggccaagaaagaagagagaactctcamcacaacatttcaaagggaatacattgccagaacttggaatactctactggacaaacatttcctccaaggacacagctctctgcctccacgtc

SEQ ID NO: 30828 - DNA, 221 bp, Homo sapiens
  misc_feature 85: w=a or t
caaaaacatccttgcagaatgattcaaaagacaaaagccaggctcaacttatagaatgttttggaaactggaagtaatgatacawttcacttcagaagcacttgtaggtctttactagtgctaagtattatggtgagctatcattaaagtgtgccatcttggataaaggccttttgcctactctcttctgcaattttgacacctcaatattcacaccctca

SEQ ID NO: 30829 - DNA, 246 bp, Homo sapiens
ttggatggtgaaagaggtgagaaaagaacgtcctagtgcaggacaatgagggaaaaaggaggtgggagcggaagtacaggtagtgaaagatgtctttgaggaatggtggttagaatacaaattttgtaaatgttttgggctgagttgtgtaagatcaaggggtggaaagattgtagaaagctttgaatggtagcttaagaagccaggcagtaggagaaggaagaggtggtttagatgggaagcagt

SEQ ID NO: 30830 - DNA, 166 bp, Homo sapiens
  misc_feature 55: n=a, g, c or t
  misc_feature 56: n=a, g, c or t
  misc_feature 85: r=a or g
aaaaatacaaaaaattagctgggtgtggtggcacacacctgtagtcccagctacnngggaggctgaggcaggagaatcgcttgarcccgtgaagcagaggttgctgtgagccgagatcgcaccactgcactccaacctgggcgacagagcaagattctgtctcaaa

SEQ ID NO: 30831 - DNA, 165 bp, Homo sapiens
cttgttttagtgaatctgtaattccaggttggtcctcctgaatattcccccaatctatctcccaaactgtattttccattttagttattggcagctccatcatttttgttgttcaggtaaaaatcttttgagtcattattgatttctttctctctcttagaccca

SEQ ID NO: 30832 - DNA, 229 bp, Homo sapiens
  misc_feature 106: w=a or t
  misc_feature 166: k=g or t
cacttagcataatatctttaagattcatccatggttgtaccatgtgtcaaaatttcctttctttttaaggctggataatgttccattgtacatatatatgtatgtwtgtatcacattttgtttatccatttatcttcaatggacacgtgggttgcttctacctttkgtctattgtgaatgatgttgctatgaatatgggtgtacaaatatctctttggtctctgctttc

SEQ ID NO: 30833 - DNA, 215 bp, Homo sapiens
  misc_feature 73: r=a or g
  misc_feature 138: k=g or t
tattttggcactgtcattatagagccttttgttttccattaaataggagtcagtaggacccaactgtcctggratgagaaaattttcctatttaggataatttatatttttcacctcaccggaggtgtgatgcctttkagtttttcagatttggagtatattgtaaatttttttaaatcttggcaattttatttcacatgattggtttgctaaga

SEQ ID NO: 30834 - DNA, 289 bp, Homo sapiens
  misc_feature 85: r=a or g
  misc_feature 105: k=g or t
  misc_feature 230: m=a or c
gtctgtagaccacgtgttgtcttccatggcctgtttctcctgctgtctgggtgagtgagcctgcaacgcaatgcccatgagagtraatgcctcctgacctaccckgctcagcactgttctagtgtcttggccttgaaagaaaagcctgacttcctgctgacacatgtggtaggggcatggcagctatgaggcacctcctacgtctgttttctggctgtggtgacttgggmtttttaaccttatatatctttttcctttactcaaaacaaaacaatttttagcacactga

SEQ ID NO: 30835 - DNA, 50 bp, Homo sapiens
atgttgaggagccgccgctgccgttgccgccgccgccgccgccgctttgt

SEQ ID NO: 30836 - DNA, 409 bp, Homo sapiens
  misc_feature 61: m=a or c
  misc_feature 89: n=a, g, c or t
  misc_feature 98: s=g or c
  misc_feature 102: w=a or t
  misc_feature 109: w=a or t
  misc_feature 147: r=a or g
  misc_feature 153: v=a or c or g
  misc_feature 154: w=a or t
  misc_feature 155: m=a or c
  misc_feature 233: k=g or t
  misc_feature 234: k=g or t
  misc_feature 241: w=a or t
  misc_feature 242: w=a or t
  misc_feature 246: r=a or g
  misc_feature 331: n=a, g, c or t
  misc_feature 341: d=a or g or t
  misc_feature 342: n=a, g, c or t
  misc_feature 343: n=a, g, c or t
  misc_feature 357: m=a or c
  misc_feature 380: w=a or t
tcaaattactttcccagtggaaatatttatgtttgttgttgaaactgaatgattttacaamtcattgagcttcttaacaaacaatagancagaaaagsatgwacatctwtcattttaaaatgttgcttcaatttacaaagactgtcraatttvwmgtattctttgccaaaatgctagggggaacaatatagctaagtcctactttcttcttgtttcataatgtctcacagtakktcttttwwcaaratagaaatcttctgtttattgttatgaattacagtaatttattagctcataataatctgctctacaatctttgtaatccaactgnagagtgattdnnttggccatgaacgmggtagtcttttaatatttgcttwatttgcatagtggttatgtgtgtgtgtat

SEQ ID NO: 30837 - DNA, 344 bp, Homo sapiens
  misc_feature 322: w=a or t
tgacaggatcaaattcacacataacaatattaactttaaatataaattgactaaattctgcaattaaaagacacagactggcaagttggataaagagtcaagacccatcagtgtgctgtattcaggaaacccatctcacgtgtagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggwgctaactatcctaaatatttat

SEQ ID NO: 30838 - DNA, 110 bp, Homo sapiens
ttataagcaggagtctctttctaacctgttggagcaaggcaaagagccctggactgtgtagcatgaagtgaaaataagatgggtgggaattttttttttttttttttttt

SEQ ID NO: 30839 - DNA, 343 bp, Homo sapiens
  misc_feature 80: k=g or t
  misc_feature 82: k=g or t
tgaatttaatgcctgatgatctgaggtggaacagtttcattctaaaaccgtctctcccacccccgagaaaccaaccccckgktgccaaaaaggttggggatcgctggtctgaaggtcataaggtgtcctgtcatctgtggatagccacacatacgtctctccagagccacgctttctattctgtttttataaaagcacatgcttttgtgaattttctgccccctcactttccctctctggccaggaggcttctttacctctgtctgcagaaatagccaccagctctgccctgggaaacttaaagcactgtattcctggaagcaggtgtccagaatcgtatcca

SEQ ID NO: 30840 - DNA, 358 bp, Homo sapiens
  misc_feature 126: k=g or t
  misc_feature 127: n=a, g, c or t
attgctacagtttttctacagtcctagacagtatgagttttgaggctgctcatgaattttgcaaaaaggaaggtaattggtttttgtgatggtaaaaatgctttcatgtgctccttcttgccattknagtaaacaatgtggatttctttattcatcccattatttagtgactttaggagcaacaaaaactaaactattgaaaaaataaatactattgaaattgcttgtttggaggacagctactatatgaaacaatgtccagtgtagaatttggaaacctaagatgatgtctcagcatactgcactttttgaagaaaacgttccttttgcatgcatttgcattatgaattttgaatgt

SEQ ID NO: 30841 - DNA, 402 bp, Homo sapiens
  misc_feature 79: r=a or g
  misc_feature 85: r=a or g
  misc_feature 86: r=a or g
  misc_feature 336: k=g or t
  misc_feature 346: m=a or c
  misc_feature 383: s=g or c
  misc_feature 395: s=g or c
cttccgagaccagtccacctacatcaggtcagttgtagcctgtgtctcccctcctgggggaccttcaccccctggggarggctgrrctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctccccttkctactctaamcagagggtatcttgtacataccctatagatggggttscttgtgcaagasctggtgt

SEQ ID NO: 30842 - DNA, 194 bp, Homo sapiens
  misc_feature 82: m=a or c
ccatcagagaacactacaaatacctctacacaaataaactagaaaatctagaagaaatggataaattcctcgacacatacamctctcccaagactaaaccaggaagaagttgaatctctgaatagaccaataacaggatctgaaattgtggcaataatcaatagcttaccaaccaaaaagagtccaggaccaga

SEQ ID NO: 30843 - DNA, 203 bp, Homo sapiens
caactccaaattcctatttggtgaaatgatccttcaggattgatggggtaataaaaacattctcggttgatagaaaactaaaaagaatttgttgaatgagtctaccctatagaccttgaaaagaccaaccctaaaggaagttcttgaaccagaaaggaaacatttaaaaaaaaaaagttttgggatgtcaggaataacgatga

SEQ ID NO: 30844 - DNA, 219 bp, Homo sapiens
  misc_feature 97: k=g or t
ttagtaacaacctttttttcaccgtttgacaactgggcattttataaattgtatccacagcataacttgtctgaaaaatagatcttcatttttcatkatgtacttacagtatcacatctctttctataggttgttctccaaagaagtatggaacgagtacagtccttttttcagaaaaataaatgccgtctccctctcaagccaagtctagtgggcagc

SEQ ID NO: 30845 - DNA, 322 bp, Homo sapiens
  misc_feature 306: r=a or g
caggtgtgaggaagaaaatagattttggaagttatgagaactgtagagagtgagttgagcatagtttgtgattttgagggcctctaaaagtattaaggcagcggcagccactgcacgcagacatgagggctaggctaaaacagtaaggtcaagttgtttggacagaaagtctacagggcgcagtcccggctcttgtgtgagaactccgaccgcacagccctgcacttcggctgtatgtaatgaaaagggagtgatgagttagggagagccagtgtgggagcagcttttagggctgttttttaaggratggaaaggggtgtag

SEQ ID NO: 30846 - DNA, 55 bp, Homo sapiens
  misc_feature 19: k=g or t
taaaatgctcacggcaaaktcagcagcactggtaagccaagactgagaaatacaa

SEQ ID NO: 30847 - DNA, 106 bp, Homo sapiens
atttttgcccccaaatttaaaagtatcacggaaggcagagctattacagagagaaaccaaccttttggttatcgcacagcagcttttatgaattaaaaaaaaaaaa

SEQ ID NO: 30848 - DNA, 221 bp, Homo sapiens
tatgttatcaaattcttgtattaccagaagacttactaaagaacagtagtctttgtgattacctaatactggatggagaggtgagctggagtagtgctaggggaatctaaatctaaattatttgtcgtattcagccaggatgagaaacgttgatttgattgaacaaataaagaaaatagaactaattttattttattttattttatttttttgtccggggc

SEQ ID NO: 30849 - DNA, 344 bp, Homo sapiens
  misc_feature 87: w=a or t
  misc_feature 142: b=c or g or t
  misc_feature 190: w=a or t
tgctcttctttgtaaaaagaaattgtctgtgtttgctgtgtccagttcttctgtccgtctttttttcatcattttcatggaagtatwtagaaaaatgtcacagacgcatgtatagtctcaaaataaacagtgtccaaccacbgtataggtcaagaaacaatgttactgtaaggtcagccaagagaaaggwtgaggagacccaaagtcaggcaagcaagctttattgagctgcttggctgctccaccacagttagaggaggcagccccccttacagactatagctgggttttgtagggccagaactgggtcggggtcggggagctgagtcgggtgcaagaggact

SEQ ID NO: 30850 - DNA, 444 bp, Homo sapiens
  misc_feature 24: d=a or g or t
  misc_feature 250: y=c or t
  misc_feature 251: n=a, g, c or t
  misc_feature 327: w=a or t
  misc_feature 333: r=a or g
  misc_feature 371: n=a, g, c or t
  misc_feature 372: n=a, g, c or t
  misc_feature 373: n=a, g, c or t
  misc_feature 377: r=a or g
  misc_feature 418: r=a or g
  misc_feature 427: w=a or t
cacacaaagaaatagaaatgggadtgtcattggatttctcagcagcatcactggaaattaggaaacaatggaatggtgtcctaatcttctgctgaatatttttaaaatatatgattttctattcagccaaactgttccatctgagataaaataacatgttcagacatccagagtctcaaatttactgccaatgcacaggacatttctggatgatttgctcctaggagtaaaccaagaaggaataaaactynggaaccagggtataggagaattgacatgaaagagagatgaggacagttcctgaagtgatggagaagggaagtcttwtgatgrcagctgtgtagtcaaaccagagcataaaccagctattnnngggraatagaaagctccaggaaggctacctcctggtaaagaatgrtttggaagwtatctgctgtgtctgaa

SEQ ID NO: 30851 - DNA, 276 bp, Homo sapiens
acataaatctgaccaagaacacaagcatcttaatttgaatccacaaagtttcatgtaatgaaaagaaatacataattttaattcaacccgagtgttttccaagaagattgtatttgcttaaattgctacagtaattcaagagacagccctgtctggacacagagttactgtggatttttaagagactcagttaaagaatttaggaatttctgattcatttaaaggatttacaaattcatcaacccctgaaaactaaagcaaattgaacaggaaaaa

SEQ ID NO: 30852 - DNA, 349 bp, Homo sapiens
  misc_feature 223: w=a or t
  misc_feature 225: n=a, g, c or t
aaggcagaaataagttctttaaaaccaatgagaacaaagacacaatgtcccagaatctatgggacacagctaaagcagtgttcagagggaaatttatagcactaaatgcccaccagagaaagcaggaaagatctcagatcaacaccctaatatcacaattaacagaactagagaagcaagagcaaacaaattcaaaagctagcagacaacaagaaataactawcnagaactgaaggagatagagacatgaaaaacccttttaaaaagttaatgaatccaggagctggttttttgaaaagaccaacaaaatagatagaccgctagccagactattaaagaagaaaagaga

SEQ ID NO: 30853 - DNA, 359 bp, Homo sapiens
aggcggatggacaaacggcactgctgggaccctgcttggccatgggggaaggacacacacagcctgggtgagtccccgaatcactgtaccgagtggaagatgtcagaggaaaccacgtacgcactgcaggaggccattatgcaaagctctagaagatgcaaattaacctacagtgactgaaggcagaaagaaaacaaaaagcagcccaaggcgaaaaagtcgatcctgtgccctgagcataggcagtcctgaggtgcgagcggtttcccaccaggctcttcttggcctttcgagaacttcagcccctctctgctgtttcctgttgctggcatccactttcccatctcacaatattttct

SEQ ID NO: 30854 - DNA, 131 bp, Homo sapiens
ttttactcaagggtatgaaagtgccagtatgtctagcacatgtgaaccttgcaaaagtaggaacagacattcagcccagactgaagagcctgttcaagcaaaagtattcagcagaaagaatcatgagcact

SEQ ID NO: 30855 - DNA, 179 bp, Homo sapiens
  misc_feature 32: h=a or c or t
  misc_feature 68: s=g or c
  misc_feature 85: y=c or t
  misc_feature 86: h=a or c or t
  misc_feature 95: s=g or c
  misc_feature 96: r=a or g
  misc_feature 107: m=a or c
agatccgcctccatcgcagccagaagcaagahgctgtcttcccgcccccgcgtgcctacaatcagccscagtctccctgggaaayhgacgagcgsrcctgagctggmttctgagctccagcgttttggggctagaagttgcggactagtagctgaggcggcacgggagtgtaggcgcgc

SEQ ID NO: 30856 - DNA, 338 bp, Homo sapiens
  misc_feature 80: m=a or c
  misc_feature 98: m=a or c
  misc_feature 121: y=c or t
  misc_feature 171: m=a or c
  misc_feature 274: s=g or c
aaatatgaataaagtaggactgctctcggtaatgggcgatgaagaggagccatatttgttgcatttgttgcatgtataamaatctagatatgcttaamacggaacagtattttaaaagtayaggtttcataaaatttagtagagttctctgtatagtctctaatcttagamaaatgttggaagggtaatttttaagtgtagtggtttgaagaacaaaccagaagcgcacaaacctttgtgtattttagaatatatttgtcttcattctgcggastcttgtgttgtaaaggtgcagaactacgtaaaaatagtgttgggcagacttacatagtacatct

SEQ ID NO: 30857 - DNA, 242 bp, Homo sapiens
  misc_feature 174: n=a, g, c or t
cgtagagtataaaacagtatgtggtgtggtggcataaaaaaaaacagacaaggtgtcaggagattaggattactggtttagctacagcctcttccttaatctatggtatctcagtctcagtgtactcacttacatgtaatatctaatggtatttgtacagaactaaaatacatnaattcataaaagttattaatgtgtaaagcactgataaagtttttttttgttgttgttgtttttttttt

SEQ ID NO: 30858 - DNA, 181 bp, Homo sapiens
cttgaattttatcaaaaaaaggtaatgacggatgacaattgagaagagcttctgagataacctgtttacagagagcagacacattacaactgaggtgaagctagtggggccgtaagtttagaaatcctaaattttcaaaagtgagtctgataaccaatcagtaatagaaaaaggttgggcg

SEQ ID NO: 30859 - DNA, 371 bp, Homo sapiens
  misc_feature 230: d=a or g or t
  misc_feature 231: d=a or g or t
  misc_feature 304: w=a or t
gtatttcttgcccacagtgactttgtgcttggccatatgacttgctttggtcaatgggacaatggtaaatgtgaagcaagcagatacttgaaaagtgcttccagattgtggcctgccctcttttgatgtttttggacatgtaacaagttatcaagtcctagctagcttgctggatgaggcacaagactacatggaaggcaactgaagcctcctaagtgacagccagccaddtattacacatatattgaggacatcttagatcatccaattgccagctgaccccagctgattgcaaatgcaagawagaacacagccaagccagctcacaacagaagaacctcccagctggcccacagaaaactgagctaagt

SEQ ID NO: 30860 - DNA, 256 bp, Homo sapiens
catttaggacatcattgtcatttacctggagaagtgtaacagtctgagttagtcctgcggcattgatttttgtccccttctcatctgctctccacactgcagtcagaatgatctttctaagagtacatatactcatgccactcctccgtatctgaggacccttaggataaaatccagagtccttcctgtggcctcccatgccctgtgtgatccaccctctgatgcacccctctgctgcctcacctttccctgtctg

SEQ ID NO: 30861 - DNA, 367 bp, Homo sapiens
  misc_feature 322: b=c or g or t
  misc_feature 323: n=a, g, c or t
  misc_feature 336: r=a or g
ctataacctgtgatatcaagtgttttaaacctttgacatttgacaaactttccaaaatcaaattataaattatgtctttttctgacctaattaatccttaatatattaagttccatacagtccaaaaatgacataatttgtcttatttggtataaaaattatataggaagtgttgtcaaatatgaaatggtgtttgggtttctttgggctgtgtttgtataaatatgttattggtatgtgttcccaaatcataggaaacttctataattctgatatgacttagtgtacattatcagtaataattataattattatgttaaabnatcgtgtgccacrgaggtaacaaattttcttgtcaatggtgcgt

SEQ ID NO: 30862 - DNA, 59 bp, Homo sapiens
catttcctaaacaatgtattgtgacagtaaatatgcccaagctcaccagcatattttta

SEQ ID NO: 30863 - DNA, 356 bp, Homo sapiens
taaaataagaaacttaaagttagttttgagaaaagatatcaataacatttatgatttaaagggatttgaagaggaacttttgctttctacacaaagcctcctcattcattgaagaggaaaactcttggtggggacaagagtgaatttactttaaataccaatccactgactaatcccaagtctgggaatgcctccaaaatgttgagttgatgtattattatttatgtagaaacacccatttactgtaagtttccttcaaaacaaccctcgttgctgttgcagaaatcataggctgtgacgctggtagccacctacacattccttctagaacacgtatatttttccccaagatataa

SEQ ID NO: 30864 - DNA, 251 bp, Homo sapiens
agagtgtaaagaggtcctgggacaggctttgcacgttccacaagagtgtctcgctgtgtcgtctagactggagtgcagtggtgtgatcatggctcaactcctaggctcaagcgatcctcctgcctcagcctccggagtagctgctgggactgcaggaacgtgccaccatgcctggctcaaacacaaagttttttcataaaactcacttggcggcaaaattctaccttacctgaagttatttacggggtgca

SEQ ID NO: 30865 - DNA, 330 bp, Homo sapiens
  misc_feature 105: r=a or g
  misc_feature 109: m=a or c
  misc_feature 113: b=c or g or t
  misc_feature 115: s=g or c
  misc_feature 139: k=g or t
  misc_feature 152: m=a or c
  misc_feature 153: r=a or g
  misc_feature 164: m=a or c
  misc_feature 170: r=a or g
  misc_feature 177: r=a or g
  misc_feature 191: m=a or c
  misc_feature 192: m=a or c
  misc_feature 307: m=a or c
tgagaatattagacatcctgaaatggctgtgggactctgtggggatgctaaggctggagatataaatttgggaggctgggcctctttaacatcaaaagatgaggrtgamaaabasaagtttgcaaaaaagactgggaakggccttcaacgamrtaggaagaacmgttgtraaatggrgactcgagtgaaammggttgggagcaaggacctttggcaagtgctataatatcaagacattacattatataaggtctaagaatttacaatggtttaggcaagagaaactttaaaggtaaccctgactaamatgattttcaaatgaatgatgga

SEQ ID NO: 30866 - DNA, 130 bp, Homo sapiens
atctgcttattatgagagtgttttgagaaagccaaagctttagcagaaaaatgcccaggaaaacttcaccagagagtccttttctatcacagcaaaggttctgctcacgcctctcatcaaacgggacacc

SEQ ID NO: 30867 - DNA, 306 bp, Homo sapiens
taaaaagaatcatctaaaatactaaaaaagcaagaatatgttgtttcactagcttttgattcctaaagtagattttgacttccgggtgtgggaaggtgggtggaaaatgagtttttgttaatattcaaaggcatgaaaacatttttaccagtttatgttttcctggtgcatttagaaatctgtggatccttggggatggtgtatgcaggcaaatagagaatccagtacttgtgaatctgcctgaatccacaggtttgggaataagggcagggacttgagggttcacagatgtgaaggttgtacaca

SEQ ID NO: 30868 - DNA, 300 bp, Homo sapiens
  misc_feature 246: r=a or g
ttatttatttatttatttattgagacggagtctcgctctgtcgcccaggctggagtgcagtggtacaatctcggctcactgcagtctccatcttctgggttcaagtgattctcctgcctcagcctcccgagtagctgggattacaggcacccaccaccatgcccagctaatttttgcatctttagtagagatgggtttcaccatgttggctaggctggttttgaactcctgacctcaggtgatccrcctgcctcggccacctaaagtgccggaattataggcgtgagcaccgcaccatgc

SEQ ID NO: 30869 - DNA, 102 bp, Homo sapiens
catgagaaaaaatcctaaagtaatttatcaggtcagagaaaatgatcccatgtcatcatgcccagtaaatatgaaagaaggccatccacccttttttttttt

SEQ ID NO: 30870 - DNA, 200 bp, Homo sapiens
  misc_feature 82: r=a or g
  misc_feature 180: n=a, g, c or t
  misc_feature 181: d=a or g or t
caaggaatgagttttataaaatgctaatgaaaatgatgctttttatgaaaatgatgcttgtatgttgattatgactgaatgrgtgaattaagttaatagtttacttggatcaacaaaatgaaattatcttcataaatgcttgattaaaatgagtaaagcaaatgcattcaccataactandttaaattataacccagatg

SEQ ID NO: 30871 - DNA, 276 bp, Homo sapiens
  misc_feature 88: m=a or c
tgtctagtaccaacttgaagatgttcattctgtatgtaaatcctgctgattgtagcattagttctttgtgtggtaagttagctcttamccaagcttctaatacaactttttgggtcctgacgttatgatttgattaatgctacctcataacctaaaagtgttaagcattcaaaaatgcataattttctcccagaatttgacatttcctgggaaaatttgaccaaaaaagaataagtaaggtcttattacctagcgattacagcatgataccccccc

SEQ ID NO: 30872 - DNA, 118 bp, Homo sapiens
  misc_feature 86: y=c or t
ctcctagaaaattttctattacatctgtgactcacattctaattttgttgaacagtgctggtctagaaccaggttcttgcacctcytaagtgtaccagcccaattctctgtctctgct

SEQ ID NO: 30873 - DNA, 198 bp, Homo sapiens
  misc_feature 97: m=a or c
  misc_feature 109: y=c or t
tatattggttacatgttgataatgttttggatctatactgagttaaaggcaatttattaaaattagttacttctatttttacttttttttttggagmcagagtcttgcyctgttgcccaggctggagtgcaatggtgtgatcacagctcactgcagccttgacctcctggacccaagtgatcctcccaattcagcccc

SEQ ID NO: 30874 - DNA, 313 bp, Homo sapiens
  misc_feature 82: r=a or g
  misc_feature 84: w=a or t
  misc_feature 85: w=a or t
  misc_feature 89: v=a or c or g
  misc_feature 92: w=a or t
  misc_feature 250: n=a, g, c or t
  misc_feature 283: s=g or c
gatttaaaagaagaagaaaagaacccagaatggttgaaggataaaggaaacaaattgtttgcaacggaaaactatttggcarcwwatcvaawgcatataaatttagccataagactaaataataagatgccactattgtatttgaaccgggctgcttgccacctaaaactaaaaaacttacacaaggctattgaagattcttctaaggaattctgttctcttgagggcattgaatgtcaggcctctgagnccaagctaagccatcatatccctagtgacctgsacgtatacatccagatggcctgaagcaagt

SEQ ID NO: 30875 - DNA, 377 bp, Homo sapiens
  misc_feature 88: k=g or t
  misc_feature 289: n=a, g, c or t
  misc_feature 290: r=a or g
  misc_feature 338: m=a or c
  misc_feature 376: y=c or t
  misc_feature 377: n=a, g, c or t
tcataataatggtggggcagtgtcatttcaggtatgtatgctctttgtgtaaagcctcctagaatttctctctaccatgtaaaagggkaaatttttttttagaggaattttgaatttaggaataacaacttaggtatgccctgtatcagtcacttaaatgcagtagctctccttataacaagcccacaaggtggatattgttacccatctacttatcaaatcagaagtctctgagagtgaataactttgtgactatctagtgtaggtgacacggtacagtttccaaccnrgtcctgcctggctgttcccatgacccctttgccccaatcccatgctamctcccattcaaagtgtgccagaagcatagtaccccatyn

SEQ ID NO: 30876 - DNA, 393 bp, Homo sapiens
  misc_feature 85: r=a or g
agcaagtgaaatttatagagaatttgagatactatgttgggagaatcagaactggattggaggtgaacatagagcagaaattcarggcatcagagaagagagaccaaagaaaggatggatgtgaggatggcacaaatatcctggcacccgaggctgagatccaggaacaattaaaaggtgaaactgatgtggagactcagagcaatgagccacttagagaagaggatggtacagacattcagtcactagggaggagagaggttaaaggtgaggatgataaagacacccaggaacttgggaggaaaaatcagggtcagttaggaaatgaatttagtggaaagattcacataccaaaggggaagaatcaggaacatattagaggcgaagatgggc

SEQ ID NO: 30877 - DNA, 157 bp, Homo sapiens
  misc_feature 86: y=c or t
  misc_feature 88: k=g or t
  misc_feature 92: k=g or t
cggaagaggctctctgagacaatatccatttttacatttcttggaaatttcatggcattcatttcggggaaaataaaagctgtccytkggckggagaaatgataccaatcagggcctgaaaaggctggaaaattatcctcctggagacgggaacctt

SEQ ID NO: 30878 - DNA, 187 bp, Homo sapiens
ccagaaggttgcttcaaagatggtcaacattatgaagagggatcagtaattaaagaaaactgcaactcctgcacatgctcaggacagcaatggaaatgttcccagcatgtatgccttgttcgtccagaattaattgaacaggtcaataaaggagactatggatggacagcacagaattacagccaaa

SEQ ID NO: 30879 - DNA, 347 bp, Homo sapiens
agggactctgactgcgcaagatggagtgtaggccggccggcgagactgcacctcccagcatgccttgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccggtgtgataaagcggaattgggaatatatatgtagccatgataaagaaaaaacgaagatcctaggagacaaaaatgttgatcccaaatgtgaagact

SEQ ID NO: 30880 - DNA, 321 bp, Homo sapiens
  misc_feature 84: r=a or g
  misc_feature 191: h=a or c or t
aagaaattggaagcttttataccaaattttccagaagcaaggtcaatttggaagctagtttacacctataacaattcacaataragacaagagctgacctcagtagggcctctatcagaccattagtttagagacaaaaatatcaggcctagcatctgcagtttttggtgaatatcaagatttattttcchgggaggccagcattgacctcagtctcagtttggtcgatatttatctcttagatcaataggtcttgatggtagctcaaacaaaagtcaatagccacctgttgactcacacaaagttagtggataatttaga

SEQ ID NO: 30881 - DNA, 380 bp, Homo sapiens
tggtagatatctcaagccttttgtcttttacacaatggtgctctatcctattgttttcttttcaaagaagcatctgaacacttgcatttctattttcctatccaaaggcatccacatctaagtgtgtttttaaagttgattaaaattatttttctgttaaagcattctgaaagtgtttgtctttacctagaatgatttgtacacactcgtggtcaactgaacatgaatgtcagtagtagtctaattatgggaagggtaaacgtgttagattaaggctcttaaagctctaaaccatataaactatggacttgtatcatgatttaactgttcttagatctttcttacacagtgattcattcctctatttgtacagtgtgcag

SEQ ID NO: 30882 - DNA, 245 bp, Homo sapiens
caagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttac

SEQ ID NO: 30883 - DNA, 228 bp, Homo sapiens
  misc_feature 98: r=a or g
atttagtgtcatcacttattaaaaataagactaatatgattataggtcctctgatttttttttagaattatagtgatatgggagtaaataaatatatrcgaaataattataaaatagaaaagattagtgcattcttagaactttaatgtcatgttaattgaatgttaatccaatgactttatctttcatttcaagattccttgcctgaatgaagtagtggaagcccaa

SEQ ID NO: 30884 - DNA, 86 bp, Homo sapiens
tggttgctttatgttctgtgtcacctgtccaggaaatctttgcttaccccaggttgtgaagattttctatcctacgtttttttttt

SEQ ID NO: 30885 - DNA, 385 bp, Homo sapiens
  misc_feature 84: s=g or c
  misc_feature 87: r=a or g
  misc_feature 288: h=a or c or t
ccagaaatctgtcttgtgaaactgaaactttgtccccatcgaacactggctcccgattcctctactccctccagcccctgggasccrgaaactgaaactttgtccccatcgaacactggctcccgattcctctactccctccagcccctgggacccaccattctactttgtctctatgaatgtggctctctaggtacctcatgtaagtgggatcacccaggatttgtctctctgtgaccagcttatttcactgcaccacgtcctccaggttcatccgtgttgtagcahgtcagcatcttctttcttaaggatgaataatattccactgtatgtacacatcacatttaatccattcacctgctgatagacacttgttctgcctttt

SEQ ID NO: 30886 - DNA, 281 bp, Homo sapiens
aaaagaagaaagctgaatcatactcgatgattattgatcatttgtatacagctcaagccctcaagtagcctgctgtaatatttactagttacaaagaaaagattcgttttgtcacagttacatgaaaggtgcttatatttgcaaatatggagacaaagttcatcttaaaagattaaaatgagaatctcctaaatgaagcatttggaatattgattagtataccagaaatggtttttctttttcttatgatcagcgtttttgccggttgtcaaatcccttcc

SEQ ID NO: 30887 - DNA, 117 bp, Homo sapiens
tcagctcactgcaagctccacctcccgggttcatgccattctcctgcctcagcgtcccgagtagttggcactacaggtgcccgccaccacgctcggctaattttttttttttttttt

SEQ ID NO: 30888 - DNA, 370 bp, Homo sapiens
  misc_feature 168: k=g or t
  misc_feature 169: s=g or c
  misc_feature 339: m=a or c
atcagattatatggaaaattgaagatacttaattttgtctgtcaacatgttccagaagaatattttttggggaaaatggatttacaatcaacaaataaacaaaaatgatggcatgtttccatgttttctttttaattggatccttatcagagtactcccaatcagatksttctccagtttagagttttcccccaagagattcagctcatccaagaaaaaggtgagaaggtcctaggcagtactagagtgaagcctgcctgattctcagctgattggccaaactcagaactctctcggtgttctgggtgcttttgacagacagtgggacgacctccccamcccagtactgctgacacagtgtcttccctct

SEQ ID NO: 30889 - DNA, 185 bp, Homo sapiens
  misc_feature 89: y=c or t
ttctattattaatagtaatggtagtgatggtgacgatggtgttgatgactggtagcagcagcagcatcttcctaatgttttaaattgtyattaaattttccctccaaaggaatcttaagtcactttaagaaaatcaacatgtgctgcatattttggagaaaataatttttaaatgtccggcagca

SEQ ID NO: 30890 - DNA, 385 bp, Homo sapiens
  misc_feature 278: d=a or g or t
  misc_feature 316: m=a or c
  misc_feature 320: s=g or c
  misc_feature 323: s=g or c
tttagcagcgcttcgtcagttcaaaccagaatctgtgttagcatcatagatgagagcagagtgggaaggccagaattgatgagctgaaagtcatggcgtaactgagactaggagctaacaaaaggctaaggccaggtcatttggccagggctttaagtacctccccgtacccccactgcagcctcagctagtatatgtgaatggctgacagagccgtttgtgaaatccctcaattccatcccgctgctgttatgctctgtagattctgtctcagtgcdtctggctcaggaacctagcattcatctaaaggcaacamtggsaascatcataaacaaaaggaaccttatttctgttgtgccagctttgcttttagttaattgccccc

SEQ ID NO: 30891 - DNA, 120 bp, Homo sapiens
gagtcagcgcggaacctctgcatctacggcgagctttcctggcctgggcgttggactcgcaggtgcctgccctcgctctcagtgaagggaagtcgcagagggcggggacgacggtttgct

SEQ ID NO: 30892 - DNA, 204 bp, Homo sapiens
cacaggtctgtaaggataaatgtgcaaaaatggttattgcagtagtcacttttggtagcagagttggaggcaatccttcaattggtcatcctagcaaaatgaatatataacatgtggcatatgcatacaatagaaaactaggcagcttcaaaaatacttatatatgtaaatgtacagttgttcttcactatttatggattccat

SEQ ID NO: 30893 - DNA, 393 bp, Homo sapiens
  misc_feature 109: m=a or c
  misc_feature 287: m=a or c
tggagtgagcagctgggttagttagttggctattggcatggcccaggtaagagaaatggtggcctggatgaggctggagctggctgaggagatggaaaaatatggggamagatttgagatgtttttggaggcagagtcagtaggtctggtgatggattatatgtggtggtgacagtagggaagggccgaggaggaaagccacgcttggaacatgagcagtcatgagttttgtgggaatgggaagcatgcctcaggggcaggagggcagctgccctcaggggaagggmaggaagtagggatggggaggatgccgccatgtgtccttaagctttggcgtcttcctgagtgaactggggtttatgatgatacctgtacctcagggtgaatgtttca

SEQ ID NO: 30894 - DNA, 162 bp, Homo sapiens
gatacgcctcccccgagtcagagcgggcgccctgtgcacagggactgcgttccctccccgcctcgcaatcccgcggcgccagggtcgcttttgggggcggggagcctgtacgcagccaccgttagggtcactcggctctgatctaggtcccatccgcctcct

SEQ ID NO: 30895 - DNA, 66 bp, Homo sapiens
aatagcattcttggaaatgaaggggtatggggactggaagagagatggggtgggactcctcttctt

SEQ ID NO: 30896 - DNA, 159 bp, Homo sapiens
  misc_feature 75: s=g or c
  misc_feature 97: b=c or g or t
caagatggtctcaatttcgtgacatcatgatccgcctgccttggcctcccaaagtgctgggattacaggcgtgascaccgtgcccaatgaaaacctbtattttcgtgatggctgcttatttatttatttatttatttatttatttttctttccctgccc

SEQ ID NO: 30897 - DNA, 352 bp, Homo sapiens
  misc_feature 324: d=a or g or t
tcatggttgcccagactggaatgcagtggcgcaatcttggctcactacaacctccacctcccgggttcaagcgattctcctgcctcagcctccagagttgctgggaaacaggcaggcaccaccacacccagctaattttgtatttttagtagagatggggtttcaccatgttggtcaggctggtctcgaactcctgacctcaggtgatctgcccaccttggcctcccaaagtgctggggttacaggtgcgagccactgcgcccggcccagaaagccttttagctgaccaggctactcccagctgagaagcgtggagggtcgagdtctcagtttctcctgatgtactctcccc

SEQ ID NO: 30898 - DNA, 281 bp, Homo sapiens
atttgtctccctttgaaataataaataggtaggtaaagacattagtcttaaagactgatttcttaatgcaaaagagaagattcttaacagagctcatttcaatctgcttttatttatttatttatttacttattttttgagatggagtctcactctgtcacccaggctggagtgtggtggcgcgatcttggctcactgcaacccccgccttcgggttcaagtgattctcgtacctcagcctcccaagtagctgaaactgcaagcatgcaccaccacaccgc

SEQ ID NO: 30899 - DNA, 407 bp, Homo sapiens
gtcaaactgcctaagtaggggttcgttctctccctgaagcacttgttcaactcctgttaaagccgcgtgcctcaaggggaggctggaccccaagtgtttacccacttaaatatgttctggggtttcaggtaaatgtttgtgggtttttttttccttacatgaataagtttggttttgatttttttttaattgaatgcaaaaaatttgtgttgtgatacaaattaagtttgtgacaagaaatgcccaaatccaaggacataagaggtcaagctcagggaaggaacctccttttcactcaggcttggggcctccagcgaggtttccagagcattccatggtatgagagacagtgaggagggagggcacctggcgcgggacttccagcgtcctggctcttggcattgtcc

SEQ ID NO: 30900 - DNA, 384 bp, Homo sapiens
tatatactacatatatttgtatcaaaactcttttcagatcagtatatcgaacatggaagagacatctgcattcccatgtttattgcaacactagtcacaatggccaagatttggaagcaacctaagtatccaatggcagatgaatggataaagaaaatgtggtatttatatataatggagtactattcacccataaaaaaagaatgaggtcctgtcatctccaacatggatggaactggaggtcattatgctaagtgatattagccaggcacagaaaggcaaacatcgcatgttctcacttaactgtgggatcgaaaaatcaaaacaattcaactcatggagacagacagtagaaggatggttaccagaggctgggaaggatgc

SEQ ID NO: 30901 - DNA, 127 bp, Homo sapiens
tacatacaaaaggttctgattttgacaatgttcatttggtctgttttattgtttttgcttttggtgtcacattgagacaaagtggtctcagtcagttctggggtcctttgcgcaagatgccccctat

SEQ ID NO: 30902 - DNA, 423 bp, Homo sapiens
  misc_feature 376: r=a or g
  misc_feature 377: k=g or t
gcacagtgaacaagaagataaggtcaaataggtaatagagggccatattacatagttttgttgatcatcattaggactttggcttttattgttagaggtggaaagccactgatgcttttgagcagaggagtgatgtctcatgtaaagattttaacaaggtcattctggctgctatgctgagaaaaatcgaaggatgggcaagaatggaatctaggaaactagtcatggactattgcaatagtctaggcaagagataatgttggctcgaatcaagatattagcagtggaagtagtgggaagtttttatatgctgcatatcttttgaaggtagagccagcaggactactggtgacaaatatacagtgtggtgaggagrkaggagtcaagtacctgagcaattgaaaggggatagagttgcttcta

SEQ ID NO: 30903 - DNA, 417 bp, Homo sapiens
  misc_feature 361: r=a or g
  misc_feature 394: r=a or g
aaaggctgtgtgaagtggaagctcaagaaatatcggaggaggtgtctggcacaatggtgcatgcctataataccagcactttgggaggctgaggcaggaggatcacttggatcaggaggtcaggagttggagaccagcctgggcaacatgactgggaagcgtcactgaggtccttcaaggagcaagcgaggccaggcacagattccagggacaccgctaaagcacatctttctcagcattgccagaagagaaatccgtggcgcaaatacggtgtcatgtgaccatttggcttcagttgactggaccagctactgtcatccatgcctggaaagtcatccacaggctggccagaagcccatgragtgacctggtacaaaagctttgctcaaaaggrccatgctctagctgaatgtagtt

SEQ ID NO: 30904 - DNA, 434 bp, Homo sapiens
atgcgtcctccctctccagtcccgcgtcggtcgccgcagtcacggagcgcacgcctccacctggatcatgagtgtgacagctggagctcctgcagcccatctgtggagcacaaggtgacagtgaaaatggaagtcatacgttatggaggttgaagcagaaaaagagagggatcccaggatcctgaagattctgtggaactgccatagcagcctggactgcccattacctcctgatttccatttcttgaatgtgagagaattaacccttgcctgtttaagccactgtagcagtctcttatagcaactgaacacaattccttactgatatagaggccctgagaagaatgaagaatttgaagtggtaaatggggaacggtttaattttgggtaatgcacacgaatccggaagtgacgccagaagaagaggaagtgaa

SEQ ID NO: 30905 - DNA, 375 bp, Homo sapiens
  misc_feature 71: y=c or t
  misc_feature 86: m=a or c
  misc_feature 171: k=g or t
  misc_feature 285: s=g or c
cttatgccaccagctttattctgtgtggattccagggacttccatgttgccaaatccaaagcaatctcttygctgcattgtcttamtctgtcccagcagtaattgacagttaccactctccggaagtggtctgtcatcttgcttcccgggcactgtgctctcctgttttckatcagcttctctagccactccttccctgtcttctttgctgattcctcctctgttccttggggctgatcctgggccacttttctctctgagccctctcctcaggtgatctcttcsattctcttggtattacatagcatccatgtgttggtgactcacaaatttttttgagcccagacatgtcccatgtgttccaactcgaggttc

SEQ ID NO: 30906 - DNA, 58 bp, Homo sapiens
  misc_feature 20: y=c or t
accacccaggctcccttgcytttggctgggtgcaacttccattttaggtgttggatct

SEQ ID NO: 30907 - DNA, 150 bp, Homo sapiens
cacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctcc

SEQ ID NO: 30908 - DNA, 291 bp, Homo sapiens
gtagaatgttgttggtactgcagtgagaggcatgcttccttagaccaggcaacatttcatttgttgcatttccagtttccaataccaactcacctacaaagattttaccaaaaaccttaggaccaataaatgtgaatgttggaccccaaatgattataagcaccacagagactaaccagttcaggaagtgttctgattgggagtccatatacccctgcaccagcaatggttactcagacacacatagcagaagctactggctgggtccctggtgatagaaaacgggctgat

SEQ ID NO: 30909 - DNA, 332 bp, Homo sapiens
tatacaaaaatcaactcaggatggattaaagacttatatgtaaaacccaaaactataaaaaccctggaagacaaccttggcaataccatctgggacacaggaacaggtaaagatttcatgacaaagacacaccaaaagcaatggcaacaaaagcaaacattgacaagtgagatctaattaaacttaagagcttctccacagcaaaagaaactataaacagagtaaacagcctacagaatgggaaaaaatatttgcaaactatgcatctgacaaaagtctaatatctagcatctataaggaccttaaatttacaagagaaacccccccccccc

SEQ ID NO: 30910 - DNA, 129 bp, Homo sapiens
tagctattttcagcgcttatggctctgttcttggagttatttctaaattcttattctcttttgtttgtaaggtttcttggctttgtttcctgtttgcagtctgatcccatttgctcttttttttttttt

SEQ ID NO: 30911 - DNA, 377 bp, Homo sapiens
  misc_feature 150: w=a or t
acagtggcgctacagtgcctggagctgcgctggtttttcctcggagtggagcctggtaaccgcgacttccccgccatgttctgtgtgttgctggctggagaagggtggttgacaaactccgacccagcacagtgtttctgtgggtcaaawctagaaaactatgtccaggctcggccgaggcggaaggatccgttcaggccaggagttaaagagctgcctgggcaacatggcgcgaccccatctctgtagtcccacctcagcttcccagatacttgaaccccaaggttcaaggctgcaatgagctatgatcccatcacagcactccatcctgcgagacggaggtaaacttgtctaaaaaaataaactatccaaatgcc

SEQ ID NO: 30912 - DNA, 357 bp, Homo sapiens
  misc_feature 236: r=a or g
tgtcaggtattctaatggaaatggttaatgttatagatttatgtctgtgatattctggatcattgattcttctaggatattgtctgtatttctggaaaataattcttagtaatacctgtggaaagacttttttttttaatacctctctcatagataattaatatagtagatttctttgcatacaccaacaatcaaattaattatggatccacaaaatgttttatactatagaaggrcagcaaagctgagttgagattgatgccattgttgagtagtcaagcctgctctcaaaaactgactttagctcccacatagcaacctcaaagtgtgcagtcaaatcggtggtttaataaagta

SEQ ID NO: 30913 - DNA, 265 bp, Homo sapiens
tgtattaatggattggatagaatgcaaatggtccctgtgtttttcatgttattccatgactcattttggaaaggagagaaccactagctggtcatcttcacagagagattgtttacattgtttctactgattttacaatatcaaggaggcaaaaggtacctctcagtgctcagaaaacgtaaactttgtattgagacagttgcattcttaaatgatcgtcataaggtctgtggtttaaaaaaaataaaactttaatggggattta

SEQ ID NO: 30914 - DNA, 289 bp, Homo sapiens
tgaaatgcaatgctgttccataacttttttatgtttattaaattgtattataaagaatatggcctagagttttctaaagcagtatttatcaatagaaggagtttgggaatttaaggcagggtagttctattttaagcagaagtaattcatgcactgcatgatttttatcatccctgtccctaagaactatgtgcttatagcacccaccagtcattttaacaattaaaaccactctgccacatttccaaacacggcctgtggagtacagttacttcctcccacccctaat

SEQ ID NO: 30915 - DNA, 313 bp, Homo sapiens
  misc_feature 86: k=g or t
  misc_feature 89: w=a or t
aaaagaaacacagaggaaatgctggaacaaacagttttagtcaacaatctgtttcagtgatatcctagtaactgtcatgaatatckctwtatgtaattatttcagcaaagcgtgctttcaagcacatgagaaagatacatcaattaatgactcatgtcctaagtataactaataaattatattttaacttaaaatttttttctatttaaaaagtttttgagaaaaaatctcagattacaaagcataactgcagaaataccaatagtaactctaagaatgcaactgtcagaatatagacacttttccccagagt

SEQ ID NO: 30916 - DNA, 381 bp, Homo sapiens
  misc_feature 34: d=a or g or t
tatacacacacacacacacatcaacaaggccaadgttgctaaaagtatagttcaatcttctgtatatttgttatgttttatcttcttgttttattggtgttggagaggtgtgttaaaaaacttctgaaatagttgtgaatttgttcatttatccatgtatttctgttaatgtttgctgcataaatataacaccgagggaacacaaattgggaattgttatatatttgttattatgaaatacgcttatttctaagattttgttttgtttttaatacaatctaattcttttttctgttgattggaacatgtattacctttacattcaatgaaagtaataatttattttggtttgaattcatcaactttctacttacctatccc

SEQ ID NO: 30917 - DNA, 359 bp, Homo sapiens
  misc_feature 308: d=a or g or t
  misc_feature 333: w=a or t
ttttgttcttcactatgaaaacttagtccggttcctgaaagtgacggttgagtaccccctaagactgtggtcctcagggtttctctttctcctgatagtctaccctcagcctccagcaagttgtcaaaattactgtgtaagtgtgcctatgagatttttgctcgatttgcttctgcgtcagaaaagcaggtctccactatgattctctagaatctcctttctctccacattgtagggtggtggcttgcctttcaaactcagttctctgatagatctcagaaaaatcattgatttccagtttgtctagdtctttcttgtaaaaataggagtgawgcaatttttatgacaatttaagattt

SEQ ID NO: 30918 - DNA, 434 bp, Homo sapiens
  misc_feature 420: y=c or t
tttctttctttttaaggatgaataatattccattgtgtagatataccacaatttatctatttatctgtcaacggatactgggttgcttccaccttttggctattttgaatcatgctgctatgaagatgagtgtacaaataactcttcaagacctgtttttaattctttgggtatatatgccgaagtggggttgctggattattttgtctcgtcgtggtttaaacttagggtttcctgctaagtagtgatgttgggcatctttttatgtgcatatttttcatttgtatttctcctttgataaagtgtcttgttcaaatatcttctcaatttttgagttttgtttattattgaattttcagagtcctttatatgctctagatgcaaatcctttataagatagatactttgcaaatatattcyccagtctgtggctt

SEQ ID NO: 30919 - DNA, 121 bp, Homo sapiens
aaaattaaagcattcctccagggaagctgattgcatccttgtaaatcaggaacaataaagatgggtggctttcttcccatgacttgctttaatggttgttttccttctgtgtgtcagcgtc

SEQ ID NO: 30920 - DNA, 150 bp, Homo sapiens
atgaaatttctcttgtttgggctataggggtgtgagataagtcttaggagctataattttatgtgaaattggcccagaatctagcataaggggcaagcttttaaaaaaagcaacagtccttactaatctatcagcagtgaacacaaatgc

SEQ ID NO: 30921 - DNA, 285 bp, Homo sapiens
aatgagataaatatcacctttgcaaatgcccttaatgggtaaagcctagattttacactgcagctcagcatatgagacaacttattaacactgtgtgttgtactgcacattgctgaggggtgttcaggctttgtctctctgcttggaatgcagctaaccctcctccagttaccttgcttgcacttagaggcttaagaatcttcccgtaggatatatggaaggtaaacctttgtgactcttttcgtagcaatatctgcgtatcttcattaatctgatcctgagacc

SEQ ID NO: 30922 - DNA, 305 bp, Homo sapiens
  misc_feature 67: s=g or c
  misc_feature 68: m=a or c
  misc_feature 75: y=c or t
  misc_feature 109: v=a or c or g
  misc_feature 110: s=g or c
  misc_feature 117: m=a or c
  misc_feature 120: m=a or c
  misc_feature 123: m=a or c
  misc_feature 139: s=g or c
  misc_feature 154: m=a or c
caaaaaaaaagaagaagtagataatctgaatagccctatatctatagaaacttaatagtgctgggasmtataggyattattatcctcattttacagatgtgaaaattgvsgctcagmgamgtmaagtctattgctcaasgtcatgtggctagamtatggcagagccatgattcagatccaggtcttctgattcttattccagtgtcctttctagcataccatgttgcctctaaagattgcagctccttatttactagaaaattgttcctgcccaatctacatctccacctcaccccatcttttct

SEQ ID NO: 30923 - DNA, 420 bp, Homo sapiens
agccacaaagaaggtgtggccagaacaacttgggctcctgctgaccaatgtcctctagggcctaggggacagaggaacacagagtcagcttcaggggccgaatgagcatggcggccttcctgagagaatatgccccaccacgaaactcagcccagtagacaccatcctggtagcggcttcggtagtggccgccgtggtgccacacaccgttgaggttggagtgggcacaggcatggtaccaccagcctccccgctggtacagggcacagttacctgaggggagagagagagtccatgtcctctcaccagaataaaagcctctacctgcacctcacagtgcaaggcttttgccaggcatcccctggcccctcccattcttattgaatacaagccctgatcttccatctcctcagcaaaaaa

SEQ ID NO: 30924 - DNA, 208 bp, Homo sapiens
  misc_feature 127: w=a or t
aagcttcttaccacttttgatttggaagtctccctatttgcagttttttactaacttaatatttatattaagaaaagcaccctgaattttcttttgacagtttttgatgtcagaagcaggatcaggwgaagacccctgtgaagccccaaggccagtaactaggtgctggtacccagggccgcagcactggctgctctctcacccagct

SEQ ID NO: 30925 - DNA, 189 bp, Homo sapiens
tgagtagtagagaagggaagcaatagatatcagtggtggctttgggagcagctgcgacagcaggggttgtagtttgttccactaatatttctgttatgtttcccccagaatcctggaatggctgttcccaggcttttttcaaagcaagtggatctgagcgggacaaaaggtgaaggcaggggacagctc

SEQ ID NO: 30926 - DNA, 146 bp, Homo sapiens
cactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaa

SEQ ID NO: 30927 - DNA, 338 bp, Homo sapiens
  misc_feature 96: k=g or t
  misc_feature 102: w=a or t
  misc_feature 108: k=g or t
  misc_feature 110: k=g or t
  misc_feature 118: d=a or g or t
  misc_feature 121: w=a or t
  misc_feature 122: w=a or t
  misc_feature 128: r=a or g
  misc_feature 148: v=a or c or g
  misc_feature 149: d=a or g or t
  misc_feature 160: r=a or g
  misc_feature 186: k=g or t
  misc_feature 189: w=a or t
  misc_feature 220: k=g or t
  misc_feature 221: w=a or t
  misc_feature 230: k=g or t
  misc_feature 310: w=a or t
  misc_feature 336: k=g or t
cattaaatggtaaatattattcacagttgagtcaggtagtgtaattataagcagacttgttttttgtactgcttttttgttttcctggaaattackaattgwctcacktkcatttggdttwwtaaacrtacctaccattgattctttvdgaaatctctgrcacaggtgtaaatcttctgccattgkgtwtaaacaaggcaattaatctgtccattttctkwtctttcatktcttttccctgtgaagacatctctcctggagcttgccattctccaccgtggataggttgctttcaaggataggtgtatawgctgtcatcatgagaactcccttcakca

SEQ ID NO: 30928 - DNA, 136 bp, Homo sapiens
  misc_feature 113: n=a, g, c or t
  misc_feature 114: d=a or g or t
  misc_feature 120: r=a or g
aaaattattaattgtttcacagactgcttaaagactgcattaaataaaaatgatcagaactttaaatgttttatttatagaagactatttatttatttttttactatcctgcndttttarggttttacacacgcat

SEQ ID NO: 30929 - DNA, 191 bp, Homo sapiens
  misc_feature 118: y=c or t
  misc_feature 122: w=a or t
  misc_feature 123: r=a or g
  misc_feature 124: s=g or c
  misc_feature 135: n=a, g, c or t
  misc_feature 171: n=a, g, c or t
gtacagaaaccttacaggggcttttcttgtttttcctgttatgtaaggtctgtgaattgcaccctcaagcagctcctttattgaaaatgcagtttcagccgggtgggtgtcgagcatycgtwrsccccagctttntggggaggctgaggcgggtcgttcgagtccaactgngcagcaaagcaagaccccgt

SEQ ID NO: 30930 - DNA, 295 bp, Homo sapiens
  misc_feature 13: m=a or c
  misc_feature 117: m=a or c
tttaatataaaamaggaaagatcggaaggctgagatggaggacttgcttgaggccagcctgagcaacataacaagactccatgtctaaaaaaacattagttgggcgtggtggtacamaactggtaatcttagctactctggaggctgaggcacggggatcacttgagcctaggaggtcaagactgcagtgagttatgattgtgctatagcactccagtctgggtgacatagtgagatcctagctctaattaaataaattaagtcaataaacaaataaaaacacgaaatgaagcca

SEQ ID NO: 30931 - DNA, 369 bp, Homo sapiens
  misc_feature 166: b=c or g or t
cattttttaattgtacaaaagaaacctttatttgtatccctttctgtctaaaactcaagagaactgtcaacttagataattttcaagaagtattgaatttttctccttggtttttgtggcctttaaagtaatgaaaagtagttctataaaggcaaatgggaaagcbatctctgccttttttactcctgtacctccctacttaacaagttaagaagttcattagactcatttttgtaaatactgtataatgagcctaattgtcacacaattttaggaaatgaagagactataaaggtcatggattccagctcctcttacagatgaatgaagctgatgctgagagaagctaagctgcttgtttaagagcat

SEQ ID NO: 30932 - DNA, 274 bp, Homo sapiens
  misc_feature 94: r=a or g
  misc_feature 104: k=g or t
cggtggctcactcctgtagtcccagcactttgggagcctgaggcgggtggatcacaaggtcaggagtttgagaccagcctgacaaacattggtraagcccccakatctactaaaaatacaaaaattagctgatgtggtggtgcaggcctatagtctcagctactcgggagactgaggcagaagaattgcttgaacccaggaggcggaggttgcagtgagccgagatcaaaccactgcactccagcctgggcaacagagcgaaactccatctcac

SEQ ID NO: 30933 - DNA, 240 bp, Homo sapiens
gaaagggagagataaggctcactagccacacacagaaaaacaggcagttaattcttttttattttatttatttagtttttatttttatttatttatattttttttgagacagagtcttgctctgtcacccaggctggagtgcagtggcgccatctcggctcactgcaagatctgcctcccaggttcatgccattctcttgcctcaccctcccgagtagctgggactacaggcgcccaccg

SEQ ID NO: 30934 - DNA, 58 bp, Homo sapiens
  misc_feature 9: m=a or c
caaatatgmtataaacctgagtcactcttcagagccttattacagtaacaccatgtta

SEQ ID NO: 30935 - DNA, 244 bp, Homo sapiens
  misc_feature 16: d=a or g or t
  misc_feature 213: v=a or c or g
cgaagatgataaagadaaaaaagaacttggttatttaacagtagaaaatggaattgcaccaaaccatgggctgacttttcctttaaattcatgcctcaagtatatgtacccaccaccttccagcacaatcctagcaaacattgtaaatgccttggcaagcgtgcctaagttctatgtacaggtccttcatcttatgaataaaatgaatttgcvcacaccttttggaccaattactgcgcgaccc

SEQ ID NO: 30936 - DNA, 281 bp, Homo sapiens
  misc_feature 106: n=a, g, c or t
  misc_feature 146: n=a, g, c or t
ttaggaaaaaaaactaaccagttatttttttactaaagtatgtgaattacaaacaggatttgcaatgaccaggcagaaagatatttaaaggtgtaattattctaanggaagatgagaaaaaattcatctgctacagattcaactgncttttaaatgcctcccttgtcatggagtaaatgactactcaaaaggatttcacaaaagacttaaatctcacccttagcaatcaaccggtcggccacagctcagatgcctcattagcaaaatgaaattgcacaacc

SEQ ID NO: 30937 - DNA, 344 bp, Homo sapiens
ctaccacattgttttatgtttcttttctatttgtccaaggtggtttgtgtttcttttcaattatttcccatcttctttaaaggtacattgatcattcgttatccttccattttctttgggataaagtatttttaaagtattcctttagatgataccctccttatacaaaaactttattgagagtagttataaatgctgaattgatggtagctggactccgcaggtaatttttcacattgttatctttggggagtgaacaaaatcaattattaaaaatttaacttaaaattatattttttgtgcttcaaagaccatcatcaaaaagtaaaaagttagtgcaccaa

SEQ ID NO: 30938 - DNA, 330 bp, Homo sapiens
  misc_feature 16: y=c or t
  misc_feature 81: m=a or c
tattgactagtagaayagtaagggggaaactgcctccgtgattcaattatctccgcctggcccacccctgacatgtggggmtaattacaattcaaggtgagatttgggtgggaacacagccaaaccacatcactccttcaatttttttctggtagatagtgaaggtcagcacctgtgggaaaggatgaaaaatgggtctgaagaagcaaatggaagaactcagcagagcaggagatgtgaatgctcacagagatacagctagagaccagcatgaatggtggaagtctcttggtagagtcttgcaagttgggaagagaaatcacacatgtt

SEQ ID NO: 30939 - DNA, 53 bp, Homo sapiens
aatatctgaattttgaaaaaccacaaagctacaaactgaccctcttttttttt

SEQ ID NO: 30940 - DNA, 120 bp, Homo sapiens
tatataatatccttgcttgagtcttagttttctcctcaacaaaataagcataaggacattttttcatagggcttttgtgaagattaatttgggtaggtaagtagagtagataggcagccc

SEQ ID NO: 30941 - DNA, 358 bp, Homo sapiens
  misc_feature 161: b=c or g or t
  misc_feature 162: d=a or g or t
ggctttcctgagggtcaaatgaagtacagttgacccttgaacaacatgattttgaattacacaggtccacttatgcatagatccacttatacagaattttcttctccctcttccacccaagacagaaagaccaactcgtcctcttcctccttagcctactbdgcgtgaagacagtcaggatgaagacctttattatgactgatctccaaaaagattggcttcagtatttcatggagtgctatgaattagaatcctgagtctctatattgttaattattttagtctcttggtctacgtgtgttcctaaactgtagtagctttcttaatttagttctaggcatactacattaggggataa

SEQ ID NO: 30942 - DNA, 412 bp, Homo sapiens
  misc_feature 228: n=a, g, c or t
  misc_feature 379: s=g or c
ttttttttttgagagggagtcttgccctgtcacctaggctggagtgcagtggcgtaatctctgctcactgcaacctcctgggttcacgtcattctcccgcctcagcctcccaagtagctgggactacaggtacctgccaccatgcccggctaattttttgtatatttagtagagaaggggtttcaccatgttagccaggatggtctcgatctcctgacctcgtgatcngcctgcctcgcctcccaaagtgctagcattacaggcatgagtcaccacgcctggccagtagtgattttttaaagcacatagggtatgcaaagatcagctgccatacagagaccatatgaattgtcatccaagacattgttattttcatagstgacactgctgggttctgtgcctcgcctgatgc

SEQ ID NO: 30943 - DNA, 286 bp, Homo sapiens
  misc_feature 172: r=a or g
  misc_feature 173: v=a or c or g
ctaagtatacatatattttgctatattattttctctctgttaagcattattcttttttttaaatggagatagggttaggttctaaaagctgatattccttcttttgtaagtaacccatttttcgcctctgcctggatgcctgtagaaatttattctttaaacatgtaacctrvattattgtttacattaagttttctttcagctcaatgatttttttctttatatatttgtgattttctggttttcacttttctgcttcttataaattgcctattttctgactcat

SEQ ID NO: 30944 - DNA, 146 bp, Homo sapiens
  misc_feature 116: n=a, g, c or t
  misc_feature 124: s=g or c
cctacacgactaggaacttgcacagtccgcctcgggcagcccaaagctcctctgcccaccctggctcccagagccctccaaaacaaaagccagagaagcactctccacccagcagncagacgcstccttcttgacgccaaccccca

SEQ ID NO: 30945 - DNA, 77 bp, Homo sapiens
aggagaattgcttgaacccgggaggcggaggttgcagtgagcagagttcgcaccactgcactccagcctgggcgaca

SEQ ID NO: 30946 - DNA, 336 bp, Homo sapiens
  misc_feature 325: r=a or g
tatgtgtaatgtctttattccttagactatggtctccgtggaagattactgatactcccactagtattaataacaatgttaggtaacattactgaatgtttactgagtgccaggtaatgttctaattgctttacatgtattaggctatgtattcctcacatgaaccatatgaaagagatactcttattgttgtcattttagaagtgaagaaactgaggcacagaaaacttaagtaattagtccaattcatacaggtagtatatggtagaactgaagcagttgggccccaggtctttttttttctttctttttcttctgccgccgrctcctccaacc

SEQ ID NO: 30947 - DNA, 219 bp, Homo sapiens
  misc_feature 83: y=c or t
acgttcctttcgcctcactgaacttcctccattttcgcttattcaccctggctagtgatttattctaagttttttttagggcyagaatttgcggtggagaaaggggctggggaagagaaagacgatcaggagtggtctctgaaaagtattgggtcaaaaaggcagtgtctgtaaagggtagtgtgggagaagagagcgacttgtagctatttttttttt

SEQ ID NO: 30948 - DNA, 271 bp, Homo sapiens
ataaataatacatgactattgttttctattgaatgtcaaagacttactgggtctttacacctctgtaaagtggaggttttggcatgagctgtttaacttggccaagctaggctgtcaaccagacaactcagtcctttcatgtaaatttttgggcaagagaagtctgctttgactgccttgcctgaccaaattaaataaatagttgccagatctctacttttatcctgcatgggataatatatctgtaaatgcatgagtttggaaaccaccc

SEQ ID NO: 30949 - DNA, 350 bp, Homo sapiens
  misc_feature 327: r=a or g
gtctgcaggatggcaccggacccctgcatggagtctcacagtgtcgccgggctggagtgcaatggtgtgatctcagctcactgcacttcgcctcctgggttcaagcgattctcctgcctcggcctcccaagtggctgggattacaggcacccgccaccatgcctggctaattttttgtatttttagttgagacggggtttcactatgttggccaggctggtctcgaacttctgacctcatgatctgcccgcctcggcctcccaaagtgctgggattacaagcgtgaccaccgcgtccggtctgcttaagtattttctatatgatagraagtaaaaatgctctgagagtaa

SEQ ID NO: 30950 - DNA, 373 bp, Homo sapiens
  misc_feature 359: v=a or c or g
tgtaatggaagcaatcattttgaaaagagttaaagttttttggtaagtcaaataaggatcaatgctgctgaaagctgggacaacacacgggccctgaccaaattggggtttctttgtctacctcataccttccaaatcaaaaaataatttccctagtattttaattactcccccaaatcaggaataacttcctcactgtgctgattttggttcttttaaaataaggtggtaatttgaaggtaatagttaaaccagtcatagattattctatgccattcttttcaaatcagcccactcaggtgtcagtcctacttttcttttgttgtagtcctctttattctcctttgtttctgctccavctcatcccccacca

SEQ ID NO: 30951 - DNA, 137 bp, Homo sapiens
tgtgtgtgtgtgtagcgtggctgggtcagactggattccttgttgagcatctagctaaaagaggttaagaggaggctcatatactgctgaaggccagagggctttgctgaacgctggtcatcttaaaaacgagcatc

SEQ ID NO: 30952 - DNA, 436 bp, Homo sapiens
gaatagaagttctaaggaaactcagtgatctttaagataccacagaaaagcagttcagaaatttatcaaataaacttagcaaagaggttgaaataataaaaagaaatcaagcagaaatcttagaacggagaaatatgtttgcagagctgaagaattccttagaggctttccaaagaagaatggatcaagcagaggtaagaatcattgagcctaaagataggctatttgaaaatacataaaggagaaaaaaatctttaaaaaatgagaatcaacaaagattgcctacaagatacagaaaattacctcaaaagaccaaatttgccaaatgagttggctcatgcctgtaatcccagcaccttgggaggctgaagcaggaggatcacttgaaggcaggagttcgagactagcctgggcacatagtgagacccccctctcc

SEQ ID NO: 30953 - DNA, 171 bp, Homo sapiens
ttagcatttagtaatgtggtttctggggtaggtgagttgggttcattcattgagcaaacatttcttgatcccctgctctgggttgggtgcaggccagggggctagggttacagagatgagggaagggcctagtttgcctttgagtgtgtgtctgtttggggaggcaggtgt

SEQ ID NO: 30954 - DNA, 433 bp, Homo sapiens
cctaacagatataataatagtgaaaatgcttggaatattgtgagaattaccaagatgtgacacagagacatgaaatgagcacatgcttttggaaaaatagcgccaatagatttgctcaacacagcattgctgcagaccttcaatttgtaaaaaatgcagtaactgcaaagtgcaataaaatgaagcacaatagcgcagagcaagataaagcaaagtatgactgtagctggtaaaaactggcgtgagaagatgaccctggcatattctatacatttcttgcctcaaaactggaatcaggcattcctccagagatccctgacttcttttgggagtggggtgtaggcaatgctattagaaactataatctggatactagaggtactcgttgtaagtttacattgttcatagtgtaatcacctgacagcttcttccc

SEQ ID NO: 30955 - DNA, 227 bp, Homo sapiens
atatatttgttggccagagatctatttttatatcaatgtgccttgcatgtatattaaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctgaggaagtg

SEQ ID NO: 30956 - DNA, 243 bp, Homo sapiens
cattaattgctgaaaggtaaatgagttacatattttgtttggaccacgtcacctgtacattttcaaagcctcggattgtttatcttgcaaggagagaaggggcctcttctccacagatgcagctcaaattagcaaaactgaactgtagagtttcaggcctttcccttccttaaaatgctgatagatttctagaccagactttgatatttattggcttcttggtcttgctgtttaaacacaccc

SEQ ID NO: 30957 - DNA, 182 bp, Homo sapiens
ctggtgtattggttaagcatcttatctctcaaatggttaatattacttatactttataaaatatttatttttaaattattctcatagtggtaattgcgtattgttttatctcacaggtagtctcccactattttatatctttgttacttcaagtaagacaatcttaaatatgagaggacaac

SEQ ID NO: 30958 - DNA, 286 bp, Homo sapiens
  misc_feature 159: s=g or c
ttcatcttgttttgtctagactccagatacagagggacagctggactgaggacaagcaattccatctagcatagggtctctcagggttggtgcatccagccacatgggcagggccagtcacatctagtctatgtccccagtgcccttggagttgcgcasttagctgacttgactccaaggaaattagtacagaagtaaccactctattaagtgtgttctgctatgttcacatgcctgtagtacctgcaaaccatgccaggttcatctaaagacataggggaagcta

SEQ ID NO: 30959 - DNA, 388 bp, Homo sapiens
  misc_feature 96: y=c or t
  misc_feature 295: k=g or t
  misc_feature 296: w=a or t
  misc_feature 350: y=c or t
  misc_feature 372: m=a or c
gtgaatgttggtgtgcccctacaattcccatatgggaaacttgatcttcaatgctatagtattaaaagatggagcctttaggaggggatcaaggtytcgagggctccatcctcatgaataggattagtgcccttatcaaagaggccagcaggaacttgtccctcccttcgaggtgggaggcggggctggactctggagctgggctcagacaccagaccaaaatgaggactagataaaacagggaaggggcaaaagcagcttttcataagacatgcccaccagtgtgccatgtcckwttactattgtcccaacaacactcaggagttaccgcccctttccgtggcagtgaycccacgacccagaagttcctamccttgtcctagaaatt

SEQ ID NO: 30960 - DNA, 123 bp, Homo sapiens
aaagatgaaggagctagagcaatgtggaaagtaaaataaatgtataatatatagacattagatgacagcagtgttgaagtagtcaagattatattactaaagcagagagaggaatcatggcca

SEQ ID NO: 30961 - DNA, 219 bp, Homo sapiens
ctattctccctagaggatcccttaggctctcaccagaaccttttgaaatacttttctctgaaataggttatttgatttctcaacccataacaggagtaagagtagccagttaaaagaggggcttgttgctggaaacaagcatgaccaaaaacaaggagtgatagctgacaacctgacagaaaagaaacaagaaaatatatgaagtatacataagacctc

SEQ ID NO: 30962 - DNA, 129 bp, Homo sapiens
tgaatggtggtatttttgaatactgctagatcctcagttgatcagattttatagtttttctccaatagcattttaataataattggtttgtaataataaataaaactttgtttaatattaaggaaagaa

SEQ ID NO: 30963 - DNA, 371 bp, Homo sapiens
  misc_feature 313: n=a, g, c or t
  misc_feature 363: d=a or g or t
ttgttgtagtgttgatgagaaaaaaataaatggattcccagctgggggcaccactgatgtggagtttgcatgttctcttcacgtctccgggtactctggtttcctcccacatatcaaagatgtgcactttaggttcactagagtgtctaagttgtcccaggatgagtgagcgtgaatatgtgtgagtgcgccctgtgatagaatgggctctgagtcagttcccgccttgttccctgagctgctgggataggttccagccaccagagaccctgaactggaataattgtgtaaataattattctaacttgttttnatgagtcttttttaaatgtatgtattacataactcacatttatgtctgtdtaatatta

SEQ ID NO: 30964 - DNA, 346 bp, Homo sapiens
  misc_feature 331: m=a or c
tttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggcggggtggagcggagctgctgggaggctgctggataggagaggggtcacggctgcggaagaggaggttcttcgggacaccgtggatggacacggcaaggaaacaccaggccaaccacagctggggataaaatagcacaaccacamcctgccgtccagacg

SEQ ID NO: 30965 - DNA, 151 bp, Homo sapiens
gtgtctagcgggatcgcttgcttggtaacccggaggagagattggaaaccgcggagtttcctttgggaggctgcggccagccggggctgacttgttatgttgggctccggaggccgttaagagccgagagagacatgaggtgtctctgaag

SEQ ID NO: 30966 - DNA, 168 bp, Homo sapiens
atcaagatacattgttaaactttagagttaaatagaagaactaacatatttaagagtaaaataagtgctcagcctcttctaaatacatgagacaaattgtcattgctataatttatgaaaacttctctttctattcataagacactttcttttttttttttttttttt

SEQ ID NO: 30967 - DNA, 209 bp, Homo sapiens
ttgtaattttggtagagaagcggttttgtcacgttggccgggctggtctcgacctcccaacctcaggtgatccagtaacctcggcctcccagcgtgctgggattataggcgagagacaccgtgcccagcccactttctttttcctttaccccactgatcactcctagtctcttactgatcctcttgcctaacctccatttttttttttt

SEQ ID NO: 30968 - DNA, 89 bp, Homo sapiens
  misc_feature 2: v=a or c or g
  misc_feature 35: n=a, g, c or t
  misc_feature 36: b=c or g or t
avtttcgcctcagaaggctgcctcgctggtccganbtcggtggcgccacgtccgcccgtctccgccttctgcatcgcggcttcggcggc

SEQ ID NO: 30969 - DNA, 344 bp, Homo sapiens
ttctcttcgtatttaaagtgggtaccttgtagataggatgtagttggatcttgttttaaacatttgatctcataatttattcttttaattagtaagcttagattatttctacttagttattgatgtttggatttaaatgtaccatcttgctagtcttctgaattttgggccttttttgtttattttttcctctttattttattttcagttccaggatacacgtgccagatctgcaggtttgttacacaggtaaacatgttccatggtggtttgctgcacctatcaacccatcacctaggtgttaagcccaacatgcattagctatttattctgatactctctct

SEQ ID NO: 30970 - DNA, 171 bp, Homo sapiens
caatttgccagttctgagccttatctcatttttttctgactttggcccctttgcacatagtatcttctgtgcctgagtgctcccactaccttcattggctggctgacaccctctttcaaactcagcccaggtgtcaaccccttcagggagctttcttttactgtccacccc

SEQ ID NO: 30971 - DNA, 384 bp, Homo sapiens
  misc_feature 292: k=g or t
  misc_feature 317: m=a or c
  misc_feature 322: k=g or t
  misc_feature 336: w=a or t
ccgcggatgctttgcagccttaaaccctgggacctctgctgcttcctttaagatgcaggtacttgattcatttgcttctcaaagagatcagatgcatcagaattaaaaaggtatttcaggatgggaggaagggggtaagagatgtctctgcagcttcttcaactgcactctgattcctcagatagcttactataatggagtaaatatttttgaagccattaaactagccactctaaaggaagcggtttttaagattttcaactttgttataaggttttatattgctaagggktctctttgattatgagaaaatttamccctkgtagcttcaaaatwataccttgttgggaaaaactgcattccataaatacacactgtagaaca

SEQ ID NO: 30972 - DNA, 254 bp, Homo sapiens
gactagttaatttattcatagtttgttttttaaaactacaaaagtgtttttttttcctatacataatacagagaggtatatagtatagagtaacacagtgcttgtttcacggtaccacaaagttccattcctcagtcttaaatctctgtaaccagcctttgtggttgctgtgtatcattccagatatttccatattttggtttagtttttgtttcttaaatgaaggggagaaagtgttgttttaacggggtacc

SEQ ID NO: 30973 - DNA, 140 bp, Homo sapiens
cacagagagtgagcatctgtcagatgctgccgctgcaagtcacacgagggctgagaattggtcacgagtgaccttgatgaacagttttggtgaagttatgggcaaagaatgacctgattgaagtgaatcttttttttttt

SEQ ID NO: 30974 - DNA, 368 bp, Homo sapiens
cgtggagatatgtaattggggtaagaacagggcactttgattatttggttcatttggctggaccccaccataacagtcaaggctggttagtggctataacaaacaccctgtccctttcagtggcttcacaccaagtgtatttctcgcctacagcacagtgcagtgttgtgggctctgtccacacagccattcaagcaaccagactccttctctctgctgcctccaccttcctcgaggcccatgtcattcaggcagagataggcaaagggagggaggccacgcacaggaggttcctgtgacccccggatgtagcacctttcctctgcttgggagacactggccggagctcacttgtgcgtccacacgcc

SEQ ID NO: 30975 - DNA, 311 bp, Homo sapiens
  misc_feature 311: h=a or c or t
ttagcgttagtgtttctgcatgatttcctttagtttataatgtaggaaaaaaatagttcttacagtctctcaccccaccagtgatttgatttagcaaaaccactggctttataatccttcctggcccttttgtcccattggcagggctctaacctctttactccagagaaaacacagctgttgtcgtcttctttctgaacagtgaagggggctacatcattttcaactgtattttgaagaattaatttgtgcactaatataaatgagttttctaaatttaaatgtttgaaataaagacaatttatataath

SEQ ID NO: 30976 - DNA, 290 bp, Homo sapiens
acaaaagttctccaagtcccctacctgattagctagacacagagcgctgactggtgcgtttacaaacctttagctagacacagtgctgattggtgcgtttacaatcttttagctagacagaaaagttctccaagtccccatccgtcccagaagcccagccggcttcatctctcactggcattggcagggcagcgggactttgcgacacctagcccgggcactccagcagcccagagggagctcctcccagacaatcaagagggaaagaggggaagcagaaagagacggtc

SEQ ID NO: 30977 - DNA, 228 bp, Homo sapiens
  misc_feature 204: s=g or c
  misc_feature 206: r=a or g
agttaccaagctcggtgaaggagacaagttcccacagctgactcggctcggctctcccaccttcccggcagcggccgcgagccctaattgtatccctccctttcctcgtgggggagcacggactgacttggctgaagaaaatgccagttctgtggatgtggccgtgacaagaggacgtgcggctggaagaggcagaaggggacsargaaaagcatgctttgaagagaa

SEQ ID NO: 30978 - DNA, 148 bp, Homo sapiens
tttattttttcctttcttccagtctgactccttggctggagaataaaccccaattacgccggcggggagcccaagcgctctcggaccgcctacacgcgccagcaggtcttggagctggagaaggaatttcactacaaccgctacctcc

SEQ ID NO: 30979 - DNA, 164 bp, Homo sapiens
  misc_feature 68: r=a or g
gtgttacttttaagtctcacaaacgaaagtttcttacattgaaaagactgtcaaacacagaataattrgaaatactttaactttcatgcctatatgacaatactgagctatactatttggtacttatgggtcttgaaaaagtcaggtaagtactctgtgctgac

SEQ ID NO: 30980 - DNA, 302 bp, Homo sapiens
tactactatggctatggatcttgataaagtatctgtttccatgtgtaatctcagcttagaagaaatctgtgtgggttgggttaattttggatctttgcctaataatgcatgttgatgttattgtgggtctgtgtttgtttttatttttatatgttgttagctgcagattaaccccagcccctctgtcttctgttaagtacagttgatactgacattgttcactcatcaaaccacatcttgatgctaagtaacatttcccatgagcctcaaaactgaatgctgaaaagctactagactggatt

SEQ ID NO: 30981 - DNA, 134 bp, Homo sapiens
caaataaaaacttgtggtattcctggtaatactgtccagaaataagagattagtataaaatactaaaggatgcagagaatcagctctcttctgcgtttaatagatgaaagcctttattgagctcagaagcagac

SEQ ID NO: 30982 - DNA, 57 bp, Homo sapiens
  misc_feature 50: k=g or t
  misc_feature 57: k=g or t
taaaaattagacaggcatggtggcctacgccctgtagtcccagctacttkggaggck

SEQ ID NO: 30983 - DNA, 398 bp, Homo sapiens
  misc_feature 382: k=g or t
cgagtgttacagaggagatctggtttctggaggtctccaggatggggctgtagcctaaaaggaagactatgtgaggcagcaggcaagcagcagcaagtggaaaggcttggagatgtggaggacgttatatggtactcagagagcagcagtacatggatggcaagtgtggcgttgtgctgccacccacttccccatgccaaaagcatataactgctaatcagttaccgcattttttgctgccgaattcgtaagcagccccaagagttctcaacaggatgcttcaggtggccactactaattatttggagttggcacgtgaggttaaacctgtttgtcttctttgtagtgggtgttcctgtgcctggagcgtaggatgtgtgtkggagtcggagtcagaa

SEQ ID NO: 30984 - DNA, 181 bp, Homo sapiens
  misc_feature 87: r=a or g
catacccttggatccccacagtttggtcctcctcccagctacccctttatagtatgacgagttaacaagttggtgacctgcacaaarcgagacacagctatttaatctcttgccagatatcgcccctcttggtgcgatgctgtacaggtctctgtaaaaagtccttgctgtctcagcagcc

SEQ ID NO: 30985 - DNA, 280 bp, Homo sapiens
  misc_feature 108: r=a or g
  misc_feature 221: d=a or g or t
ctggagggcgcaaggcgcggcgggggtgatgagcccttgggttctcgctccgactgctaaattcgcttggccgggtccaccttctcgtggcctcactcgccacacggrtcagaatccggagcaggcagttctctctattctgaggctcctgcggctgccgcgctgacttccctgtgtgcgggagggaactctgggcaggctggttttcttggaatgtgttdacgatgttgaatgggacttgaacaggaagctggacgctgcagctggaactagcgtgcct

SEQ ID NO: 30986 - DNA, 204 bp, Homo sapiens
gttaaattgaagtttttaattgttctgagtgttttaaaaattgtgaattttaaggtacttgttacagaagtcgagataagttcttgatttcaagataatctgtatgggagttggttgcttatattaaaacaattatatgcctatatgaaatgttttgagctaacaagtaggacagttttagatggtgatttatagaggagaacg

SEQ ID NO: 30987 - DNA, 194 bp, Homo sapiens
tagtaattaagaagacagacagacacggtggctcacgtctgtaaccccagcaattttggatgctgaggcaggaagatcacttgagtccaggaatgagaggctgcagtgagctatgatcatgccattgtcctctagcctgagcaacagagagcaaggtcctgtcttgttgagaaggaggagggaaaaaaaaaaaa

SEQ ID NO: 30988 - DNA, 327 bp, Homo sapiens
  misc_feature 182: k=g or t
  misc_feature 184: h=a or c or t
  misc_feature 285: s=g or c
  misc_feature 286: r=a or g
  misc_feature 304: v=a or c or g
  misc_feature 305: r=a or g
caggaatttggactttgttctagggcagtggggaggcattgaaggctctagaagcagcagagtgatgcggtcaggttttttttatttgcaaagaatccctctgattgccatggcgaatggatgggagaagcagaaagacagtaggtcgggggctgtcgtggtcatcctggtgagagactgakchgggcagtgggtgggagccagtgaggacagacagccgtcgatggagcaaaaagacacttgtgtgctggtctggctgcaaaagggagtgaggagtcaagggasrcttaaaatagcaaaaggvrgccaggagaagcaagcaggcac

SEQ ID NO: 30989 - DNA, 444 bp, Homo sapiens
catttctgttcttagttctcatgtttctgatttagagtttttaaatattcccaaatgcttattttaggatatataggctcactcctgtcatcccagcactttgggagggaagggtaggtggatcgcttgagctcaggagtttgagaccagcctgggcaacatggtgaaaccccttctctgcagaaatacaaaaattagccaggtgtggtggtgtgcgcctgtagtcccacctaccagagggagctgaggtaggaggattgcttgagcctgggaggtgaaggttgcagtgatttgagattgcaccactgcactccagcctggatgacagagcaagaccctgtctctaattctgtttgaaatgttgtgttaatttacttcagcttagtgggttttttttggggtggggggagtggctattttcatcaacaaatattttgattcata

SEQ ID NO: 30990 - DNA, 224 bp, Homo sapiens
atttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagataggaggc

SEQ ID NO: 30991 - DNA, 139 bp, Homo sapiens
  misc_feature 123: w=a or t
gatataaccgattatgatgcctgtggcagagaaagctgacaatactcaaaaaactaaatatattttaaccttggaccaatatttgagagctcagaatctctctaaagtatgtatttacttccwagtttctgatggaata

SEQ ID NO: 30992 - DNA, 424 bp, Homo sapiens
  misc_feature 306: n=a, g, c or t
  misc_feature 307: n=a, g, c or t
  misc_feature 308: k=g or t
ataataaggatttcctgctgttgaaatagctaggatttactagttatttacctgtattgtataacaaaacttggtcctatgaggatttgattccatccttgtctagtgcactcagtccaagtttgtttgtttgtttgtttgtttgttttccttgagacggagtcttgctctgtcgcccaggctggagtgctgcaatggctcagtctaggctcactgcaacctctgcttcctgggttcaagcaattctcctgcctcagcctcccgagtggctgggactacaggcgcgtgccaccacacccagctggnnkttgtatttttagtagagacagggtttcaccatgttggccaggctggtcttggactcctgacgtcgggtgatccgcctgccttggcctccagaattgctgggaggcctgtagcgtga

SEQ ID NO: 30993 - DNA, 401 bp, Homo sapiens
  misc_feature 92: s=g or c
  misc_feature 97: v=a or c or g
  misc_feature 335: s=g or c
  misc_feature 344: s=g or c
  misc_feature 348: v=a or c or g
  misc_feature 356: k=g or t
  misc_feature 358: s=g or c
  misc_feature 379: k=g or t
  misc_feature 387: m=a or c
cctgtcggggcttacatttaacaaagagtaagttaacaaagtggtgataagaaccacggtagcagtaaacaaggtgatgagagagtagttasgggavgccgcttaattagggtggtcacaggaagacctgtgcagctggcatttgagatactctctagaggctgtgaatgagtcatggaaagataggaggcaagagtgctccaggcaaagggaacaacaagtaccaaggtgtaaaatccagcaaggggttggcttcttccagacacagcatagcgggagctcggtgggcggcgtacgggacgtgacagggggttgaggctggaggcaagtgggascaggcgtgsagcvtgtaggckgsagtaaggagtgtagattttakcctgtgamcaatagaaggcatt

SEQ ID NO: 30994 - DNA, 261 bp, Homo sapiens
gttttggaatcattgaatcctgagatatccaggtgaaaggctggagtaattacaggtccggtctggagataaagacttaagagttaccagtagttccaaatttaccaaatttttttttgttctttttgagacggagtcttgctcgccaggctggagtgcagtggcacaatcttggctcactgaaacctctgcctcccgggttcaagcgattctcctgtctcagcctcccgagtagctgggattacaggcatgtgccaccac

SEQ ID NO: 30995 - DNA, 131 bp, Homo sapiens
tgtatagggagcaacctactaaaaaattaatcctatgacagttagtttggattttccaagatgtggaataatattatatttcttttataatggtaaatgaagtgattcttttgaaaaattgatggccaaac

SEQ ID NO: 30996 - DNA, 221 bp, Homo sapiens
gtattaagccaggcatggtggctcttgccttcagtcccagcactttgggagaccaaggcaggtggatggatcacttgaggacaagagttcgaaaatagcctggccaacaaagtgaacgtctctactaaaaatacaaaaattagtgggacatggtagcgtatatctgtagtgccagctacttgggaggctgaggcacaaggatctcttgagcccgggaagcc

SEQ ID NO: 30997 - DNA, 290 bp, Homo sapiens
aaatgacttaaagtagatgaattacattttgttatacatactcttgagtgtaaaatgttttcatccccaaaacttagttgctgctattttgtttcagacaaatttccaattttgaaatgttgccttgtagtgtggtatgaagtgctaactgttattataattgtattctcttttgtcaataagacaatatttggcttatttagttctgcattttacataatctaacctttgctaatttttctgtattaaaattatattgctaggagaagaagagagatgaaaattagtct

SEQ ID NO: 30998 - DNA, 193 bp, Homo sapiens
actttaaggcatttggaatcctgcatgaatttagccttgttcttaacacattttaatattttattaaataattttatacaggagaattgacaaaaacactaccaaatttctgtgtactctttaattagatttcctcagatgttaacatttatcatatttgtttatcattctctctctcttttttttttttttt

SEQ ID NO: 30999 - DNA, 282 bp, Homo sapiens
  misc_feature 73: r=a or g
  misc_feature 88: m=a or c
  misc_feature 90: w=a or t
  misc_feature 92: b=c or g or t
  misc_feature 94: r=a or g
  misc_feature 99: v=a or c or g
  misc_feature 100: s=g or c
  misc_feature 114: y=c or t
  misc_feature 115: v=a or c or g
  misc_feature 119: v=a or c or g
  misc_feature 218: m=a or c
  misc_feature 235: y=c or t
  misc_feature 236: n=a, g, c or t
  misc_feature 237: r=a or g
cagccttgctgccatgaagccacatcttccccatctagtacttgtgctggtggttttttggcatttgttcctrctaaatttcatgacmtwabgrttcavsccattgtccagtcyvtcavgaactttgtcatccaaaatgctggcttctcccttccaaattcctgttaccagaagacataatcttgcttttctatatcattacccaaattcttgatttmaaaatattgtatagggynrggcgtggtggctcatgcctgtaatctcagcactttgggaggccga

SEQ ID NO: 31000 - DNA, 402 bp, Homo sapiens
  misc_feature 96: r=a or g
  misc_feature 335: m=a or c
  misc_feature 337: h=a or c or t
  misc_feature 338: v=a or c or g
tttaaatgacaaagattcatataatccaagagagaagtattatttagagggattcttttaccatgtgatatataataaatgcatccaatgttaatrcatcaatttaaaaaacaagtaaataactttaaagaaaagataactactggccaggtgcagtggctcgcacctgtattcccagcactttgggaggccaaggcaggtggatcatgaggtcaggagttggagaccagcctggccaagatggtgaaaccctgtttctactaaaaatacaaaaattagccgagcgtggtggcgggcgcctgtaatcccagttactcagtagctgaggcaggagmahvgcttgagcccgggaggcggaggttgcagtgagttgagatcatgccactgcaatctagcctgggt

SEQ ID NO: 31001 - DNA, 312 bp, Homo sapiens
  misc_feature 81: k=g or t
  misc_feature 86: r=a or g
  misc_feature 92: k=g or t
  misc_feature 96: s=g or c
  misc_feature 102: k=g or t
  misc_feature 113: r=a or g
ttcatatacatgcatttcaccatttaaagtgtacaattcagtgacttttgtatattggaagagttgtgcatccattaccgkagtcrattttkgaasaatttkcatttccccaraaatagactcttttcttcttggttgtcaccccccaatcccctcattccaccagccatagctaactactaacctgcttctgtctctgtagatttgcttgttctggacatttcatatcaatggtatcatatagcatgtggttttttgtgtctggcttctattacttaggatgtgttttcaagatttatgttacagcccact

SEQ ID NO: 31002 - DNA, 196 bp, Homo sapiens
ctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaaagcaaaaacaaaaaaggaaaaactaaccaacctcaaccaaccagccc

SEQ ID NO: 31003 - DNA, 375 bp, Homo sapiens
caagaggaggaggaagtcgatgattgctaagcgtcgccgagttgggagtgtcttcagccctaaggcagcatcagagatcataatcttctgctctcgtggcaagaaatttgtgcggatagagttgatacacctcacttgaagttggcctggagaaaagaggcgtcggactcctggacggggttgggaaacggtcaccagtttcggctcaaagcagcctgtttccaggagaccgccatggtcgaggcagcgtcctggtcccacggtgcggggccggacgatcatttatgggatataaataaaaggactatgaggtggtaaataaaagactaccaactagaagccatagggagtcatttgaaggagaaataggcacgg

SEQ ID NO: 31004 - DNA, 364 bp, Homo sapiens
  misc_feature 100: w=a or t
tttgtgtggatgtagatttttaaatctcttgggtatatacctaggagctgaatgtatgagacatatggtaattttatgttaaacattttggggaactgcwagattgttttccagagtggctacattattttataatcccaccaataatgtttgaggatttcagtttctccatgtccttaccaaaaattgtcatggtctgtattgctgtagccatcttgggtttctaaagattgagcattctgctgggtttgtcatgagccatgttgtttgcacatctcatgaggtgtggtccacaccttctttccctccatcacagtgccgtggctctaaaagttttctgtgtgaattcagacaggggatgggc

SEQ ID NO: 31005 - DNA, 289 bp, Homo sapiens
tggatgcccccaccatcccgggcggacagcttcaaagtctcctaccagctggcggacggaggtggtgcctttgccatgtgctcatcggctcgcatttcctctcccccctgcactctgcccaccctccagccgccctggggttccctgggtaaccctcgatccccaacgttttcaggggagcctcagagtgtgcaggtggacggccgggcccggacccagaaactccagttcctgacggtcccacacagttgcgtgcactgaacttgaccgagggattcgccgtgctgca

SEQ ID NO: 31006 - DNA, 208 bp, Homo sapiens
  misc_feature 93: m=a or c
taattttttagtgctttagtgtactgaaatgctgtctttagtgccctggaattacttatttaaactgtgatagaaggttgtacaaggtattamcttttctctgcttataaattatatgaatgtacatagtcctagcaatatgaatatttatcagaagatgtataatgtagaatccaactgcctcattcttcctgaacagccatgacct

SEQ ID NO: 31007 - DNA, 341 bp, Homo sapiens
  misc_feature 89: w=a or t
  misc_feature 93: m=a or c
cagttagtaacctggaaataataaaaatctgtttcacattaggttgtctgatgagcagcttgaagagaatcaggtagggtagagtttawtgamcaactgttgggaagtgagttaggttgtgacagttttagaatatgcagaatacaagaatgtatggactaccacatccagtctcttaattcaacagaaatatgttgagcctgtctcaaagagactgtatttgatagtagcatcttttgccttaatgcttttgttaaaatgtcatgaagtgtcttcaggtgtaattttcatttaagttttattcttactatgctatgaacctttggtgcttatcaaatgta

SEQ ID NO: 31008 - DNA, 167 bp, Homo sapiens
tctaacaatctaacactttcatagaatcatttggatcttgtatagagtgtaacttattggggataaacacttcaacttttggcagaaaatactttggattctccccaaggtcatttgtattcagagtaaatcagtggtccacccccataaaactgtaagacaaggcc

SEQ ID NO: 31009 - DNA, 359 bp, Homo sapiens
aaagatatgttgtgatattaaggcaagaaaaaaaaactcatagcttttgttaagtgaagcttgcaaattctgcccatcctttcgtgggtgtttcttcctcccatactctctctgtcagtaccatttgtttcaaattcaggcagaatcagaacatcatagtgcatataaggggtaattctggatgaagaatcgtacctgaatcgtacctgtgagaaagtaactgtgaagtctcaatgcacgttatcttttatgtttttcttttgtaaagttcttttgaacctggaattttaggttaaattaagtaaaaactgtagattggaaacctcctgaactttgtgcatacttaaaatatcaagttt

SEQ ID NO: 31010 - DNA, 280 bp, Homo sapiens
caaacgatgagtctcagcctttttcttgatttgataggcattgtacaaacagtcacaaaccacatagtcccatggacatttcagggttacatgtaattccaggtatactcattgcggctactcattttcttccctggggaaagcacattagaatatgggagggtaaaggtaagagtgctgagagctctatacgtatgcatgcaaaaggttacctccatttcaaccagggtcaccctgtacctccagagatgcattgatcaacccccatttttctggccat

SEQ ID NO: 31011 - DNA, 151 bp, Homo sapiens
tttccatagttttgcttctagcagccatttctattttttgtgacctgcagctccatgttcgctcaggctcagttagttccatagatacagctacttagtattgagcatttccatttggttagcacattagcgtaatgatagggaggggttg

SEQ ID NO: 31012 - DNA, 54 bp, Homo sapiens
agttcaagtgccccaaaggccgtcattccaaccagtggcttttttttttttttt

SEQ ID NO: 31013 - DNA, 382 bp, Homo sapiens
  misc_feature 174: n=a, g, c or t
  misc_feature 319: n=a, g, c or t
ccttttggcagagcttttcgcgaaggcagttgtggctctgagcgcataggcgaggcattcctggggtttgcgccgtatccttttacaaagtcctggctttggctggtgcgaccaaagaaaggaaaccggcgcttgagacttgtctgggctggctatggtgaagcagtgaaacgntgcagaattgtgtcaatgaggctagttcagttgtgcaagagcatttcctcaaagtaagacagaagcttttagttacgtcaacacctgctaatgttaggctggccagaaatttcctgacaaataatgggtgaaggtcgggcgtgtngtcgctcatgcctgtaatctcagcgctttgggatcattgaggtcaggagttcgagaccagctt

SEQ ID NO: 31014 - DNA, 437 bp, Homo sapiens
  misc_feature 149: n=a, g, c or t
  misc_feature 409: k=g or t
agggaagtgcagggggttgtggaattccctttcctagccaagggaagccatgacagatggtacctggaaaatcgggacactcccaccctagtgctgcacttttccaatggtcttagaaaatggcacaccaggagattatatcccgtgcntggctcggagggtcccatgcccatggatccttgctcactgctagcacagctgtctgagatcaaacgcaaggaggcagcgaggcttggggaggggcatccgccattgctgaggcttgagtaggtaaacaaagtggccaggaaactcgaactgagtggagcccaccgcagctcagctaggcctgcctgcctctgtagactctactctcggggcagggcatagctgaacaaaaggcagcagaaacttctgcagacttaaatgkcctgtctgacagctttgaagagagtagt

SEQ ID NO: 31015 - DNA, 69 bp, Homo sapiens
ttctctatgttggcaaaatcctaatctttcaaggcccatcagatgctaataactcccctaatacttcat

SEQ ID NO: 31016 - DNA, 292 bp, Homo sapiens
caaattaatattgacgtataaggttttgttcctgtcatgttgttagctagttgctttgttgtctcaattgtgtaattgcttcataggatctgtggaaaactttgaacttaagtatgcttttatggtagcaagtattgtcctttcaattccatctttagaatgccattgagcatttcttataggtctggtctagtggtgacagattctcttagcatttgcttatctgggaaagactttattgctcctttgtttatgaaacttattctggcagtatacaaaattctcggctggc

SEQ ID NO: 31017 - DNA, 413 bp, Homo sapiens
caaatagctaacattccttatatcatttcatcctctcaacaccgtgaagcagatattactttcattgcatggaggaggggatcaacgtttaggaagattattttttccctcaaagttatgcagcaggggtgaagtgtgggtgttgaccccaggtgtatctgactgcagagcctcactcaaccatgagtgcagtacttttgcagagaaaaactatgggccccattaaccttggtggggacatactctaaagagtgacctctcagtacacatcagggtctcgcttcaggtgcctctgctgcagtgccagaaccttccatggggaactccctgctccctagaaaccctatctccaggcaggtggtcagagcccactgtcattatatccagaggaaaagaatatggttgcactgagt

SEQ ID NO: 31018 - DNA, 161 bp, Homo sapiens
  misc_feature 22: m=a or c
cagtcgctcaggctactcccamcccgccccgccccgtcattgtccccgtcggtctcttttctcttccgtcctaaaagctctggcgagccgctcccttctcccggtgccccgcgtctgtccatcctcagtgggtcagacgagcaggatggagggctgcatgg

SEQ ID NO: 31019 - DNA, 258 bp, Homo sapiens
  misc_feature 166: k=g or t
  misc_feature 178: k=g or t
aagggagggggcgaggatggggagcaatgcaaagctctgctcgccccccatctcaccccccaagcggatactggtcttctcgtcggattgcccatgcacatgttgcagaaacagccaaggccctggctgtggagaatgctgaaggaagaagacgcagaagcaggakgaccctgaaagkttcagcctcttcatcctcaaacaggaccaggcctcctcttcccacctgtccagcagcatgaaagcagcatgattggccga

SEQ ID NO: 31020 - DNA, 146 bp, Homo sapiens
cacgtgttcaaaggtacaataaggcttacagtggaaaatctctctcattcctgtttcctagtcatccaggtcccctccccagggacaacttaggttatcagtatctgtgtatccttccaaatatattttattgatgcagcccactt

SEQ ID NO: 31021 - DNA, 417 bp, Homo sapiens
  misc_feature 221: s=g or c
  misc_feature 222: n=a, g, c or t
  misc_feature 399: r=a or g
  misc_feature 400: v=a or c or g
aagaaaattaaagcggcaattagacatacatatttaacaccctcattttccaaaaggtgaaggttgtttctgtggagttatgaagagttagaacatactcagaatggaaggagaaaaaaaaaatactgggggacattttctggacccaatttgagattttaagaaacatttttaagattccatgaaaaaaggccgggtgcagtggcttcacgcttgtaatsncagcagtttgggaggccgaggcgggcggatcacgaggtcaggagatcgagactttcactcgcgtctgtgtgaagagaccaccaaacaggctttgtgtgagcaacaaggctgtttatttcacctgggtgcaggctggctgagtcggaaaagagagtcagcaaagggaaataggggtgrvgctattttataagattt

SEQ ID NO: 31022 - DNA, 260 bp, Homo sapiens
aatttaaacattataaattagttgacttttcccttaattagccacagctatgttcccatagaaaagctgaaaatatgaagttacgttttcctctaaaaggagtctaattacattattatctgaaataatacctccttaacgattctttgaacagtactccctatgttttcttccactatgcagacttttcataaataacagtctacatcaagacaaacagtacattcagcaagctgaagaaagcaaatgaaccaacccaa

SEQ ID NO: 31023 - DNA, 171 bp, Homo sapiens
cccagaggcagaaagtaatattgcttactatgagtctatatatcctggggaatttaagatgccaaagcagctcattcacatacagcgtaagtaatgattctcttaatgattgtattttctatatttctcttattatgtaacttgacagatttttatctcttcaggagcgat

SEQ ID NO: 31024 - DNA, 217 bp, Homo sapiens
  misc_feature 100: k=g or t
  misc_feature 102: k=g or t
  misc_feature 107: k=g or t
  misc_feature 179: n=a, g, c or t
agtgtttgtttcttatttaataggctttttacttcattctattaaattttagtgtttagaagaggcgggtactgtcactgtgtaaaatatgtaatatttkakatgtkataccatgtcatatatacttgcaatatcagaccttgcattcaatatacaatgcaattgactctttgcagacntgcatttttcagtgaacaataaaaagattgtctggcag

SEQ ID NO: 31025 - DNA, 342 bp, Homo sapiens
  misc_feature 290: n=a, g, c or t
tttctctcttttgtactctgtccctttatttctcaatctggctgatgcttaaagaaaatagaaaagaacctacgtgaatatcagggcagattccctgatactgaatgcctttaacagcacccaagtcacctcttgaatgctttgccacttagaaatttcttctatcagataccctaaatcatctctctcaagttcaaagttccacagatctctagggcaggggcaaaatgctgccagtgtccttgctaaaacataacaagagtcatttctgctccaattcccaacaagtncttcatttctatctgagaccacctcagcctgaattttattgtccatatcccc

SEQ ID NO: 31026 - DNA, 136 bp, Homo sapiens
  misc_feature 96: k=g or t
acatatgtagtattaaaagcacttaagagaaatgtagaatatataatctttataaaagtattaaaggaattatttaaattgaatttgtatcccatkttatcttgcttgctaaatagatttaattggagcatccatt

SEQ ID NO: 31027 - DNA, 266 bp, Homo sapiens
  misc_feature 89: r=a or g
tttcccagttatcttgaggggagtgggatgtagggctggtattctttgcttaggttcatttacaagatgtatcagtgttgtaagtccartaattttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggacct

SEQ ID NO: 31028 - DNA, 86 bp, Homo sapiens
gggttttataaaactcttatactttgtatacagaagtttatttctgttttctgtttctcagaacatttgctcattcataacttttt

SEQ ID NO: 31029 - DNA, 158 bp, Homo sapiens
  misc_feature 71: h=a or c or t
  misc_feature 72: n=a, g, c or t
  misc_feature 73: s=g or c
  misc_feature 86: k=g or t
  misc_feature 94: s=g or c
cttgctgtgggggtaaggaatcaagcccccgcgctggctccggaccagctgcctcaaaacaacacgcttghnscgctgcccatcgkagccatcsgagaacatcctcagctttatgtcctacgacgaaattagccagctccgcctggtgaggcccccgc

SEQ ID NO: 31030 - DNA, 251 bp, Homo sapiens
cagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggccccaca

SEQ ID NO: 31031 - DNA, 369 bp, Homo sapiens
tgtttctagcttctgctgaaaaggttgatttggacccattagtcacatacctaatctcttcagaaaaggtttttcagccacatccttggccctttctccagagcatgttttagcatcttttacaatttagataggttaagaaatctccaaatcataggtttttctttgcttaacaatttcttcctcaatttatctcttctctcacattttactgtaagcagcccggagaaaacagtctacgcctttaacactttgcttggaaatctcctcagctacatattcaagttaattgcttaccaagttctacgttttgccacatagtagaacccatttcagccaagttttctgccactttacaacaaggaccgc

SEQ ID NO: 31032 - DNA, 452 bp, Homo sapiens
  misc_feature 448: m=a or c
taaagtcctctcccaaagatccagacttctcttcagtcaatggactccacgttagaaaattggctcaagtttgaaaactgagcaaaggatcattatttgtttattgggcagctgccctcagcttcctgatcatccacccttgatttcttctagttgtataaagtaaataatatcctcactcgtttgccatctgtcttacccctagggacatcacactctttaactgtttttaccactccatgtgggtgaatcctccttgactgccatccatctttgacactctttatcttaactgcacctgcctggcttctggtagagtgctgccacctggtctccgttatttcaatgtcctatcatatcaatttatatcaataaaccaaattctgcagtggcatctcctactacagctctgggagaacaccactgagctcctcactgcttccagcamccct

SEQ ID NO: 31033 - DNA, 210 bp, Homo sapiens
  misc_feature 86: k=g or t
  misc_feature 91: k=g or t
  misc_feature 95: k=g or t
gtatcttttctaaggaatattatttcaggaaatatatttaaaatgcattgttctcttttaaagtgtttttgttatattcttttatktattkattkatttttaaagacagagccttgatctgccgcccaggctggagtgcagtggcacgatcttggctcactgcaacctccgcctcctgggtttacgcgattctcctgcttcagcctccat

SEQ ID NO: 31034 - DNA, 364 bp, Homo sapiens
  misc_feature 195: y=c or t
  misc_feature 196: n=a, g, c or t
  misc_feature 277: s=g or c
  misc_feature 278: r=a or g
tttcagtcttctggttctggaggcattttaatccctgggggtcctattaaaatgcaaaaactccgagaagaataatagcattgaaagctattattaactgacagcaaggaggcccttgggaattggacacgggatagagcctgaggaacaactccaggaaattggggtacaagcagagggaaggtaagatggcaynaaaaataaactttatctacttcgccattttgcaggggcaaggcagtcccacttctgatattctgtacactaaggaaattcsrttcaaggtgagatgatggacacagtgagagcaacttattttcggttgtgctaaaggagaaaatcaacagtgacacagagtagtaag

SEQ ID NO: 31035 - DNA, 329 bp, Homo sapiens
taaattagcctgaaaaatatttcaggtaatggtgtggattggcctgctttgactctcagccaccaacagaaatctttgtcacctttgttcctcaggctaaaagtaattttgttataaacacaaagtgactttaaacaggtaaaaaacccattcctatttttgtacattaccaaaagtttttcatatacctacagagctaactaattacaactgatttaatccactcaagtttagaccagttaaacccataggatcctgtatggttatcaatgtgatgccttgcttttcataaaataggtataattgggtcatacacttgacgagaggga

SEQ ID NO: 31036 - DNA, 424 bp, Homo sapiens
  misc_feature 100: k=g or t
  misc_feature 331: r=a or g
tgaaatctgaagctgcattattataaaaatagataaatccaataaaataccttcacagcattttcagtcatagcataatctgtggtatttatgtttagtkattaattctatattttaaaagatattctgaaattctgaagattatgtaaactcaaatgaccagtgagtgatatgaaaatcacacttaaaacagcaatagctgagaaaaatgtggacatttagcttggacaaaaaaggacttttcaggaatggtttgagtcacgtattttaagggttgtcatgtggaagatgatgtttatgttctttaagtctctaaaatgttgacttagaraaaagacggatgggaatttggcacaatagatttgagctctatattagaagagtggagagaaagggatctgggattcagaattgtacacacaat

SEQ ID NO: 31037 - DNA, 199 bp, Homo sapiens
  misc_feature 88: y=c or t
  misc_feature 196: d=a or g or t
aatgagggatttgaacataacacacaagttagaaatcaaggaattatagctttgagttaccgtgactgggaggagattgtgaagaccytttgagatttcagagcctgtgattaccccaagtcagaggcagcagaagccaagtgcttgatgctagctgaaggactcaaatggatagtgaagtccaaaacggaaagcdgcg

SEQ ID NO: 31038 - DNA, 170 bp, Homo sapiens
  misc_feature 87: r=a or g
  misc_feature 91: m=a or c
gcgtctgtcaccacgtgtataaaagagtctaccgagttcaccaagacatctgcttcaaagagagctgtgaaagcacaagcctcaagragamccccaaacaggaaacaaagtaagagtcagacactggagaaatcttaaggatttaagacgttcttgttacacccccccat

SEQ ID NO: 31039 - DNA, 339 bp, Homo sapiens
  misc_feature 93: w=a or t
  misc_feature 96: w=a or t
cgccaccacacccagctaattttgtactttttagtagagacagggttgcaccacattggccaggttggtctcgaactcctgacctcaggtgawctwccttgccttggcctcccatccactggccttggcctccttgggattataggcatgagccaccgtgcctggcctgccctaggattttcaggcttgccaaccctccacaatcaaaagccaattccttaagataaatttctctccctctttctctctctctcctgttgattcgatgtctctggagagtcctgactaatacattccctatcatagcagttgcttgtttctctttttctctctcttgga

SEQ ID NO: 31040 - DNA, 391 bp, Homo sapiens
  misc_feature 94: r=a or g
  misc_feature 167: w=a or t
  misc_feature 168: d=a or g or t
  misc_feature 219: n=a, g, c or t
  misc_feature 220: v=a or c or g
aagtgattcttctgcctcagcctccaagtagctgagattacaggcatgcaaccactatgcctggctaatttttgtattgttttggtggagacargggttttgccgtgttggccaggctggtctcaaactcctgacctcaggtgatccacccgccacagcctcccagwdtgctgggattacaagcaggagccaccgcacgtggccttgattcctcagacnvccttttacattcagtttgttttcaaaattgtggaagaaaaacaatcagtaaaagttttaaaaatttgtgatatatgcaagcagtgatattacatggctagctaataattttgcttggtgatttgttaaaaaacaacttccaatctacatattggatagtcttatttaaatt

SEQ ID NO: 31041 - DNA, 364 bp, Homo sapiens
  misc_feature 95: y=c or t
  misc_feature 96: y=c or t
agatgcgaggcggcggtcaggtgggatgctatggaatatgatgagaagctggcccgtttccggcaggcccacctcaaccccttcaacaagcagtyytggggccgagacagcatgagcagggccctggggaggaggtcccggacgtcactcctgaagaggccctgcctgagctgccccctggggagccggaattccgctgccctgaacgcgtgatggatctcggcctgtctgaggaccacttctcccgccctgtgggtctgttcctggcctctgacgtccagcagctgcggcaggcgatcgaggagtgcaagcaggtgattctggagctgcccgagcagtcggagaagcagaaggatgccgtggt

SEQ ID NO: 31042 - DNA, 207 bp, Homo sapiens
  misc_feature 94: w=a or t
caaaagaaagagtttattttgggattaggataggagttgtgtttttgagaaagagttattgttgtgagttatactgtcctggatgtgtgaagawaatcaatgcaactattgtatcatgcctttgcattgggcgatggggaaatgtcttatgctcctggaagtgatgcataaccctacaggtttatggtgaattgtttacttagcgaa

SEQ ID NO: 31043 - DNA, 296 bp, Homo sapiens
  misc_feature 94: r=a or g
  misc_feature 95: r=a or g
  misc_feature 96: k=g or t
  misc_feature 98: y=c or t
tcaattcctgggtatccttgttaactttctgtcttgtttttctgtctagtgttgacagtggggtgttaaagtctcccattattattgtgttggrrktytaagtctctttgtaggtcactaaggacttgctttatgaatctgggtgctcgtgtattgggtgcatatatatttaggataggtagctcttcttgttgaattgatccctttaccattatgtaatggccttctttgtctcttttgatctttgttggtttaaagtctgttttatcagagactaggattgcaacccctgccga

SEQ ID NO: 31044 - DNA, 373 bp, Homo sapiens
  misc_feature 92: m=a or c
  misc_feature 232: h=a or c or t
  misc_feature 262: s=g or c
  misc_feature 263: n=a, g, c or t
  misc_feature 267: n=a, g, c or t
  misc_feature 298: r=a or g
  misc_feature 334: v=a or c or g
caatgtttgtgaaacacctttggagaggtgcacttctgaatgctgcctctgccgtaaatcctggggcaagggatcagcctcttcccagggamcaatcgccttctataaaccgtgaactcaagcaggcattttttttttcttaccgaaaggctgctattgtgcaagggcacataatgggtctgttgctcttattggcttccaaatgtgcatggcaaagagagagatgtgggchtagagcagatatattcagcaaggtgacagsntccngtaacaattctaacacttcttatcttatgtragaataaaatatttaagggttgaaccttattttgcvaaatgtatcttttctgcttttgaattgggcagaagattt

SEQ ID NO: 31045 - DNA, 174 bp, Homo sapiens
gtacgaagacgaccgggctctcaagatggcggccccatgcggaaacagctccagggagcagccatgttgcttcctgaacaaagcctctgaagatgcggaacgggcaaaaccgcccagtacggaacggcgcagctcgggagcccggtgtggtgctcgcggacaggaagcaggagg

SEQ ID NO: 31046 - DNA, 234 bp, Homo sapiens
ctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagcaat

SEQ ID NO: 31047 - DNA, 329 bp, Homo sapiens
  misc_feature 143: h=a or c or t
cggctaatgtgatgcctccagctttgttctttttgcttaggattgctttggctatttgggctcctttttgggtccatattaattttaaaacagttttttctggttttgtgaaggatgtcattggtagtttataggaatagcahtgaatctgtagattgctttgggcagtatggccattttaacaatattaattcttcctatctatgaatatggaatgtttttccatgtgtttgtgtcatctctttatacctgatgtataaagaaaagctggtattattcctactcaatctgttccaaaaaattgaggaggaggaactcttccctaatga

SEQ ID NO: 31048 - DNA, 57 bp, Homo sapiens
gactgcggcgcacagcgactagtgggagtccgatgtgggagaggggctgcggccacc

SEQ ID NO: 31049 - DNA, 403 bp, Homo sapiens
  misc_feature 351: m=a or c
  misc_feature 384: w=a or t
caattcttctgcctcagcctcccaaatagctgggattacaggcatgtgccaccatatttggctaatttttatatttttagtagagatggggttttcgccatgttggccaggctggtcttgaactcctgatctcgagtgatccaccagcctcggcctcccaaagtgctgggattccaggtgtgagccaccacgcccagcccaaaactgttgattggaataccttgtctcctccatgtcctctctcatagcatgacagcagggctctgagatggaactttccaagcatatttcttaaaaaatagaatctgcagatctcttaaggctaagctttggaagttgcaacattgtcamctctgctgcattctgtggtcaaagcaagtcatwagacaagcacaattcaaga

SEQ ID NO: 31050 - DNA, 244 bp, Homo sapiens
tttcatcaaaatttatccagtcaaaaaaatttcatgaatactccagatgtaagagagtcacaattttctacgataaatcagacatcttatttctagggtgattgagggaggtggaaagcgcaggaggaagccagtgaagaggacaatggaatgctgagtcaatgacattgacttgtgttcctatctgccatcttgggtgtgggtctttatatgtggttacagatcctttagtttgagggaagtg

SEQ ID NO: 31051 - DNA, 121 bp, Homo sapiens
  misc_feature 80: r=a or g
aagtcatatcagatatcagacctaatttaaatttcattttagctttacaagtccaaaaacacagaatttatatattcagrtactctagcactaattttagtcttaaaatattcccacaatc

SEQ ID NO: 31052 - DNA, 163 bp, Homo sapiens
  misc_feature 126: s=g or c
  misc_feature 128: n=a, g, c or t
tccatcgagagtgagattaggcgagaacgagagaggcagacaaacccatcagccatggaggtagaagaggatgatccagtgcctgagatccgtcgagatcactttgaagaagccatgcgctttgcsgncgttctgtcagtgacaatgacattcggaagtatga

SEQ ID NO: 31053 - DNA, 60 bp, Homo sapiens
  misc_feature 47: s=g or c
  misc_feature 52: k=g or t
caatggaggtgtggagcacagaaactacaggtcaatggaggtggggscacakggactaca

SEQ ID NO: 31054 - DNA, 387 bp, Homo sapiens
  misc_feature 296: w=a or t
  misc_feature 313: w=a or t
  misc_feature 317: k=g or t
taatttttttcttctctgagacaaggtctcactctgttgtccatgcctggctaatttttttcttttttgtagagacagggtcttgctttgttgcccaggctggtttcaaactcctggcttcaagcgatcctctagccttagccttccaaagtgttgagattataggcatgagccaccacactcagcccagggttcagcagacactttgagaggtcagatagagttcatccttcaggcagatgagatgctgtccctttaaaaaaaaaaaatcaacttctattttagatataggggawacatgtgcaggtttgcwacakgggtatattatacccatgtagtgaatgtagtatccaataggtagtttttcaacccacagcctccccccaa

SEQ ID NO: 31055 - DNA, 169 bp, Homo sapiens
  misc_feature 71: k=g or t
caaaactggcccaggccagattctaatagacacttgcctttggcagtctcccagttgtctctcttcatgtktcccccacctttgtctgccccctccttagttgtgtgttgagctcctcactgtgccattttcctcaggtctgtagacatgcctcttcttataccccaac

SEQ ID NO: 31056 - DNA, 433 bp, Homo sapiens
  misc_feature 263: y=c or t
  misc_feature 264: n=a, g, c or t
  misc_feature 295: d=a or g or t
  misc_feature 305: n=a, g, c or t
agaatatattaaatgtatcctaatggatgaaagaacttttttaaacaacaacattgtctacacgttcatgacacatttccttctaaaggtacgtagtactttggaaactcagtgtgtcatttccaattagttaatgcttgtggtttcattatgctggtcttttggagatttttttaaatcttctttttcaggttcaaagtcaagtgttttctgaagcaaactgtgccaatttgatcagcactcttattacaaacttgataagynagtatcagaacctacagtctgatttctccadccgagttganatttccaaagcaagtgcttctttaaatggggtaagaactatgcagaggcggcggcacacacttttaaactgtccttcagttaactgtgtggccttcatatgattttactctcgtaactttaacttact

SEQ ID NO: 31057 - DNA, 182 bp, Homo sapiens
tttggatggagtctcgctttgtcgcccaggctggagtgcagtggcacaatgtcaggtcactgcaagctctgcctcccaggttcatggccattcttctgcctcagcctcctgagtagctgggactacaggcgcccaccaccatgcccggctaatttttttgtatttttggtagagacgggtca

SEQ ID NO: 31058 - DNA, 343 bp, Homo sapiens
  misc_feature 147: n=a, g, c or t
  misc_feature 322: y=c or t
  misc_feature 323: s=g or c
agggaatgttaccactgaccccacagaaatagaaacagccatcagaaactactgcaaacacttctatgcatacaaactagaaaacttcaaagagatggataaattcatggagaaatacaccctcccacaactgagccaggaagaaantgatttgctgtaaacagaccaataacaagctccgaaattgaatcagtaataaataacctaccaaccaaaaaaagcccagaacatgatggattcccagtcatattctactagaaatacaaagaagagctggtaccatttttacaggaactatttgaaaatattgaggaggaggaaysctccccaactcattctatga

SEQ ID NO: 31059 - DNA, 216 bp, Homo sapiens
gaacattagatttagtggtaagaagatactgtctgaatgcttctcatttaaaatgacatagaaaattagctaagaggttgtgtgtagtggctcatggctgtaatccctgcattttgggaggctggggcaggaagattgcttgagcccaggagttcgagactagtctgggcaacatagtgagacccgccccttctctaaattttttttttttttttt

SEQ ID NO: 31060 - DNA, 99 bp, Homo sapiens
agtgctgacgttggcagccgaacccaaagtagatcgaggcggcgggctgcacattcccgttgttgcgttgcgtttccttcctctttcactccgcgcacc

SEQ ID NO: 31061 - DNA, 376 bp, Homo sapiens
  misc_feature 236: k=g or t
ctcagctcagcgcgcttatcctgggtccaccggcgctaccgccccccgacgctcctgtgacgtttgatgacatcactgtgtacttactccaggaggaatgggtgctgctgagccagcaacagaaggagctctgtggttccaacaagctggtggcaccactgggaccaactgttgccaatcctgagctgttccgcaagttcggacgagggccagagccatggcttggcagcgtccakggccagaggagccttctggagcatcacccaggaaaaaaacagatgggctacatgggagaaatggaggtgcaaggtcccaccagggagagtggacagtccctcccgcctcagaagaaagctacctttcccacctcagtaca

SEQ ID NO: 31062 - DNA, 396 bp, Homo sapiens
  misc_feature 194: w=a or t
  misc_feature 195: n=a, g, c or t
  misc_feature 196: h=a or c or t
  misc_feature 197: n=a, g, c or t
  misc_feature 306: k=g or t
  misc_feature 307: h=a or c or t
  misc_feature 308: n=a, g, c or t
  misc_feature 391: n=a, g, c or t
caatgtaatttttaaaaataatacaatctccaagtccttctcacaaactggttctaaagtatccctaattacttagtataaaagctgtcttgatttatccatttctactgtttttagcattgctgtttagggaatgttgatcctggaggataaagttctacaaaatatctagagttaatgtttaatcgaaaggwnhntgtcttaagggtcaagagatagttgagttcctctattaaaaacaatgaaggctagaccctgtcttctccattaggaatcctgagcattggtgaggaaattcatactaakhncttgctgctaccaatatcttattccttatactggatctccagtaaaatgtgcatatatatatgcatatatatatgggtttaanattat

SEQ ID NO: 31063 - DNA, 279 bp, Homo sapiens
  misc_feature 68: k=g or t
  misc_feature 87: s=g or c
  misc_feature 93: r=a or g
  misc_feature 104: s=g or c
  misc_feature 105: k=g or t
  misc_feature 241: r=a or g
  misc_feature 242: r=a or g
  misc_feature 258: r=a or g
  misc_feature 267: r=a or g
ccaagatcaaaccatgaagaaatccaaaacctgaacagaccaataacaaataatgagatcaaaattakaataaaaagtctccccagsaaagaraagcccaggaskcaatggcttaactgctgaattttaccaaacatttaatcaaagaagaacaagtaccaattgtactctaactattcagaaaatagaggagagagtacttccaaacgaattctacaaagccaatattacactgataccrraacaaatgacacatcraaaaaagaraactacaggccc

SEQ ID NO: 31064 - DNA, 217 bp, Homo sapiens
ccagttagctgatgttttattgtaattgtcttaatttgctaagaacaagtaataagtaaatttttaaaaagcctttctgctgggttggattaagtcctgatgtgacattgtttttgtgtgcgaataaggcacgggcagcctcagtctcgtgcagagccagatactttattcatcacttgggcgatttgaaactgccaactccctccctccctccccc

SEQ ID NO: 31065 - DNA, 326 bp, Homo sapiens
atattttgataatttaccattaagaaagaacggcaatgataatggaagacacaagaggaaaagcctggccatcaagctgtatagcagttttccagaggcttttactttttattgggattggattatattaaccttacattcatgttccaaccgtgtaattttgccctaatacattattttaacttttctctagcttctgtagacatcatgattcctgtcttgcttgaatccgaatctgtatagcttgaaacagcattattactagtataagtgcaattacacatcatccatatgtgtaatacaaactggcagactaagaccccagc

SEQ ID NO: 31066 - DNA, 116 bp, Homo sapiens
tctgttgctctaggctattttgctccatattctcctgttttattactgaaatcttgtagatttacagtgaactccctgcctctacggttctgctcattctcattacatggaccaaa

SEQ ID NO: 31067 - DNA, 304 bp, Homo sapiens
  misc_feature 91: r=a or g
  misc_feature 269: k=g or t
  misc_feature 300: m=a or c
cggacaggaagaaaatggtcttatagacaggaaaaacatcaatgtggcatcagacttctagcatttagtgtttcggggaatgcaatattargaagacttttcagtgaatgatgtttagaaaattagctttttatttaaaaaacataaccaaaaaattctaaattggttaaaaaaattaactaagtagtagaagatcatctcaaagaggggttttattttgggggaaggtcaggaaattataaagaatgatttaactctgcaaaagttakaaacttttatatggcaaaaaaaaaaatcccmccac

SEQ ID NO: 31068 - DNA, 175 bp, Homo sapiens
  misc_feature 74: k=g or t
  misc_feature 102: k=g or t
tagaactactgcggaacctcaaaatcagtagatttggaagtgattcaaagctaaactttttccttggccctccktgtgttctaattgctttgcaagtgtaakactaggatgtccaagatgccagtttttgcttctttgttagttgtcagctgcttttatcaaatttcaggccgct

SEQ ID NO: 31069 - DNA, 278 bp, Homo sapiens
  misc_feature 74: k=g or t
  misc_feature 252: k=g or t
  misc_feature 255: k=g or t
  misc_feature 260: k=g or t
  misc_feature 262: k=g or t
taatttgggattatttcaactttacattgtatgtctgaatttcatcgatgttgtacctggctcagtcaatagtkgtcacaggtattaagccattttggaatttgccacttttttctgggtaacctgttttagtttagtttacagcatttagaaacagaaggtaactttatagaagtaacaccaatatcctagtctgcttgccccgaatataactaatagtattaggatgtaagcaatattaagatggttttkatkatttktkatacactgtgtgcatc

SEQ ID NO: 31070 - DNA, 227 bp, Homo sapiens
tgagccagaagagagggatttacacaatatcaggtgtattaaggggttcctaagaaagagagaactccaaagtgcctttgaaggttcttaattagagcgcttgcagtaattggtaaagctcaaaccagattgcagcaggggtgagagagtccctgctgagattgtctcgggggccagggaggggctggttttctcattgcagacacttacctgataagggggcagcc

SEQ ID NO: 31071 - DNA, 185 bp, Homo sapiens
  misc_feature 101: r=a or g
ttgaagatgatacttgggtaacaaaattggcatatttaactgatatttttagcattcttaatgaactgagtttaaaactacaggggaaaaacagtgatgtrttccaacatgttgaacgtatccagggatttcgaaagacattattgttatggcaagtaagacttaaaagtaatcgtcctagcaac

SEQ ID NO: 31072 - DNA, 444 bp, Homo sapiens
  misc_feature 93: k=g or t
  misc_feature 368: s=g or c
  misc_feature 375: k=g or t
tatgtactatatccacaaatcctcctctccccattttcctttcaatgggacttgcatttacagttgatcctagaatgtatggaatctcatagkaatcagcttgcttctgaatttcttcccactcaaattaagctcactcagaaagcacattcacaaattgggctacatatacagaaggagctatgttttatatgcctcactgtagtcaactcatttatcctatatgtatggttcccccattttttccttcttttcaggggtaacttttaaacttgagccattcatgagtatccaaaaagttacaacttatgttctctaattaagacttcatccttattttagtatacttcccctctctggcttttttscatattkctgcagatgtcttgacctttctggggagtaagccccttagaagattaattttctgtagttctctattga

SEQ ID NO: 31073 - DNA, 349 bp, Homo sapiens
  misc_feature 173: h=a or c or t
cgattcgacacggcactggcagcgggaacttgttcccgccaagaccctaaagggattgttcattgctgctggaggaagatcatggactgtcgcgggaaactgaagtggttgagtatccactagtcgtggatgagggcagtgacttcgcagttttttgcgaattacacatctchttgattatgttgtgactagttttgttagatagtcatttagtgtttgggatacctgttaagccctttgtccagggactgtggttggatttatgaattatttggacggttgtccacttgaaagaactgacagtagcttcataacaatgttacaaatctcgttctaagattaagctgtt

SEQ ID NO: 31074 - DNA, 379 bp, Homo sapiens
ctgaaaatagtatatttcaaagaggcagatatctctaaacaaatctgaacaggatttggaaaacatttttgtacttaaatttgatattatgcctgatatttaggacttctaaccattactgcccaatgcttgatatatagcaataaatatttgtgaaatgaagaaattaatgaatggaacacacatacttgaatgagcagaaagactgaaagtacacagagctgaaagcctgtttgatttcttcatctgtcaagctccctagtgaaaatttgctttgtgacacttctgattcattcaaaccttctccagaaggaaagtaattaagtgtttttgttttagatagttccatttttatactgcaggtgacaagcgaggagaa

SEQ ID NO: 31075 - DNA, 155 bp, Homo sapiens
cccggaacttttgggcaggcgtcacgcccgtgtcaccgccacgtcgcggacatggtgatttcagaaagtatggatatactcttcagaataagaggaggccttgatttggcttttcagctagctactcctaatgaaatttttctcaaggaggcact

SEQ ID NO: 31076 - DNA, 158 bp, Homo sapiens
caaatattaattctcagataccaaggccttctgatgtgtcataaagaattccctccaaagtgagagagggtctctgtcaatcttatggagcatgggaaggggaagaccacctgacagtagggcagggagaggggctgccaggtaagcttgaggggcct

SEQ ID NO: 31077 - DNA, 362 bp, Homo sapiens
taattttcatcatctaaactgaatgcaaacagcgcttggcaattaaaatgaagctctccaatgaagtatacttcatcagctgctgtcaagtcatccattgatactgttttgcggtttttaaattccttttgtcactgtgactgctcatcagcaggcaaggaagagcaggcaacaaaagttgaaaagtgcatgaaggaaaactttgaggaatatgatattcacattccagcaaattgggggaaaactgctattatctggtttaacacaggagtgccttggtgccctgcctgaggctaatgtgttctgtaggggtggctgcacagccacagtcctgaaacatgggaaagcatctcctgagtcca

SEQ ID NO: 31078 - DNA, 375 bp, Homo sapiens
tttaaaaatagtgttctagagatacatataaatatattacaagatcataattatgtattttaaatgaaacatttttaataattaccaagttttggccgggcacagtggctcacacctgtaatcccaggactttgggaggctgaggaaagcagatcacaaggtcaagagattgagaccatcctggccaacatggtgaaaccctgtctctactaaaaatacaaaaattagctgggcgcggtggtgcacacctatagtctcagctactcagaggctgaggcaggaggatcgcttgaacccgggaggcagcagttgcagtgagctgagattgcgccactgtactccagcctggcaacagagtgagactgtgtcgcaaaa

SEQ ID NO: 31079 - DNA, 216 bp, Homo sapiens
tctgatgaccaaaaatgttctctatatttgtaaagttagtgaagcaatgaaaattaaagtggtataaatttaggactaccagaatttaggctttgggtaactctagtctaaaataatatctagtaccattttgtaacataggctgtttgcttcattaagtaaataatcaacagtcataaatagtactctggtaaatttcacagggatagtagagac

SEQ ID NO: 31080 - DNA, 373 bp, Homo sapiens
  misc_feature 220: w=a or t
  misc_feature 221: k=g or t
  misc_feature 235: h=a or c or t
  misc_feature 237: k=g or t
cattagatattttagtttgtttaaaaggttgtaggcatactacttgaataaaacccaggcaggtagtttttttcacagtacaagagcatttttcttgttagaatctcttgatttatttgaatgtgcttctccacacatttaaattaagctttaatttaacatatgtctgaggccgggcacagtggctcatgcctgtaatcccagcactttaggaggccawkgcgggtggatcgchtkaggtcaggagttcgagaccagcctggccaacatggcgacaccccatctctactgaaaatacaaaaattagccgggcgtggtggtgcatgcctgtaatcccagctacttaggaggatgaggcaggagaatcgtttga

SEQ ID NO: 31081 - DNA, 225 bp, Homo sapiens
attccagcccttagctaaggcggcccgggatcgtgcctcatgaaagtcatctacctgatcttggtagtagctggtgtcccctggtgagggtggcaatcctaaatcatctccattttcgtcggtgagcgtgggacctgccttggctcgcacagctgcccacttagctgctccgcgccgccgggatctccccaccatggctcacaatctcaggttttacagcgacat

SEQ ID NO: 31082 - DNA, 409 bp, Homo sapiens
  misc_feature 339: s=g or c
  misc_feature 393: y=c or t
tcagtctgtggagacaggtgagcacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggcctggcagatgtggggtctagaagaggacaggagttatcagggsctccggccattgtgctgggctttgctgtacaattgtttctcaagcagttgtgtycctgtggctttggtgc

SEQ ID NO: 31083 - DNA, 123 bp, Homo sapiens
caactaaggcttaggagcttttatttttcaagtggtttgggaactgaagattaatgtccttattagttttaataaagcactaatggacatttaaatcttggctgttctccagggttttttttt

SEQ ID NO: 31084 - DNA, 392 bp, Homo sapiens
ttgggttttgccggtgtttaattgagagggaaatggatagagaaatgacttgtctaaaatactattaagagtaatgtgggtatagagtcccaggcattcccatagcctaggtacggtgcggctgtggcagggcagccccagtgggttgtgtgtgttagggcagtgagtgaggggctggggctctataagggctgaccccttcttacctgctctttgtagagggtggcatcaagctaggtgttctgggagaaaggtgagaaacaaggagcttccagtctagcagggaaaagatcacaaacttagtataagaaagagatgtggccagatggcagtggctcatgcctgtaatcctagcacctctgggaggccgagaagggtggatcactgaggtc

SEQ ID NO: 31085 - DNA, 406 bp, Homo sapiens
  misc_feature 85: w=a or t
  misc_feature 89: k=g or t
  misc_feature 91: m=a or c
  misc_feature 92: m=a or c
  misc_feature 113: k=g or t
  misc_feature 344: s=g or c
  misc_feature 345: r=a or g
ccctgatcgagcggcgggagcgagggcctggacgtagtgtcttcaacagttgtaacagcagctgccatttgctgaatgacagcawgtgkcmmacactctgctgagtattacakgcatttttttctaatacaaagtcttgtagtgtggaaatacttgcagacttgaaggaattatcagtctttcattttctatcatcagtgtcctatgatagtttgtgcttccctccctcatccctttgttcatgtcactctgttcaccaacccactctgctgaaatgtcgttatttcttcaaggccggagaaatgctaccactctcatcagagggttcagagatgggcagtgasraggagcagagtccagaaccacacctgcctgaggaaggggaagggggtaagccttggagagt

SEQ ID NO: 31086 - DNA, 335 bp, Homo sapiens
  misc_feature 121: n=a, g, c or t
  misc_feature 277: k=g or t
  misc_feature 278: v=a or c or g
cagctaaccctcaataagaaatgcacgcatttgattgttccagagccaaagggggagaaatacgaatgtgctttaaagcgagcaagtattaaaattgtgactcctgactgggttctggatngcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctkvcagctctcaagaagggtctccttcaggtgaccagcagttttcacctaaatccaacac

SEQ ID NO: 31087 - DNA, 251 bp, Homo sapiens
agcatggggaatcaaaggtggcatgccaagttcaactcagggctgaggtatccacattgtccacatcaggcaagccctgcactgacggttgagcctcatggagaggagcatgtgttggaaagagatccctttgttaactgttttgtggtgttctcttcaatgaattagagctcatgccccttttctggctttgctgttgattttggatggtagagaatattcctgagagccttccttttggcccccagctg

SEQ ID NO: 31088 - DNA, 394 bp, Homo sapiens
tatttatttatttagagacggagtcttgctctgtcactcaagctggagtgcagtggtgcaatcttggctcactgcgacctctgcctttggggttcaagcgattctcctgcctcaacctcctgagtagctgggactacaggcacccaccgccacacctggctaatttttgtatttttagtagagactgggtttcgccacgttgcccaggctggtctcgaactcctggcctcaagtgatccagctgtgtcagcctcccaaagtgctgggattacaggcataattaagccaccatgcccagctggcatctaacttctctttgggcaccagaacccttctagaagctgatcaagggactttcagggatttgggaactgagcaagagaggtatgtatct

SEQ ID NO: 31089 - DNA, 271 bp, Homo sapiens
agcaattaagggccattcaaaatgacaagctaaaaacaaacaggttacataagaccaaattacctcttaaataagaataggtcacagcattttttcttcattttaaaaatccagtattttaaagtgctaaagcatactgctttagagtgaagagggcaattagaaatcatgtggttcagatctctcatttttcagaggaggagttttgattcaaataatttatgtgttttttttccaagccagagtcacatggcttatagggaccaagcca

SEQ ID NO: 31090 - DNA, 244 bp, Homo sapiens
tgaatgtcataataattctatgagataaattattattatcatcaccgtttgccaaagggaaaacagaaaaaaggtcttcaagcgtcttctagaaccatttagatttaatatgttaattcattatgataaatgagccaaaaatattaactctctaaaagcagaatcagtttatctgaataaaccattaaactctaatgtcattcagtggcacaaggcaaattttgtgaaaattgagagcagttta

SEQ ID NO: 31091 - DNA, 169 bp, Homo sapiens
tagcagatatgagaaagccagcagttggcaaagctgagaatcaacccaatttaaacttctggagccttgaaggctcggaaatcggtggcatcagatgtagctggttctccgtatccatggattctgcatctgaggattcagccaacctctgatccaaaatattcaaaaa

SEQ ID NO: 31092 - DNA, 196 bp, Homo sapiens
  misc_feature 90: k=g or t
  misc_feature 98: r=a or g
  misc_feature 162: s=g or c
  misc_feature 163: y=c or t
cagtttgaaaacaaaaagaatgatgtcaacattttgtttcttactttgtgtgctcttttcaacatatagatgacaaactttgacatgaakgtttagaraacttgtgagtaaaaggataggcgatacgaatatttctaaaattcaaaatcagaagcttttagsytcataaatcatatattttgaaaaatgagcattg

SEQ ID NO: 31093 - DNA, 412 bp, Homo sapiens
  misc_feature 328: s=g or c
tcaatatgtgtttggggttgaagccatccatcattaaaatcttgtgcctgggacagtttcatatccacaggatataatttgagcttttcacaagtgttcttcaactagattctgctggcagaattgtagatttcgagatctttacatctaatgctcctatacatctactgtagagattttgccttctgaactaaatacattcttcctttgtagtttgagttaccagttctgtctatcccaccaataattagtaggtacctctgaataatagttttaatatttcttggtaacatttatagttcattttagacccaaaatgagagaattscttgagaattactcagcacttctgttgtggtacttcagctgttacaatattatgaaattaagtatttgctgtttctggtcgggc

SEQ ID NO: 31094 - DNA, 360 bp, Homo sapiens
  misc_feature 75: r=a or g
  misc_feature 313: r=a or g
tcgttacaacacgtggagttttactaacatacatattaaatcaaagtatattcttaaaattacttgtgaagtagratctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaraacatttaatgcactaactttaaagaaattgaaaattcaggtggata

SEQ ID NO: 31095 - DNA, 240 bp, Homo sapiens
cacagtatttgttccaaataacaaagaaagtatgacattgaaggagtaaaatagtaaggatatttattgttgagtttttaacttttggaatatataacataaacttcttttgattatgggggatgtggatcttcctcatcacctgcagcagacacattgcccagagacccatcccccaacctcaaaagacaccctacgccttctggtctctgacctgtcttccctgacagacagcccaac

SEQ ID NO: 31096 - DNA, 234 bp, Homo sapiens
  misc_feature 120: b=c or g or t
  misc_feature 121: m=a or c
aaaagtatttttgatgactgccccaattctgaagctactcgggtccaccatgagttacctcattagcataaactcaggtgtgatccatagcaaagacatgtctagctctgtgctaggaabmctaggacaaagacctgacaaattattacacagggcataaacaagaccaggagtgaatatggcagtgttttcttatttatttagtggtttcttttctcttggatcatttagctt

SEQ ID NO: 31097 - DNA, 220 bp, Homo sapiens
ctattcagaatttctgtttctttgtgatatcatcttggtaggttttatgttcctagcaatttgtccatgtcatctaggttatccaatttgttgggatacagttgttcgtagtaccctcttataatcctttttatttgcgtagaatgggtagtaatgttcctactttcatttctgattttagtaatttgagtcttcttgtcttttcctagtccacctagcc

SEQ ID NO: 31098 - DNA, 272 bp, Homo sapiens
  misc_feature 113: r=a or g
caaaaacttcaggcagtaaagtcagttaagagtttcttccggtaaacatactgtggattaggagaactctttttttgttccatgcttcccttttgtaattactgggtcaccarcctgcaacttgtccctttgtagatctcatttctcttgtgttataattttaacttttagtaataaaatggtttgaatgtgtaaaggaaaatacttgttgtaaaggaacattgtccatataatacagtgtaattttagtgattgtaaatttaccatttttt

SEQ ID NO: 31099 - DNA, 300 bp, Homo sapiens
  misc_feature 85: k=g or t
  misc_feature 113: m=a or c
  misc_feature 188: b=c or g or t
  misc_feature 198: k=g or t
  misc_feature 201: k=g or t
  misc_feature 216: y=c or t
tggtactattttactgaatatagactgtggaaaggtgctgaacagttgaaccttgtcagtcttcagagtcatctgaaacttaagktatcgcataaacacagtcagtttttggmaacagtcgttttatttgcagtttctcaattgggaggaaacagtctcctggagttttatttttttatattttattbtattttattkatktatttattttatttytattttttttgagttagagtctcgctctgtcgcccaggctggagtgcagtggcgcaatcttggctcactgcacgcaccgtcttc

SEQ ID NO: 31100 - DNA, 178 bp, Homo sapiens
  misc_feature 81: r=a or g
aaaaaccctcaaacaattcagtcaggtataaagtacaaataaaaggccccctgtcctattcccagacccacttggttttgrgtgtttccttctagaaatattaatactacacacacaaacacatgcatacactatacacgtatgtatttttaataatcacatataaaaactgctctct

SEQ ID NO: 31101 - DNA, 290 bp, Homo sapiens
  misc_feature 81: k=g or t
  misc_feature 84: w=a or t
  misc_feature 86: k=g or t
  misc_feature 91: y=c or t
  misc_feature 93: k=g or t
tttttgttgttgttgctgttggaaatgaggtattttctttcattatgtttaattggaggttaggtttgtacataggaaagktawtkgattyckgtatatttatttttttaatcccactgccttactaattggttatggttttttaggtgattttctgtgattttccagcagaggggtcttttgtttatttgcttataggtttttggcttttgtgagaataacggaaggcttaggatactatagatgcaggccatgtttgtatttttgaaacaaatactttacccaggagc

SEQ ID NO: 31102 - DNA, 200 bp, Homo sapiens
aatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccg

SEQ ID NO: 31103 - DNA, 239 bp, Homo sapiens
  misc_feature 92: k=g or t
  misc_feature 171: n=a, g, c or t
  misc_feature 194: n=a, g, c or t
cctcttactcatttaacattgatgttacaatcaatgacatgtcattgttttgtggcactttttctttcttagtggtttgtaaaaataatggkgcatcgtgactgaaggcctcttggatttgctgaaatactggaagtagcattctccagatttgagctctagcagctctgncagaagccgggaacctgtgtgcncatactctgagtttgttttcccagttaggactgggtcctagtgta

SEQ ID NO: 31104 - DNA, 405 bp, Homo sapiens
  misc_feature 340: n=a, g, c or t
  misc_feature 365: h=a or c or t
  misc_feature 375: r=a or g
tctatctccagatggtatttattagaaacagtattaaaggagctcaactggcctagagaaaaataagcacttatataaattacatattttctcagaagaaaagaactttgccaaaatgcttttcaacttcatatgacctgagtaatcttttataaataagaatattggcattaatgaaagtgaatattctacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacancatttccagataagcaaactactahgcaaaaataraaaagtgttccacttatctttttctctcta

SEQ ID NO: 31105 - DNA, 430 bp, Homo sapiens
  misc_feature 81: r=a or g
  misc_feature 90: r=a or g
  misc_feature 355: b=c or g or t
aaggaaacattctagaatttaacttctttttgtcctcatatttcagaacatagacatatggtcacacttaactacaagtgragggcttgraaaacacataagcctatgtactcagttctctcactacaaaagagaggagaatatatattggggaacccctggcagcctcttctacagggacacagactcccttatgccaatccagagaaaccaaagacttactgagcatttctttgaggtgattctttactcgtgtaagtcttaagtgtatcatcttagctacactaacaattggggggtggaaaagagtcttttccaactgatacataccaatattttacttcagaagagatabctgaactgtatatttcagatggcatttttaaaatccaatgcctaggataatagggttagttacttttccaaaaaa

SEQ ID NO: 31106 - DNA, 148 bp, Homo sapiens
  misc_feature 83: k=g or t
  misc_feature 87: r=a or g
cactctgtcttctgtttaggaaagtgtattaagtgccttctacagttatcaaaacatccttgtattaactagcctctcatttkgagraaattataatttgttaccttggactagtaagtaggtacttaaagtctaagatttctttttt

SEQ ID NO: 31107 - DNA, 177 bp, Homo sapiens
aaagaatttagaattatttttaaaattagccctccagtttataaactggattttaatctgccagtaagtttattcaagtaaatatgtaaattgatgcataagacagttgattatcaagtttgcaagaaaatgttacctgttaactctgatattaatttcaatggttaaaaagtcact

SEQ ID NO: 31108 - DNA, 338 bp, Homo sapiens
  misc_feature 86: m=a or c
  misc_feature 167: n=a, g, c or t
  misc_feature 324: w=a or t
gttaataaacacatttaaaaggtaagcattttaattattaaatttaatttagtgtagctctttactattaaatctatagttgaaamcatttaaagtaaatagtacgctataaggaactggacaaaattcagaagacttgggttatggtcctattatctgttgactantgtttatgatctttactatttaagttaaattatgtgggcttagtcttttcatgtgtgaaatgaagaatttgcttcagtgtcttttaattctcttagcgcaattcagtacatgaaccttttaacattggcctttctctcagtttaagctaaatatatwaattaatgtgctca

SEQ ID NO: 31109 - DNA, 453 bp, Homo sapiens
  misc_feature 82: r=a or g
  misc_feature 210: b=c or g or t
  misc_feature 249: n=a, g, c or t
  misc_feature 344: s=g or c
  misc_feature 414: k=g or t
gtatagctcattagttaccttgtcaactttcctttgcttttaatcaattgaaagaaaaagtcttcatggatttttagtaggraacaataatggagctgtaaatcatcagtaatgtgtgaacttatatttacaggtgcaactgaccttgactgtgcatccttcccaacttacttcttataaatcctgtaatcaataagtgaaatagtattbcatacccttcataattcaccttccaatgtctgtttttcnacacatcatctaagcttctataaaacattcttttcctctgtaatggactccaatcctgtttataagttttataaataagagcttaacatttcttstcaatacttagaaatgacgataaaagaattagttgacaagattggtatcttaagaatttcaactccactktaaatatctaagtggatgctgcattttttcaaagagtta

SEQ ID NO: 31110 - DNA, 154 bp, Homo sapiens
  misc_feature 89: r=a or g
  misc_feature 96: d=a or g or t
  misc_feature 102: d=a or g or t
aaaatttcagttatggtatttttcagttctaaaatttccatttggttcttcattatgtcttctatttatttattttttttttggctgaractttcdattttdagtttgtttcaaatgcgttcttaattgcttaatgaagcatataatggtggcc

SEQ ID NO: 31111 - DNA, 50 bp, Homo sapiens
ctgaaaggactcgattatctccattcggagaagaaaatccacacaacata

SEQ ID NO: 31112 - DNA, 142 bp, Homo sapiens
  misc_feature 82: r=a or g
ctaaaaggccctatgagattcaaactgttgtggcctggtgcctggtaactttgatggccattttgaaatgttaccgtagtgrtaaattcttctggaatctcaagtcattaaaagtgatatggctaactctgggccctgtgct

SEQ ID NO: 31113 - DNA, 430 bp, Homo sapiens
  misc_feature 208: y=c or t
  misc_feature 402: s=g or c
tgtggccacagagtggcgaattagcacaaggtccaggctgagtgtcatcttccctcagctactcctatgcttctgcttgcatctcattgtctattcattccttggaagcctatgtcacctgccaaactaggctaccagatatattctcccttcatagccatttacctccctcacctgttttctgaagtacaataccatcaccaggtayacaagcaggaaacccaacctccacttcctgtcttcctagtagtgtcaccaccataatctgaaggttgccccttccaaatgtgatccatgactcactcatcttgctccacacagtggctaccatatattggatagctccaatattaacccttccccagatatttgcatccatgggtttaggtgccatttgatagstccactaagtattatctattacatttca

SEQ ID NO: 31114 - DNA, 368 bp, Homo sapiens
tattttgctttgattttgtccttgttattgtggctattctcatttgggtgcatttaaacctatttttccttcatatatcaaatcttaaaagagttaaaacacaattttatgttctttttatttgctgacttcgaattctgtcatgtggccaacatattttgtttttcataaagccacatgacccgtttgttctggtttttgctaggtctaggttagaaatgtaaacttttttggtttataaccctaatattttaaaacaaaaagaacttgtccctttataaacactttttcatatgttatatatttaccctactatatacatctgttatgtatatcataaacatacatatatttattcagccagaggg

SEQ ID NO: 31115 - DNA, 405 bp, Homo sapiens
  misc_feature 137: w=a or t
  misc_feature 138: n=a, g, c or t
  misc_feature 139: k=g or t
  misc_feature 248: n=a, g, c or t
  misc_feature 249: n=a, g, c or t
  misc_feature 250: h=a or c or t
  misc_feature 343: n=a, g, c or t
  misc_feature 381: d=a or g or t
  misc_feature 382: n=a, g, c or t
  misc_feature 383: n=a, g, c or t
taaactggaaaaattctcttaggaaatcctaaaatatggaagataaaatatgaaatgttttctcagtattaaatgtttataacaaccactttctaaccctcagagagcaacacagcaaatacttaacagtgccatawnkaaataaaagctagtcaaccaaaacttcccattaaataggaactgtaaactttatatacagataaaacaaccacattttcacaaactgaaacttgaaaaattaagtaaannhgtcattcactaaattggctgcttggcaaactaattttcaaagaattagcatgttcttggttggaaaagaaaaagaataagcaaagtcagaaangtaacaaaaaagatctctaaagctgggtgttgcccaadnngcagccgatggagccaaccaga

SEQ ID NO: 31116 - DNA, 268 bp, Homo sapiens
  misc_feature 47: r=a or g
  misc_feature 48: r=a or g
  misc_feature 84: k=g or t
  misc_feature 92: k=g or t
  misc_feature 213: r=a or g
tcctttataaattacccagtctcaggtacttctttacagcagtgtgrraacatactaatacagacaacctattcaataaatggkgttgggakaattggcaaggcatcatgcagaagaatgaaactggattctcatctctcactctgcacaaaaatcaacttaagatggatcaaagatttacatctaaaacctgaacccataaaaattctagargataacattaataaaactcttctagatgttggcataggcaaagagtccataacct

SEQ ID NO: 31117 - DNA, 242 bp, Homo sapiens
  misc_feature 86: k=g or t
  misc_feature 91: k=g or t
  misc_feature 94: k=g or t
  misc_feature 106: k=g or t
  misc_feature 107: k=g or t
  misc_feature 108: k=g or t
caggggttccacctagatgatgtggtttatagtatattgtatcttatactttgggggaattttaatagtcttgactactggctttkaattkttkattagtaaactkkkagcatactatcattcaacccattgcattttaccatggagtttcactattattttattattttcttcttcttcttgagaattatggccacaataagtagacttgtatgttatgtaaataaatcttaatggacttt

SEQ ID NO: 31118 - DNA, 308 bp, Homo sapiens
tgaaaaagataatataccatgatcaagtgggatttatcccaggaatgcaaagatggctcaacatacacaaatcaatacatgtgatacatcacatcaacaagatgaaagtcaaaaactatctgatcatctcagcagatgcagaaagaaaaatcactcggtaaaacttaccatgccttcatgatgaaaactctcaacaaattatgcatagaaggaacacttcaacataagaaaaggcatatatgacaaatctacagctaacttcctactcactgggaaaaattgaaaagcctttcctctaataactggag

SEQ ID NO: 31119 - DNA, 205 bp, Homo sapiens
  misc_feature 108: r=a or g
  misc_feature 109: r=a or g
  misc_feature 147: r=a or g
ttagcattatgataggaacataccataaactcttagggcagaaggagcagaaaaccaatttgtttcttgactctccttggacagttcctcatcccttaggctaatggrrcacaaagacataattagaagatagcaactgtcaagtgrtacaattaagtagtttaaaaacatttacctccaataaatcatctaggaagctgcataa

SEQ ID NO: 31120 - DNA, 402 bp, Homo sapiens
  misc_feature 2: k=g or t
  misc_feature 96: r=a or g
  misc_feature 97: s=g or c
  misc_feature 98: r=a or g
  misc_feature 135: k=g or t
  misc_feature 139: w=a or t
  misc_feature 384: h=a or c or t
akaaaaaaatttaaactgctttttcggaagaacaacaacaaaaaagaggtaaagacgaatctataaagtaccgagacttcctgggcaaagaatggrsratcagtttccttcctgtgtcgatgtcgatgttgtctktgcwggagatgcagtttttgtgtagagaatgtaaattttctgtaaccttttgaaatctagttactaataagcactactgtaatttagcacagtttaactccaccctcatttaaacttcctttgattctttccgaccatgaaatagtgcatagtttgcctggagaatccactcacgttcataaagagaatgttgatggcgccgtgtagaagccgctctgtatccatccacgcgtgcagagctgccagcahggagctcacagaagggga

SEQ ID NO: 31121 - DNA, 398 bp, Homo sapiens
  misc_feature 105: r=a or g
  misc_feature 333: s=g or c
  misc_feature 337: v=a or c or g
  misc_feature 338: n=a, g, c or t
  misc_feature 339: d=a or g or t
agagttttagttatttttagttattggggcgaaaggatcacttgcagccaagagttcaagaccagcctgggcatcatggtgagaccgcatctttaaagaaataaraaacaggccaggcgcagtggctcacgcctgtagtcccagcactttgggaggctgaggtgggcggatcacaaggtcaggagttcgagaccagcctggccaatatggtgaaaccctgtctctactaaaaatacaaaaattagctgggtgtggtggtgggcgcctgtggtcccagctacttgggaggctgtggcgggagaatcacttgaacccaggaggcggaggttgtastgavndgagatcgtgccactgcactccagcctgggcaaaagagcgagactctgtctcaataaata

SEQ ID NO: 31122 - DNA, 306 bp, Homo sapiens
  misc_feature 136: k=g or t
  misc_feature 242: r=a or g
cggacttctgccaattctggcatagtttgctcaaatgattggccttttcttggtagatctcagtctcttaacttctcctttccccttgttgaactgaccaataacctgtgagtataaaccttatatcttgtgtgtkatatggtctttcatattttttcctaaagcatatcatgtcatacatactatttttaaactgccttttcaccacttctgaaaatacctttccttactttatcttctgraaatacctttccttacatttctattttaaaacaatttatatttctaaattttcagtggcccctc

SEQ ID NO: 31123 - DNA, 378 bp, Homo sapiens
  misc_feature 48: r=a or g
  misc_feature 98: r=a or g
atagtactcaaccaatgcagaactcgtggagggacttgtgtgctaggrgataaattacctgttgtgacttccctggatgtacctgctcagacacccgrccttgcaagatcgttattaaagtctcactttcgctgttcttcgtgcctctaagtccattcttcgggtttggatggaatccccttccttgtatggctctgagtaagatttggccaagaggaatttgcacaagattttagaaggcaggaacaatgcaacagacgtgactcaatgaagatttcaggattaggatagtgatggacactcacaaagcataaacatccatgcttctggattcaacaaactcttggaaagcatttttctgcatcctgctggtgtgga

SEQ ID NO: 31124 - DNA, 373 bp, Homo sapiens
  misc_feature 92: k=g or t
  misc_feature 318: k=g or t
catgcatattgtattcttgttggaaataagtcctatagtttcttaatcgtcttcatgccgtccatatttaacaaacattggcaagtcctttktatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgtkaaaatttgtgtgcattttatgaaatgccttttttcttattttgaaagtgtaaaat

SEQ ID NO: 31125 - DNA, 205 bp, Homo sapiens
tttctgagaactgaaaatagtttatttgcaccaaattcccttgatttaaggcttattaacttgaaaagagctcagtgacatttggaattgtataatagtcttgccacagcactggcatacggagttgcattttaacgaagaagatcaggaataaacccatgtatttgtttcaaataataaagtttactgtagttgatgggcactc

SEQ ID NO: 31126 - DNA, 210 bp, Homo sapiens
gaaattaaaaaataattctgtcccagtctgtctgaacttagtacatgatccaggatgtgatgggatcttagggcttggctggaaggttttctccagtcagccatctagcagagctgcagatctgggctgggctgttggctaaagtgctcttcacagacacctcattcggctcttccttcagcttcttcacttatttcttactcagtcacc

SEQ ID NO: 31127 - DNA, 286 bp, Homo sapiens
agttacttttgaccaacctgaaaactgataggattttgtttgtcatttggtaatttctactgcattcttaccatccttctctcacaaatttttgatagcttgaagatctttttaattataattttgttgtatttgtttcctaggagcaagtgttcctgctgccagttctttcctctttaggcgtggttgagaaaaagcagaaactttacataaagctgtatttcttaatcatctttaatttgaaacttaagaaaatgaatttattctgttatatttatgtaactct

SEQ ID NO: 31128 - DNA, 313 bp, Homo sapiens
tcaatgatttcttacagtggggtaaggataagggatagaggttgcataaacaataatccaggctgggggctggtatggcaataagtgattatcagaacaatgctctgagataagcattattaacctcactttacaggaaagggaggtgaggagccaagagtttagagtacccgaagttccacatctggttagtgaacttgaaaattttctgtagaatttatttaaagtgtatgtttcctgcgtcctcactttgatctagaaaatcaaaatctgtttttttttttaacaaacatctcagtaattacgccaacgc

SEQ ID NO: 31129 - DNA, 319 bp, Homo sapiens
  misc_feature 91: r=a or g
ttcaatttatatgctataaacccaatggtgcattaaaataattattgctttatataatcttatgtattttacagaacctggaagaaggagraggatcatgtacatatttatagtttattatgtagatcttaactatttgtaattcacttcatttcttcctatggacttgagacatcatctggtatcatttcccaaagctgctttgctcacacccatctcctttgtggtgttgttttcagatgtactacatttccatacactataagtccaacaatacagttatatgcactccagcctgggcgccaaagcgagactgtgt

SEQ ID NO: 31130 - DNA, 163 bp, Homo sapiens
tacaaagaaaagatgggtgctctgtcacacttctagcagttctctagattgcatttctggtctctctcacttttgcatccagccatgaatcttaaacactggacatgcccagaactcttcctccacaagctaaagattttatagatgagaaagctggaacccc

SEQ ID NO: 31131 - DNA, 261 bp, Homo sapiens
  misc_feature 241: r=a or g
tcagtgccatattggaataagctaagaaacatctacttgtgcatttagtaactggcatagagtaacacctgatattcatcaaagagctaaaaatggggtgaataaagaatgaatgaatggagtgaattccacaataaagaggtgaatcccattattaatcaaatctgttcataactttgggctttaggctttagtttaatttttaaaacaaaggttggaagtcttctcagagcatcttagraatgtactggagccgagcgt

SEQ ID NO: 31132 - DNA, 367 bp, Homo sapiens
ctaataaatggaagttgctactagggaaaaagtaggtaggagtgggagagaatttagtaaatgtgtacttgcccaatgttattattatgttcaattgaaatacttgtttgcagttacactatcttttaaagagttgtagtaaaattataatttgttatggatttcctgttccggatgatttgaatagaatttcagattatatatatattttttctgatttcaatattttgcttactgcttgctaattcaaaagcttcaaatggaattgttttcaagtttcaagcttttcagctgatttcttagtttcacattcgatttgaatgtggaaaatttgatttgattttcttttttgtttacatgactgcgc

SEQ ID NO: 31133 - DNA, 70 bp, Homo sapiens
gttatgtaggtaaactcatgccgtgggggttcattgtacagattatgtcatcacccaggtactaagccta

SEQ ID NO: 31134 - DNA, 187 bp, Homo sapiens
tacctgcaagataaaaatataggtaaggtttgccccagatttctctcttttagtgacacttatcaactccatgttctgctcataaatttttattaaattgtgtcttgatgagaaataataatatggccaacagaactgatcctgtcttcaatgaggtcttctcagttctgtaatttaattccccaga

SEQ ID NO: 31135 - DNA, 338 bp, Homo sapiens
cctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagagggctgac

SEQ ID NO: 31136 - DNA, 241 bp, Homo sapiens
cattacatgatggtaaagggatcagtgcaacaagaagagctgactgtcgtaaatatatatgcacccaatacaggagcacccagattcattaagcaagttctcagagacctacaaagagacttagactcccacacaataatagtgggacactttaacaccccaatgtcagtattagatcaacaagaccaaaaattaacaaggatattcaggacttgaactcagctctggaccaagtggacct

SEQ ID NO: 31137 - DNA, 220 bp, Homo sapiens
tagattcaaggatttaattcatttgtaaagttggcttcaaatatagagtattactataatctagttgcctctaaacctcagtagccagctttttattgtgacagggaacctctattgaggtttgaggtaatgagggtaaaagtgtaatttcccagagaagaagcttgtgatgttgatgacgttagggatgtaaacaggattatgagggggaaaaaaaaaa

SEQ ID NO: 31138 - DNA, 266 bp, Homo sapiens
caagtttctgatcatgtacatcacgaaaacatttgaatgtcatttgttaataccttcatgcaaacagcttacaaacatttatgcagaaggggacatttcatggtgtgaggacaaattacatcaattctttctcaagtgaaattctccatgatgtctgaaacttttgtctatacaatcctcagtggaagttctatttgcaaataattttttattcatcgagttcccaatctcttttccttccacaccaacaactacaaaaactggcg

SEQ ID NO: 31139 - DNA, 240 bp, Homo sapiens
agtacagcgcacaagacgggaacaaaagaggtggtggaaggaagacacccacctttggtttctcacataaagagctcaatactcaaaacagtgaatcaacggttgaagttgcagtgtgtgaaaggcaaatggcccgggcgcgaatcggaggctgcggcgaaggaaggagtgagcatggctgagaccccgccgccgcccaccgctggtgccgaaagttgcagcgaggagccggcgaggagc

SEQ ID NO: 31140 - DNA, 270 bp, Homo sapiens
  misc_feature 99: m=a or c
tttttcattcttccaaacagaactgatctggcatgaaggagagagaagaggtgtatgagtgaaattcatctgacaagaaaaagaaagcaagaggtaggmgaatataaacctgagtaagtctaagttttcatgatttttcttcccatgaagggctccccacaaaaagtctggcagcctagattttctttttgcttttctctttttccctcttgacatgctgcaggatggctgcctcagcacccggtagcaacttcatacataaccacccca

SEQ ID NO: 31141 - DNA, 113 bp, Homo sapiens
tttacattatatattaactaatataaaagatgtagagtttatgctgagggattataactgtgcaatcaacttaattttcatgatcaatttcaaactaagacatgacaccaatt

SEQ ID NO: 31142 - DNA, 199 bp, Homo sapiens
  misc_feature 93: k=g or t
acttgaaggtttgaagatggaggctctgtgtgagaaggaatgcagggcagcctctggttgcagagagcagcacccggtttgacagctagcaakgcaattgtgacctcagacctacaatgtcaaggaattggcttctgccaacaaccagaatgagcatgaaagtggattagtccttggaacttccagataagagcccgtc

SEQ ID NO: 31143 - DNA, 261 bp, Homo sapiens
cttcaggagctcttgtaaggcaggactgatggtgacaaaatctctcagcatttgcttgtctgtaaaggattttatttctccttcacttatgaagcttagtttggcttgatatgaaattctgggttgaaaattatattctttaagaatgttgaatattggcccccatgctcttctggcttgcagggtttctgcagagagatccactgttagtctgatgggcttccctttgtgggtaacctgacctttctctctgactgccct

SEQ ID NO: 31144 - DNA, 279 bp, Homo sapiens
  misc_feature 186: k=g or t
tgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattktatctccacctctctgatacatcactctttcatcttcattgctattattaataaatacctacagtactaacctgcctcctatacctagcgagt

SEQ ID NO: 31145 - DNA, 429 bp, Homo sapiens
  misc_feature 93: s=g or c
  misc_feature 297: b=c or g or t
  misc_feature 298: v=a or c or g
  misc_feature 357: r=a or g
  misc_feature 365: r=a or g
  misc_feature 374: r=a or g
  misc_feature 385: r=a or g
  misc_feature 392: r=a or g
cacaggccggggacagtggctcctgcccgtaatcccagaactttaggaggccagggcgggtggatcacttgaggtcaggagttggagaccagsctggccaacatggtcaaatcctgactctactaaaaatacaaaaattagccaggtgtgtggtggcatgttcctgtaatcccagctactggggaggctgaggcaagagaatcgcttgatcccaggaggtggaggttgcagtaagccgaggtcacacaccactgcactccagcatgggcgacagaaagagactctgcctcatatatbvattaattaataaattaataaaaagctaatcacagtattgtgatgtcgtgtaggtatggrcacattgrctagtgggrcagactagaargctgagraacccagacacacataagtgctgcttgataacaatca

SEQ ID NO: 31146 - DNA, 239 bp, Homo sapiens
gaggccaattttagtttatgtttagggtcttggcaaagcagagggaaccctcccaccccatcccccagaaaaataaaatttgcttttgataaacttttctagaatttagcaattgaaaaaaagttaaacagaaccttgattttttaaaaaaacgttcaatatagataccacatttaacattcaaaataagattgtactttgagttagatatatggtgtggtctccaaagttcccaggcc

SEQ ID NO: 31147 - DNA, 191 bp, Homo sapiens
agaagaaataaaaactggaagaagggtttaacctcatggataataaaataaggaaataataatttttccttttcaatacttagccaattttgtgatttcgtttgtttttagctcaagaaagaattccacattttagcaagtggcaaagatgttggtttgttaacagttattcagattgctggtgggggcgc

SEQ ID NO: 31148 - DNA, 226 bp, Homo sapiens
ttgatagccatggaattaagcgatgttaattaaagtgcaaaagataacctttctgttcttactagaatagagtaataaaaagaacctaggttttcttttgtttgctggaagaaaaatcaaaattctttagttctgtcaaaccagaactcttgaaagcactttgaacaatgcctggaaaataacaggtactctgtaaatgtttaccttctctgcaagtgcccgccac

SEQ ID NO: 31149 - DNA, 405 bp, Homo sapiens
  misc_feature 256: n=a, g, c or t
  misc_feature 364: w=a or t
ccactattattaccttttcatatttttcaaaagaatagtctcaaaacattgccattttgttgttgttgttaataataacagaaaatacagccaccatttattaagtgccgattatgtataagggactattgagggcattttaaatacattgttttatttaaatttagtcttccaaacaacatggaaggcaggggcctttgtatccccttttaaggaagagaaaactgaagttcagagagtttagatgacttggccnaggtgccactgctaggaagttggaaagcacatagtcaaatcaggatctgcctccacagccaatgccctttcttttctctgtatattcttctcccttcttgagaaggtwacataactcagtattatctcacagaaaaaggagcatcgtct

SEQ ID NO: 31150 - DNA, 322 bp, Homo sapiens
  misc_feature 72: k=g or t
  misc_feature 161: n=a, g, c or t
  misc_feature 315: k=g or t
aaacggtgtgccttatcttttataggagtgaacaaccaaggcgatgggctgtaggatgttgatacatctgakgggccagatggccaccatatcagggaaagccaatgtgttttgaaaaatatgcaaatgttcaataaggtaacattaagtacaatttatantgaaaacgtgatagctgtattctacctgtgtttccagcacttgtgatcactgtgatttatggaccacagatctgtgtctgtgtcacttcattcagtgtatttattgaacaccatgtaaaactaaaggtctttgattggcaattggtttgctgtktctaaca

SEQ ID NO: 31151 - DNA, 103 bp, Homo sapiens
  misc_feature 27: h=a or c or t
  misc_feature 28: m=a or c
  misc_feature 29: y=c or t
  misc_feature 88: k=g or t
tttatagacatccagcccccttcttthmyagttggtgagttgaaaagagcactgatggattgagattcagggaaccaacttttctgtkcccaggtcacacaac

SEQ ID NO: 31152 - DNA, 201 bp, Homo sapiens
  misc_feature 189: m=a or c
caaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaagamctttgagacaat

SEQ ID NO: 31153 - DNA, 377 bp, Homo sapiens
  misc_feature 359: r=a or g
ctcacgttgtagaaaaagaggccaaaaaggtcaccttagtttatttttccaaaacataactttaggtattctaatgtattttgttagttgcttagaaaatggaaataaaatatatgtgcttattaaataatgcacagtacactagattatagagtttatttttgcttttatgctttaaagaatgcatgcccaaaacactactaccaacaggaggattttttaaaatcacagaattgatatttatctcaagactatcttaagctaatgtacttctgttacataattaaactatttctgctattatttttaaagcagtattattttataaccaattctaaaattcagctttaaaatattgracataccttcctaccact

SEQ ID NO: 31154 - DNA, 361 bp, Homo sapiens
catttctacacaagaggttgaatttcccctcttgtttcattttagtttttgtctcctgagatttaaaaacatttttaagtaccacatttctatgtattcattagaatgcctggaaattttgtttcctgatagatttctctctgattatgttgtagctaaagcagcagggaaggtggggaacgaccttttctgcagggcagcagggagcattggacatgtcagctgaaagtgtgagggaaagaaccttggccttggagatggggagccctgggcaccggctctgcctctgtgactcacaatcacattcggccagcatactttacctccctgcttctcagcttctacatgttcaaaaaaaaaa

SEQ ID NO: 31155 - DNA, 370 bp, Homo sapiens
  misc_feature 96: k=g or t
  misc_feature 293: b=c or g or t
cagattcactttcccttggacatatggatgacattagctcattacagttatgacctccctaaaactcccaaatattctttaagttcttctcttatkttccctttagtttgtagtcatatttcttagttcttatatcagttgggattcccacatcttctagttggacaatattggagaagacaccacattttaactgagttccagtgatatgacaggctttcaattctctaatctcacagaagttagaaaaaaagtagataatcaaaatccacagaaaatatagaagattccabtaactctgagaatgattctcaggtatccttaggacctcaagaaagctgttctctcctgggctgtagagagttcaagt

SEQ ID NO: 31156 - DNA, 369 bp, Homo sapiens
gtacatactccagggcgtatcctggtgacagagattgagaaactgattggaagagagtgtaatcagtagtgctggccttactgttctgaaatttctggtttctttccctcgctccaaacttaattctttcttctctattttcaatttcagaagaaatttagaatgagtgagggaaattaaaatgaagtccagaagaccagcagagatttcaccgggcatgtgggtaggaaagacttgtgagaaaaccatttgaaatggaattaaaagaaaacgtgttcagctcactatataattatagttagcttggcctggtgttttgggttgcattacctgtaagattggaactcatctgttgtatagaaattgata

SEQ ID NO: 31157 - DNA, 270 bp, Homo sapiens
  misc_feature 99: r=a or g
  misc_feature 103: w=a or t
ttatgtaacttaatcgtggaagtgacatctcatcccttttgacatattctattggttaaaagcatgttacaaagtcttgcccaccctcaagggtgaagrgcawttacaaaagggcagaacaccaggaggtggagatcactgggggtcatctagagtttgcccatcacgtggaagaaagtgatggcagacatccattgttttttctggttgctatccattcctccttctggtaattatacctagattttcctttgacgaatagcccccgcc

SEQ ID NO: 31158 - DNA, 366 bp, Homo sapiens
  misc_feature 95: r=a or g
  misc_feature 100: d=a or g or t
  misc_feature 102: y=c or t
  misc_feature 104: d=a or g or t
gagcaaagcagacagaaattcctctggttctgtagagctgacaattcattaatgtgaggtagtcaataacaaatatattttatgtcaagtggtgratggdtycdattgaagaaaaatgactcaataagaggagagaaaatgatggtatgtgtatggtgggtaggtgtgcgtgatgctgttttggatagcgaggcctccgattagatgctacgtgagcagggacccaaaagagccatgtgtttcatctacctgggggagaagcctgctggcagatcctgttgaacactcgttacctaaatctcttgcattggctccatgtcatttattgctctagtgtattcttcactatcttttcagaaagtgcca

SEQ ID NO: 31159 - DNA, 389 bp, Homo sapiens
  misc_feature 102: r=a or g
  misc_feature 103: r=a or g
  misc_feature 104: s=g or c
  misc_feature 108: s=g or c
  misc_feature 179: d=a or g or t
tctgttgcctaggctggagtgcagtggtgcaatcatagctcactgctgcctcaagtcatcctccttcctcagcctccagggtcactgggattacaaggtgtrrsccasccacagctggctccgactctcttgcatttagctacagctgcgtgacggaattctatccaattgcacgagadtggaagtttcgttcatcactttcaagtctggcccataaaggtttcccacacactgctccttcatgctccttccccatccaactggctggaattgagaggacctcacacgttgaagacagcagagcctccctctccctggatctttaaacagttacacgggagaagcctgccctgccaactgttcaccaatccagtactattaggggaaaa

SEQ ID NO: 31160 - DNA, 78 bp, Homo sapiens
  misc_feature 9: m=a or c
  misc_feature 17: h=a or c or t
aagaaagamaagaggghagaggaagaagaacgaagaaaagaggaaagaaggaggaggagaagaacaaggagaagaaga

SEQ ID NO: 31161 - DNA, 356 bp, Homo sapiens
  misc_feature 344: s=g or c
agcatcgcggctgggaggacacgtagccgcttcttccctaagcggaggtctgaactccggcttgtaccacttccccgtgggtgctgtccattccggccccaggggttccatccgaagccgcgccttcctccctctccaggacccctttctccccagcctccaggagcacctgcggaccgcgtcggctctggcccggagctgggctgctccagacgtaactcacaccggaggttacttccctcgatttgggcggggattcccttccatttttttcttcccttttctcccaagatccagcttcttgggggcactcacgggtgcccgttgcgttctgctccgtcggscccgagctgcat

SEQ ID NO: 31162 - DNA, 194 bp, Homo sapiens
tgcatcccatttaaggaaaccctgtaacttgaaagatagagactaaactgatcaaacagaacagatggaacagaattaatgaaacaggagacaaacttacaaaatagaatctcaaggagacgcaataagagtattaagaaatctttttaggactctaaagtaatttacagttttcaaaattcaaaacaggaccg

SEQ ID NO: 31163 - DNA, 215 bp, Homo sapiens
  misc_feature 47: r=a or g
  misc_feature 57: v=a or c or g
  misc_feature 68: y=c or t
  misc_feature 70: n=a, g, c or t
  misc_feature 71: n=a, g, c or t
  misc_feature 146: h=a or c or t
  misc_feature 171: h=a or c or t
  misc_feature 183: d=a or g or t
  misc_feature 189: r=a or g
gtgatggccgccgccgaggcagggagttgagggtttctgcctttcgragggtttggvgggctgtcggycnngttagaaggccaccaacagccccccaggttgccaagggcctgttagttgtgttcctggaaggtgggcaagcagchtgatgggttaacattgggatttgchgtcgttatagcdgtcaargggcctgtagcggctgcagggtcggt

SEQ ID NO: 31164 - DNA, 296 bp, Homo sapiens
  misc_feature 49: m=a or c
  misc_feature 246: n=a, g, c or t
  misc_feature 278: k=g or t
tatgaatgttaagaatatagattaagttatctttttccttgattaaggmcaccagtcaattatatggatttcccaggactggtatatgtctgatagtcactggcatggctgtatctgttgttaaatgtggagagacttctgtattgggtagtccattgctgctaattggagccccaggtaatccctgactgacctggttcattccgctgtacccccttgatctggcaactaaagggttaacagctngaggcttctgggatccagcttgagctggtggktaagtacactgaacatca

SEQ ID NO: 31165 - DNA, 148 bp, Homo sapiens
agttgtttgcgggcggccgggagagtagcagtgccttggaccccagctctcctccccctttctctctaaggatggcccagaaggagaactcctacccctggccctacggccgacagacggctccatctggcctgagcaccctgcccat

SEQ ID NO: 31166 - DNA, 234 bp, Homo sapiens
  misc_feature 116: y=c or t
  misc_feature 117: y=c or t
  misc_feature 233: y=c or t
ctgattattctgtatcatcaccagtactttgtactttgagtctttttaaatatgctctgttagtttgtatggaatgatatttcattgcacttttaatttaacttaaaaatgccttyycttgactgttgatatgtattttttgtgaagtgtgtgttgaagccttgcagattattttttaaattagaggtttatcactaggtatatctcctaatgctatccctcccccctcccayc

SEQ ID NO: 31167 - DNA, 350 bp, Homo sapiens
ttataatatctacctcacagagtatatttttttaattgagaaaaggacatttatttaaaaccataggaatccataataaaatgaactgaattcatgaccataatttctgtttcagaattacttgttttcttatatagaaaatcagttcatattgagaatagatgccacatgttgaaaaggtcatccactagtatttcctacaaggattcctataaattttgatttcaaagatatgatttctgaccaaatatctggacaaaatggctacctcttattttctagctgtacttaattcattggaaaagaaatttaatattatctttccaagttcagcttctcactaacaaata

SEQ ID NO: 31168 - DNA, 322 bp, Homo sapiens
cacactgtagatcctgcttattggtaagctttttcttaataatctctattttttttctgattataatggaaatttggaaaatacataaaagtaaaagtaaggaaaaaaaatcaccagtaatcaaatcacccaaagttacttttgttagcattctggtgtctcttcttcccattttttttctgtgtactatttacacagttttgatcaatctgtaaataacaattttatattctgcttattttattatactttcctctttaaaaaaatagagatgggatctcactatgttgcccaggctggtcttgagctcctggtctcaatt

SEQ ID NO: 31169 - DNA, 274 bp, Homo sapiens
  misc_feature 88: k=g or t
  misc_feature 215: d=a or g or t
aaatgtctctttgattacagatctaagcctgatatcctagtagggaataacatatgtatattaggactaggccacggtttatcttttkttctgtttactttttacttcatttgagaaatcgtttctcctaatcacaagtaaaatatgaacatactttaagtctggaaatcagcaattcaaaaactaaagtgtacaaatacataaatccatgagtdtaaagaaagacagtagaaagacagagttacataataaattttgttatgtgtaggcacca

SEQ ID NO: 31170 - DNA, 235 bp, Homo sapiens
tttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaat

SEQ ID NO: 31171 - DNA, 323 bp, Homo sapiens
aaatttgaactctagtcaatgtatagtaaaaaatcaatatcatagatttgttctgctttctttatgcctcctggaattttcaaagtatgggaatgaacagcttttatgaaaaagatggactataaaatgaaagatggaggactttgaccaatttcctagacctttgacccagaaacactataccagaccaggatgtcattgtcccctccctagctctgtcatgtctttgttattcccatactatgagggcattaaatgtcgagtgatatgacgactatcgcacttttggaaaggatctttgacaggttaactagaacttgcta

SEQ ID NO: 31172 - DNA, 263 bp, Homo sapiens
  misc_feature 229: m=a or c
ccccatttttcaactttttgttggttctctttatgtcttattgtactgtctttgtcttgaaacattgttgtagttgtattgagtcatcattgagtatttctacttgagtattttacacaccacagttaccatattataatactcagtttttctctgtgctattaccaatgagttctgtaccttcagatgacttcttattgttcattaacattcttttcttacagatggmaagagaatgccccttagtattacttgtaggacct

SEQ ID NO: 31173 - DNA, 305 bp, Homo sapiens
tcaatgacagaaaagcagaatttccaagtagtggcagtaattcagtgctaaatacccctcctactacacctgaatcgccttcatcagtcactgtaacagaaggcagccggcagcagtcttctgtaacagtatcagaaccactggctccaaaccaagaagaggttcgaagtatcaagagtgaaactgatagcacaattgaggtggatagtgttgctggggagctccaagacctccagtctgaagggaatagctcgccagcaggttttgatgccagtgtgagctcaagcagtagtaatcagccagaa

SEQ ID NO: 31174 - DNA, 313 bp, Homo sapiens
  misc_feature 95: m=a or c
  misc_feature 249: y=c or t
  misc_feature 277: r=a or g
atgtcctatgattcttaaccctaagtaagtttgttcctacactcccttcctctttttctctattccatacacacttcctgtctgtctccacccamgcacaggccctaggcctgccctctaatctcttgtgcaaaaatttataaaaaccagaatgtattcaccaagagagtttgggaagcaaaattgtctagtaaagatttttaaagcaggtaatcatctgatctttctagcatgattgatgggatgccyatctttgagaatcattggtgggaggggraaaaaagaacatttaaaagatgccttgtagtctggt

SEQ ID NO: 31175 - DNA, 135 bp, Homo sapiens
caagagactatattgacagccagatagtatggcagttctgaaaaaatttatatcttttcaccacttgaatatactgcaatgtgtagtgagtaaattgtctccctttttctatagatcattaggttagagtttttt

SEQ ID NO: 31176 - DNA, 288 bp, Homo sapiens
  misc_feature 247: m=a or c
ttctgtactaagaaaaattcttctgccttgggatcctgttgatctatgaccttacccccaaccctgtgctctctgaaacatgtgctgtgtccactcaaggggttaaatggattaagggcggtgcaagatgtgctttgttaaacagatgcttgaaggcagcatgctcgttaagagtcatcaccactccctaatctcaagtacccagggacacaaacactctgcctaggaaaaccagagacctttgttmcttgtttgtctgttgaccttccctccactgttgtcctgtga

SEQ ID NO: 31177 - DNA, 332 bp, Homo sapiens
  misc_feature 98: r=a or g
  misc_feature 223: r=a or g
  misc_feature 289: m=a or c
  misc_feature 292: r=a or g
  misc_feature 304: r=a or g
ctccatagcacctagtgcctagcgttaccataatacttacatcctgcagtgatttacttttgtttctttcttatagcatatactttttgaaagtaggraaacgggccgggcgcagtggctcacgcctgtaatcccagcacttcgggaggccgaggcggacggatcacgaggtcaggagatcgagaccatcctggctaacacagtgaaaccccgtctctactaraaatacaaaaaattagccaggcggggtgcgggcgcctgtagtcccagctactctgcaggctgaggmagragaatggcgtgraccccagtggtggagcctgcagtgagcc

SEQ ID NO: 31178 - DNA, 329 bp, Homo sapiens
  misc_feature 74: s=g or c
  misc_feature 75: s=g or c
tcaaggtgattctctttcctcctgggagtctgtattgatgagggagtgggagggtggagattggtgccagcagssagcagacagggctctgtggtcccactcagttgactgaagacctctttaactcaggcactcttttcctacgtcccagtggaagcccagggcagggcttcctgtaagtgaccatcttcaggatgcttccacaggaatatggccagaggagaggggccctctgatgagagaggtttttccttgtagcattcaggctgatttcacctcacagcagatgttcacatgcaggttcccactgtagtaagcacagtgcttgt

SEQ ID NO: 31179 - DNA, 61 bp, Homo sapiens
  misc_feature 15: m=a or c
  misc_feature 16: m=a or c
  misc_feature 17: w=a or t
cattgttggcttggmmwttcccactctgcctaacccagataggaaaggtagagaaacctgc

SEQ ID NO: 31180 - DNA, 271 bp, Homo sapiens
ttaaaaaaaaacaatagcatctctttttgacgctgaggcagaaactatttttttaatgtaagatactgaaagcactcataaagcaaaagattaaggcattcatattcatgaaaagtcttttcatcaagaaactccagaagaaaataaaaaacatgccattaactgagagatacttgcctcacaaaaaacctgcagtggtttagtatctagaagttataaagaactactatgaataggaaaaagataccatgatagaaaaacttagccaaaa

SEQ ID NO: 31181 - DNA, 226 bp, Homo sapiens
aactcctgaactcaagtgatccacccacctcagcctccaaagagctgggattactggcatgagccaccgtgcccagctccaaaacttctttttatagtctgaatgtagttcttgatttcttgcaaataaaataagtataatataaattttcaattagagataagaaaacttaattacatagtataccgcatactttatgcagttatctacaactcctccccctttc

SEQ ID NO: 31182 - DNA, 201 bp, Homo sapiens
taacatttttgcaacatttgtggttgattttaatgattggagaaaccatctgaaacattaacatttaaaccctttcttaaaggtgacatttttttttcagagatggagtctcacagtgtttcctaggtacaattcctgggctcaagcaatacttctgcctcagcctcccaagcagctgggactacaggcatacaccaccgc

SEQ ID NO: 31183 - DNA, 159 bp, Homo sapiens
gtaattatggtgaatagaggcatcttttaggctttaaattagataaagttagggtcaaatgtcagctcccctgcacacttctgctttgtatctatgaggaaaacagacactgggtttctgtcttcacctataaaaagagaataataacatatccaccca

SEQ ID NO: 31184 - DNA, 104 bp, Homo sapiens
cattctttcctaagaataccctggtttctctgggttcttagaatgataaaaccagaaagccagtgttaagatactacagcatttcattagttgttttttttttt

SEQ ID NO: 31185 - DNA, 353 bp, Homo sapiens
  misc_feature 37: r=a or g
  misc_feature 48: s=g or c
  misc_feature 286: s=g or c
  misc_feature 287: w=a or t
  misc_feature 289: y=c or t
caagtggaattttgtttaaaaacaaagcaaaatgaaraatatataggsccagaataatgaaagagaagaaaaactcagtagtggaatactttcttaatagcttgataaataggccagttagtgtagaagttttagagtatcttttggtgtaactataaatttactgacatctctaaatttaaaaaatgcatgcccttcattcacatttgaaacattcggaatgtcattttaaaattacttctctttttttgaaaaataaactttaaaaattaaagtaacttctcgswtyttcagcatggaaagattggggacatttagagacttggtaatttccatgcgagggcaggtggatt

SEQ ID NO: 31186 - DNA, 319 bp, Homo sapiens
aattcagagtgttgtctgcagactaggtaacattgctctgacttgagaacttaatttagaaatatttactatcaggttctatccctacacctggaatcagcattttaataggattcttgggtgattcatgtataaagtttgagaagcactgttcagtgtttgtgtgattgtggaacaatgtggaaagcaaacttattccaagtttcctaaaatgaaattaatgtgactttctttccccgcactgtattgtcttttttctttaattggctttagtctgaaactgaagtttacatgtgcttcaaaagtatcgtatctacta

SEQ ID NO: 31187 - DNA, 139 bp, Homo sapiens
  misc_feature 95: r=a or g
aactgctgtatttcctcataccacatcataattccacagggaattatggatatactcagcacggcctttcagggccattttgttgtaaaaagtaraataaacattatcctctgctctacattaattttgcaggaaccac

SEQ ID NO: 31188 - DNA, 418 bp, Homo sapiens
  misc_feature 29: s=g or c
  misc_feature 309: n=a, g, c or t
  misc_feature 341: r=a or g
  misc_feature 366: k=g or t
  misc_feature 367: r=a or g
  misc_feature 368: r=a or g
  misc_feature 391: r=a or g
  misc_feature 392: m=a or c
  misc_feature 396: r=a or g
cagagaataatcatttgggtcttgaaggsctttagagtctccaggagacctctgggtgggctgttgcctgacattgagcaatgtgtaccagagaaatggtgctgggcttgcctgggtagtggtatgggcaggagatctgggttccgagctggctttgtgagctgggttcacacgtagttgtgtgatctctggttgccctgcacttcctggagcggcctctgtggaagggcttgggctggatctcttgagcctttctgagcctattgaggttattaacttcagatgccttgcagaactgtccctgtagtnctggcatagaacaaagggtagatgcctgtaargactagggtggttgggaggacagakrrgtgctggctcctgcaggatattrmcagrccctgcatagagcccagacact

SEQ ID NO: 31189 - DNA, 377 bp, Homo sapiens
agatgttacttttttacttgcaaggatgtttcttgtattcaaaaagccactacgaaagtattattttattttggagtggggaggatagtcccaaaaatttattgataagccaataatttaggattagatttagtaatttacttagtgcatagaatatcaaagaaaatggctggcaacgtggctcatgcctgtaatcccagcactttgggaggctgaggcgggcagatcacctgaggtcagaagtttgagaccagcctggccaacatggtgaaacccccatctctactaaaatacaaaaattagccgggcgtggtagcgcacacctgtagtcccaactactcaggaggctgaggccggagaatcacttgaatctggta

SEQ ID NO: 31190 - DNA, 424 bp, Homo sapiens
tcattactttgttctggaactctattttagcatctgtaaaatgacttctaaagttccttctggggcagaaaatacatgcttctaaggttctgtctcattgctttttttttattttagtaatttaataagcatttatttaagatctgctgcattcagagcattgtgttaggaatattggaagtaaagcattgtaatagctcttgccttcagtaagcttgcagtctggcagttggattaaaaaaatgaccatacgaagccgtgataacagcctctaggagggaactctactatgtggtggagatatgtgtccccctgcaaataccaagaaagacagttaattagtgtccattacagaatgttcttctggtgtcctttttaaagagattcagtcagtctttaaagatgatgctattgctgctactgc

SEQ ID NO: 31191 - DNA, 327 bp, Homo sapiens
taaattgtctttcaatgtgtttggcagagttataaaagtagacatgagccatattgatagcggcacggcatatgaagagcttcagaatacttatgacacttctttgacgttctgtgaaaggctatagataagtacctccaaacatcatgcctccagcctcactcttgcttaaggaaatactctgaaagtagattttctttcttttttgagacagtctctctgtctcccaggctggagtgcagtggcatgatcttggttcactgcagcctccacctcctgggttcaaccgattctccttcttcagcctcccgagtagctgggattaca

SEQ ID NO: 31192 - DNA, 451 bp, Homo sapiens
  misc_feature 364: k=g or t
  misc_feature 365: n=a, g, c or t
  misc_feature 366: b=c or g or t
  misc_feature 367: s=g or c
ttttctagatatattattaaaggaaaacatccaatgacaatgtcgtcaccatataaaagattatatgtataatctaagcaaagttaatattatagaagatatacaccaaattgctaatagtgcttatattgtggaggagagattgaatgtgggagggagaaactataaactttatttcagatatttctttatcgtttacatttggcacttttacttttgtaaaccaaatgactatgaaaaatgcatgatagtgaattccataccaccatcacagtttcatctaacagcttgttatttgtaacatggagaggtctgcttattcactttatttttcctgctttaactccttgaggagtgagccacknbsccatcagcaacggtgtccctttaggcagggatactcactcctaggccagctctggtagaacatcttgattcttcccactcccat

SEQ ID NO: 31193 - DNA, 415 bp, Homo sapiens
ctttacttgtagtaatttagatttgaacaatcatcatagcttatatgtgacaccacaaaactgacagcatcaccaagtcatgattcttgagttgtttttcataaatgtgtatattcaatgtgtttaaattccatctacataaacattccattatctgttgcaactgaaaacaaaatctggaagtgtggctgtgtttggtaaataacacagctattatttttgacctcttcatagtaaaatgaagtaaaatggaaagtttggagtaggagaaaagagagattagatcttaaggcacttgatggcctccaaaaatcctgactttggaacatcaaatgcatatgtgcacttttatctttgttctgagtcactgcagtccccaaagtcatatgccaatgttcacactgaatactgtatt

SEQ ID NO: 31194 - DNA, 335 bp, Homo sapiens
  misc_feature 282: s=g or c
  misc_feature 283: n=a, g, c or t
tttttggctattgtacatcttatacttgtgttttgtggtctgtttggagtcagaagctatagggacctgaaactaacaagttagcctgccacactttcactgatgctggtggaagataggaaccttctgggtctgagatgtaggggagggacaatagcctttccttccacccatttgaagttcattagttggggtccctgtaacaaaagacagattaacaaagagaaaggtatacacttttatttcacaaaagttttaggtgacacaggagccttcataagsnaatgaataccgaagaactggttgaacctgagtgtttttatgttagctttgat

SEQ ID NO: 31195 - DNA, 330 bp, Homo sapiens
  misc_feature 33: h=a or c or t
  misc_feature 34: m=a or c
aggagtctaagtctctttgtaggtctctaagghmttgctttatgaatccgggtgctcctgtattgggtgcatgtatatttaggatagttagctcttcttgttgaattgatccctttaccattatgtaatggccttctttgtctcttttgatctttgttggtttaaagtctgttttatcagagactaggattgcaacccctgcctttttttgtttttcatttgcttggtagattttcctccatccctttattttgagcctatgtgtgtctgcacgtgagatgggtttcctgaatacagcacactgatgggtcttgactctttatccaattt

SEQ ID NO: 31196 - DNA, 403 bp, Homo sapiens
cactgatggctcatgtgatgtctcctcctttaggttacctggtatatttcacaaggcccatgacaatgcatcgggcggtgtctcccacagagcctactccgaggtgagtcagggagatgcagaagccgctctacgttcccggggccagaagtggccagagacctgggaaggaccactgagtttgcttttggacagtgcatttcagttcttcagtaaactcccattataagatttatttgagaaagattgaagtcaattaaattgcaaaaaagctgtgatttctgctgtatggttattaccaaaccattagaagaggtagcttgataaaagctattgtcaaaacaaggaaattctttttaaatgtgctttcccctattgctagcatattatttattatttgttt

SEQ ID NO: 31197 - DNA, 136 bp, Homo sapiens
tttctcacccaggctagactgcaatggcgcgatcttggctcactgcaacctctgcctcccaggttcacgccgattctcctgcctcagccttcccaagtagctgggactacaggcgtgtgccaccatgcccggcatc

SEQ ID NO: 31198 - DNA, 272 bp, Homo sapiens
  misc_feature 92: y=c or t
attctttcattttactccgtgtagacgtgccttggccagaaagcattctttcattttactctgtattcatgctattgaaagttgcttctgtyagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatccac

SEQ ID NO: 31199 - DNA, 204 bp, Homo sapiens
  misc_feature 93: k=g or t
acgattctcctgcctcagcctcgcaagtagctgggactacaggtgcccgccaccacgcctggctaatttttgcatttttggtagagatggggkttcgccatgttggccaggctggtctcaaactcttgacctcaggtgatcggcctcccacctcggcctcccaaagtgctgggattacaggcatgagccaccgcacccagtccc

SEQ ID NO: 31200 - DNA, 332 bp, Homo sapiens
  misc_feature 83: r=a or g
cacaagcattcctatacaccaacaacagacaaacagagagccaaatcatgagtgaactcccattcacaattgcttcaaagagrataaaatacctaggaatccaacttacaagggatgtgaaggacctcttcaaagagaactacaaaccactgctcaacgaaatcaaagaggacacaaacaaatggaagaacattccatgctcgtggataggaagaatcaatatcatgaaaatggccatactgcccaaggtaatttgtagattccatgccatccccatcaagctaccgatgactttcttcacagaattggaaaaactactttaaagttcatat

SEQ ID NO: 31201 - DNA, 316 bp, Homo sapiens
  misc_feature 90: s=g or c
  misc_feature 91: m=a or c
  misc_feature 132: w=a or t
  misc_feature 133: r=a or g
  misc_feature 245: h=a or c or t
  misc_feature 253: h=a or c or t
  misc_feature 282: r=a or g
ctctccaagatgtggagttttttaaattatacaatttggttgcaccttaggggatccctctgattatggaggcacagtaaggtcctgagsmataggtggtcagcagtccagaaagggagaaggccgagggcwractggagaatgggactggtgagattcagataggaagagcaggggagaaatggtcaaagtgagactggaatcaaaaggttggcatttctaaaaactataattgcacttaagahgttttgchaaaggcgatttagttacccacagtgaggracatgggtgcctatgtctccagtcacttccccac

SEQ ID NO: 31202 - DNA, 350 bp, Homo sapiens
  misc_feature 94: s=g or c
  misc_feature 95: v=a or c or g
  misc_feature 96: n=a, g, c or t
caagaatgtgcagaattagttatctcccatgcattccctcttaagcatttttttctgtaggttacttgttagacttctctgttttctgtgtatsvntctcccagtttccttttaataccctctaagctttttaatgtctatcttcagttatccaatcaccacttttcatgaattttaataatattgctgtatatctttttttcccacaagagtttctctgaggttattaaagatattctataatttacattctcaatcatgtgcatttgactactgtaaatgaagatggatgtgaggggagggatcagtatctttttccctccattagagaggtccttgttccagcaccg

SEQ ID NO: 31203 - DNA, 241 bp, Homo sapiens
  misc_feature 90: r=a or g
  misc_feature 91: w=a or t
  misc_feature 109: h=a or c or t
  misc_feature 184: n=a, g, c or t
gattagactttattctcttgttctagaagatttttaaacttctggtagttaagataaagtcagcaaatttgtgtgtatatttttgtatcrwgtaggcatgactactgthacttgtagtctgtctgtttttttttgtttgtttgtttggtttttttggcaataaaagtactttgtaccttttagnctaaggttgctttttgttttttaccttttcttccatgcgtgatactcagtgcagcct

SEQ ID NO: 31204 - DNA, 459 bp, Homo sapiens
  misc_feature 269: k=g or t
  misc_feature 275: r=a or g
  misc_feature 281: m=a or c
gtgaaatgggaaaattgaattttagctggacatggtggtgcattcctgtagtcccaggtatttggaggctgaggcaggattattttagcttgggagttcaagtctagccttggcaacataatgagaacccatctctttaaaaaaattgactttaatcaaagaaacctataattatatagcagtgggacaagatagcctcttttgggcctctgtttcatctgtgaaatgatgcttttcaattagatgatgtgtggcaagagccacacggkttgagrttcacmatattttgcaagtgatatataattaagcaatgctgttttctaaggtattcatgtatatattttaaccccatcctgtaaaattaaagtcaaactttggaaataagacaggtagataccaactggcatgtggcaacttcttggaatctgtctttcagaagcaaaactttatactgtgcgc

SEQ ID NO: 31205 - DNA, 403 bp, Homo sapiens
  misc_feature 226: w=a or t
  misc_feature 260: w=a or t
tactcactaaccccacccccacccttccatgatccctgatgatcacaaatctggcaatctttgtcagatatgtagtttacacatattttctcccagtatgtagttttcattttcttaatagggtctttcatagagccaaaatatttcattttgattaagtctaatttaccgctttttatggatcatgcttttagtttcaggtcttattaactctttgcctagtccwagatctcaaagactctctcctatttaaaaaatawataaaagtaatattgttttacatattacatttattttttgtttagagacagggtctcattctgtcacccaggctggggtacggtggcacagtcacagttcactgtagcctcagagtcctgggctcaagtgatccttatgctcc

SEQ ID NO: 31206 - DNA, 221 bp, Homo sapiens
  misc_feature 72: n=a, g, c or t
  misc_feature 73: n=a, g, c or t
  misc_feature 127: h=a or c or t
  misc_feature 128: v=a or c or g
  misc_feature 197: r=a or g
  misc_feature 214: n=a, g, c or t
cagatttcacatcaagctcgccagaggatttggaggattgtatgtaaattgaaataaattctccaaaacctnnctacatatattacattatactgtgcgatgtgtccaggtgtgcagtactaaaathvtgttagcaatgaagcattaaaatcctccggaagtaaaggccaaagcaaggtgatgttttccccataggrtaattcccatctttagnttggaga

SEQ ID NO: 31207 - DNA, 349 bp, Homo sapiens
  misc_feature 93: r=a or g
  misc_feature 98: r=a or g
  misc_feature 331: r=a or g
tgggttaagtagagtgctccatattaagatatattttaatttaatacccaccatcactcaaggcttctcccagtgttgcattacacaaagggrtttarttaaagctaatgtgaaataaacatgttaaaaggtttcctggagcacagctagaggttgattcatttcaaatatacttggagttcttccatatttttcccctatggccttatttgcatataatacttttgactcatgacattcctgctgaagtttgaatattcctccagaaatactgccagtaaaacttatagtctattactgatagaccagacccttccttcttctagttcartaattacttccccataaa

SEQ ID NO: 31208 - DNA, 236 bp, Homo sapiens
tctgtttatgtattcttcccctgtggagggctgtacacatttgtgatatctaagatgtttttgttcccaagaatcaaatttcatgtttctagctcctattaagaatttatggtctgaagtatttattccatttcagtagctgataacatgagaaatgcttatataattacagaaatgaaagcaaaatactagtcattgattgacagccagtaattactataaggatggcaaaacaa

SEQ ID NO: 31209 - DNA, 200 bp, Homo sapiens
aatgtcagatctgttgagttggtttttttggttttggtttttgtttttgtttttgttttttactgagaaaggaagggccaagggatgaggtgggaaccgggccctgggggcgccacagactaaggcagagactcccctacctggcgcccagccccaaccagctggccgctcctgcccatgcttttttttttttttttttt

SEQ ID NO: 31210 - DNA, 386 bp, Homo sapiens
  misc_feature 303: s=g or c
  misc_feature 342: w=a or t
ttgctagatgggagaatatagataaactgaactttaagcagcccaatttatgacaatccagatttaccctaaagaaaaactaaagactaatggtttaatgtagaaatctttaaaaaataaagatttctgtacgtacatttaaactttcctggtttacaaaaggtaccaaaattaattcttttgtaatcggattaaacatattaatgcaataaagacattacaaaaccttgtgataatactttttaaaaatatactgtttgcttcattgagcttgaactaataaccaggggttcttaatgtatsgacaaatatggtgtgctttaatttgtaggtgtgatggtwgcaagaggactcttagcaaacccggccatgtttgctggatatga

SEQ ID NO: 31211 - DNA, 167 bp, Homo sapiens
tgttgtcagtgtatgtatgaatatgaaagtgctttgttttgtttgttgctgttttttgtttatgtgtgtgtttttaatttttttgttcttatcagcagtcttgtgttagcactgggtaagctttaattgtcccttagccaatcaaacattaaggactatggaggcct

SEQ ID NO: 31212 - DNA, 64 bp, Homo sapiens
gataatgaattcaacttgttcaacaacacttttttcagattttatatttctttttttttttttt

SEQ ID NO: 31213 - DNA, 382 bp, Homo sapiens
taactgacttaaatttaagaggaaaatgtttaaaagtagatctctggaggggaaaaaagggcattttaatattgagatgaatcagggagtttgttaatattggcagaccatgtaagcacatgaagataatctatcctgaatagcacagcgagtcatttagaaatccagtagtaggtgtacactcggacctgtcacattttctaacctttaaacattgttttttgtttcttttttttgagatggaatttcgctcttattgtccagggtggagtgcaatggcgcgatctcggctcaccctgacctctgcctcccaggttcaagcgattcttctgcctcagtctcccgagtagctgagattacaggcatgcaccaccacccctcc

SEQ ID NO: 31214 - DNA, 178 bp, Homo sapiens
agaagttggccgggcgtggtggtatgtgcctgtggtcccagctactcagaggggtgaggctagaggatcatttgggcctgggagtttgaggctgcagtgagccatgattgcaacaacactgcacttcagccttggtgacagagcgagaccctgtctcaaaaacaaacaaaaaaaaaaa

SEQ ID NO: 31215 - DNA, 336 bp, Homo sapiens
cactaaatcttaaagctccaaaatagcctcgtttgactccaaggcacactggtgcaagaagtaggctcccaaggccttgagcagcttagcctctgtggccttgttgaaccctgcagctgctatcacaggttgagtgcctgaggcttttccaggcacaggataaagctgccagtggatctacctttctaggggctggaggatggtggcccctttcccacagctccactaggcagtactctagtgggcacttggtgtggagactccaaccccacatttcctcctcacactaccctagtagaggttctctgtgagggctccaacctacagcagtcttgt

SEQ ID NO: 31216 - DNA, 223 bp, Homo sapiens
  misc_feature 188: m=a or c
  misc_feature 189: y=c or t
taaatgagagctcaaatattttaggccttggattcaaattaatagcttaaaattagccttggagctaggaagaggtttaggcaaactcactttattaaacctagtttaatggggacctggataagtgaggtgccttgcatcacgaactagcaggtgcaaatgttgggctgagaacctagatttcccamytcccaattcccaattctggtccccacccgcatga

SEQ ID NO: 31217 - DNA, 453 bp, Homo sapiens
  misc_feature 34: w=a or t
  misc_feature 85: m=a or c
  misc_feature 300: r=a or g
  misc_feature 310: r=a or g
  misc_feature 311: n=a, g, c or t
  misc_feature 408: r=a or g
catgccatcacacctggctaattttttatttttwgtagggttgggctttctccatgttgcccaggctggtgttgaactcctaggmtcaagcgatctgcctgcctcagttcccaaagtgagaacattataggtcttgataaggagtttgtatttcattctgagtagccattgggaggtttttaaagctggggagtaaagccatctgctttactttttaataaaatcgctgtggcttctgggtggggaaatggatgattgaagtgggggcaaaggtagggacaacaacattgaaagaaggcraaacaattarnagtaaattgccgtagtgttgcccatcaccctcacctgaattccttctccttagaaattcttcgttgtctcctctagcacattgatcatcgcatttgrttcttgttctagtcatatttatacttaattagtgctttgtttaac

SEQ ID NO: 31218 - DNA, 336 bp, Homo sapiens
tttgttcttaagaaacgtatcattgtatagtcacaatctgccccacaggacagagacacttactttgagagacacaaactttcttacatggcatttgaggtttcccagcctggatgttgctttacttttcaaaaggacctactactaattggagaaccagtgttattacattccatgttttttttttctggaaagataggcagcttgtttaacagatttcctgtaggaatacgaactctgctcttacatgcaggtatacaggccttccaaagaaatacagtattttaagtctgatccctggacccactggggcacacttcaaaaaggcaaaaaaga

SEQ ID NO: 31219 - DNA, 412 bp, Homo sapiens
tttatttcagcaatcagaaaacttgtaggaaagagaaagaatatagaagggaagttggagagaagaaatatcatcaaggattattctgattatgcatcacaggtctatggacctctgtctcgtcttgggtgtttcccagacaacaactcagaggactttgtagtaaaaaactactatctcaacacctatgaaggattagtggaacttgagtcatgtctcccagattttgtgacacaaccccaaatcagagctccaaaacctaaagtcattaccaccaaagctggttttctgaagagggcagcaaggttggactatgagttggcagaggttcataaggcactgttggataagaagaataaagttcttgaagtaaagaaaccctcgcttccttcaaagaaacccaatacctcaa

SEQ ID NO: 31220 - DNA, 394 bp, Homo sapiens
tatgcacctaaggattaaaattcatgttatttatctcccaatattgcttatcttcatgctttaggaatgaatatataccaataactcacatttttcaataattcatataatcacatcaaaattcctattttggggtcagtaaatactgttttcaatcttaatttcttggatttacttattagtttagataagtaaaaccttaatggaagttttgaaatgtattatagatttctgaaacatggcaatttgtttactgaggtcaaaacttcagatggagagattattttttaaaaataaaatagttacgtgcttgtagcctttttacataacttgaattgcagaagattttcatttctctttaaaaattattaggcttttgccaagttggaaacga

SEQ ID NO: 31221 - DNA, 89 bp, Homo sapiens
gtggggacgactcttctggaggaagcagcgcgggcttgaccggcgtcggcccgccgcctccgctgccgcttcgccccaatccggtccct

SEQ ID NO: 31222 - DNA, 186 bp, Homo sapiens
ccttacaggtgtccttagcaggcaattagtccttgccatctgtatgtaccatttcctgctattgtcagcaatttggtgccttgactaatgcctagcctttcatttttgcacaccattgaaactttaatgttagtgcaatctgctgccagtcaagccatgtaaaatgaaaaaacttctagcacggtt

SEQ ID NO: 31223 - DNA, 406 bp, Homo sapiens
  misc_feature 88: k=g or t
  misc_feature 312: k=g or t
  misc_feature 313: r=a or g
  misc_feature 350: k=g or t
  misc_feature 375: k=g or t
taaaatagtgaaataaaaaattaaaacaatatcaatttggcttaaagaatggtttgaatataattgtgcatatttatggagatgattkgattttatatagataatgtgtattccatgcaatatgacaaattattgtttcagaccatggataccattttctgtattgaacaggaatcatgatgtctactaccatctcactgtcggattggtggagcaaaagattatttgtttcagcattagtgttcttttctgcttgattttctttgctctgtgttttcttttaagatcaggagtaaacctcagtaggtcatkratagttcagagacatagacttgaattacatgacccakattaatacaacttgtttcgtgttgkgcaatcttttctggaccatctacctgtgagt

SEQ ID NO: 31224 - DNA, 226 bp, Homo sapiens
ccacactcaaatatccttgagttttctttcatgtcacagttatgttctgagtgatgtaagatattccatgggaaaaggggggttctatggtcaaggaacagggtacactattccctcacctcttgcttctagtttcctttgtgacatctgaaatattatgttctttattctgatttaatttttggttgttgattatgtatccccagctatcatgtaagccccccgc

SEQ ID NO: 31225 - DNA, 244 bp, Homo sapiens
  misc_feature 217: m=a or c
  misc_feature 218: n=a, g, c or t
  misc_feature 240: h=a or c or t
catgcagtgaacttttttgtgttgttttgttttttaagagacagagtctcactttttttgcccaggctgggcaatggtgtcatcatagctcactgcagcctcaaaatactgggctcaagcaacactcccacctcagcatttcaaattgatggaattatggatgcgtgccaccatgcccagctaattttttttaagagatggggtctttctgtgttgmnccatctggtctttttttttcchatat

SEQ ID NO: 31226 - DNA, 204 bp, Homo sapiens
  misc_feature 31: y=c or t
  misc_feature 34: y=c or t
  misc_feature 43: m=a or c
  misc_feature 68: s=g or c
  misc_feature 80: b=c or g or t
  misc_feature 96: n=a, g, c or t
  misc_feature 128: n=a, g, c or t
  misc_feature 139: s=g or c
acaaagagacacagacaggggactgtcagcyggyaccggaggmgcggacaacgagttatcagcaactsaaagcacctgabgggccgcacattccanccccagcccagtcctcgtcctccacgccagcnccaagcatgtsagtaacccaacttctccctttctcctccccagactctgcgggtccttttctgtcccctttctctc

SEQ ID NO: 31227 - DNA, 171 bp, Homo sapiens
ttataatgaatagttcgggtgcgttttgtttactcctaaaaggtttctttgcgtattttctaaatgtaatatctcggggaaaatattagaaaagcacgtaattagctgaagaatgtaacttgtagtccagctctgcagcttccttaaacttaagaaaaagattgggccagc

SEQ ID NO: 31228 - DNA, 335 bp, Homo sapiens
  misc_feature 50: s=g or c
  misc_feature 163: m=a or c
  misc_feature 164: b=c or g or t
gcgtccagccccactttttttctactcttgaaaaaaacaactttctagtscatgaggtactttggctccatccccctcaaaaacaaaacaaaaaaatccatttaaagtgtcctcctagaaaagcctcagaactgccttcaactacatctgtcacctttatagmbcattttgaaattctggaagaggatgggaaacaaaattctaatttagctagagctgtgatccccaaataagtgctgacaaaattgtctaccacagaaaggccgtccttgtcatcttgtaggcatcactgctgctaaatcacatcagtacatgccttctgtggggagatggca

SEQ ID NO: 31229 - DNA, 378 bp, Homo sapiens
  misc_feature 111: k=g or t
  misc_feature 112: y=c or t
cttcccagtttgctggttgctttgtttgaaatgttcttttcctcaaatttttgcttaactactttctctttttggttttgtttgtttgcttgtttgttttttgagacgaakytcgctctgtcgcccaggctggagtgcagtggtgtcatctcggctcactgcaacctccgcctccccggttcatgccattctcctgcctcagcctcctgagtagctgggactacaggcacccaccaccatgcctggctaattttttgtatttttagtagagacggggtttcaccgtgttagtcaagatggtctcgatctcctgaccttgtgatccgcccgcctcggcctcccaaagtgctgggattacagacatgagccaccgtgtcc

SEQ ID NO: 31230 - DNA, 157 bp, Homo sapiens
  misc_feature 127: b=c or g or t
  misc_feature 137: k=g or t
ctcctacctcagtagggtagggcactgggcagaactgtgtgactcccattccaggccccagctcctggaggacatttcgaacacaccgtgagggggaagggaagctgctgtgttgaaggtgcttctbgaatagtatkttcatctcgtccactttttt

SEQ ID NO: 31231 - DNA, 190 bp, Homo sapiens
  misc_feature 132: n=a, g, c or t
ttttcaaaattttggagattttctctctgttgtttcaaggtattaaggaaaatgcagggaaaaaaaatccattcttactgaaataaaagaatccttgtggccaatataccctgctgacgaaacaggaggccnccaggagtgtgctggaagagccatcctcctctcttcagcctcctaccatagtggtgcc

SEQ ID NO: 31232 - DNA, 356 bp, Homo sapiens
  misc_feature 98: m=a or c
  misc_feature 318: y=c or t
tatatgcttagttggaaccaatagaataaataatgctgttgattgcctggaatgtgaagccaggagcaacctgtttctactcacgatgacttttctamctcctgggtttgcttaattaagcgtgtgcatcctccttgccctcttctgttcgtcagaagatccttgatgtatgggagattgagtcaacagtcaggaaggctctgagtgtcccagtggaagccatttctcgcgttgccggagggttcttagccaccatatctgtggggtgtctattagtcagggttctctagagggacagagctaataggatagatgtayatatgagaggagtttatttaggagtattgactcacaat

SEQ ID NO: 31233 - DNA, 230 bp, Homo sapiens
ttgcatatatttttaagataaagcatgagacttgtataaagttctttcctggctgggcgcggtggctcatgcctgtaatccctgcactttggaaggctgaggcagatggatcacctgaggttgggagtttgagaccagcctgactaacatggtgaaaccccctctctactaaaattacaaaattggccgggcgtgttggtgcatgcctgtagtcccagctactcaagagt

SEQ ID NO: 31234 - DNA, 247 bp, Homo sapiens
ttctttggaatctggtatttggcacagggatagtcttgttgccctgtagccacttaaaaaaaacgggcatttaagtgcgctgatgaaatagtgaaatagcttgggcacagtggcccacctgtaatcccaacacttggggaggccgaggcaggtcgatcatttgcgcccaggagtttgagaccagcctggggaacacggcaaaaccctgtctctatataagataaaaaacaaaaattagctgggcgca

SEQ ID NO: 31235 - DNA, 438 bp, Homo sapiens
  misc_feature 106: v=a or c or g
  misc_feature 107: k=g or t
  misc_feature 108: n=a, g, c or t
  misc_feature 119: m=a or c
  misc_feature 127: k=g or t
  misc_feature 128: s=g or c
  misc_feature 129: n=a, g, c or t
  misc_feature 130: w=a or t
  misc_feature 303: d=a or g or t
  misc_feature 314: b=c or g or t
  misc_feature 315: m=a or c
  misc_feature 319: m=a or c
  misc_feature 336: w=a or t
  misc_feature 371: h=a or c or t
  misc_feature 397: r=a or g
  misc_feature 401: m=a or c
  misc_feature 402: m=a or c
  misc_feature 406: w=a or t
  misc_feature 423: r=a or g
tgccaatatgtattttatcttcatgtcacaacttattttctgtagccaattctcagttttagttgaagagagatctcagtgattgtactgccaatatgacattcavkngaacattaggmatcttgaksnwtggctgagcgctgttgctcaggcctgtaatcccagcactttggaaagccgagggaggtagatcacctgaggtcaggagtttgagaccagcctggccaacataatacaaaaattagccaggtgtggtggtgggtgcctgtaatcccagctactcaggaggctgaggcaggagadttgcttgaacbmaggmggtggaggttgcagtgwgccaagatctcgccactgcactccagcctgggcghcagagcgagactctgtctcagggggraaammaagwttttgaaccccccaaartatcacatatctagc

SEQ ID NO: 31236 - DNA, 264 bp, Homo sapiens
  misc_feature 10: k=g or t
  misc_feature 12: r=a or g
  misc_feature 13: w=a or t
  misc_feature 19: w=a or t
  misc_feature 241: m=a or c
atgaaaggaktrwtaaaawtgaccattggttaaaaaatataataggtgattttaatatcagtgatcagggacaaaaatataaataatgatttggaacagcaaagggagaaacactaagaaaaacacaaggaaatggagtgaaatgatcagaagcaaaacataatttgtggaaaatggagtaagtgcaggagcaaaaggagtaaatgtaagagaaaccctattcaaagaaataatagaagamaactcatttgagctgaaggaaaa

SEQ ID NO: 31237 - DNA, 349 bp, Homo sapiens
tttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagctct

SEQ ID NO: 31238 - DNA, 312 bp, Homo sapiens
ccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgctcat

SEQ ID NO: 31239 - DNA, 376 bp, Homo sapiens
tgactggggtttctagtagattccagtgtggagcaggattctaggtcttataactcaatctgaggatcatcgcaaccctagtgacaccctaggggctcttcccagtgtgagtgttgagaagggagggctccaggcctttttgaaggggtgggagattgagatcattaaatatggttgaagttgaactgttcagtttgctcataggttcaagattggggaatggtagtcatattttattaaacttgattatctctgcctgctatgtaaacacttagctttcagttgttcatgtgtgagttattccctcttcagcacatgcagacaagttttaatgttcatctgcatgtaaaataaatcagtgtgtattgcccggtaa

SEQ ID NO: 31240 - DNA, 139 bp, Homo sapiens
  misc_feature 109: s=g or c
tttccctatcttgtagataaagaaatgaaggtctaactggattaggtaatattcccaggttaaacacttaacaagtgtggaaccaaaatctcacgcagatctttctggscctcagcctgttcccactatgccacgctgc

SEQ ID NO: 31241 - DNA, 366 bp, Homo sapiens
  misc_feature 71: s=g or c
  misc_feature 72: s=g or c
  misc_feature 233: y=c or t
  misc_feature 332: s=g or c
actcaacttggtgtcctggacgccagagccgaccgagcgcgctgcccaccggcggcggacacgggctccgssgctccggacctcggcgacagagcaaatcagttgcctggagttcccagtgaagttgtacctgtgcccgtgcgtaacgtcagtggaagctgccccgagtttggggctttagccccttggagaaaacagggccacatagctgcctttctatcaagtctccctayaaaactgagaggctctgggaaactcagcctgtgaccccagcgtgggtgaagataggatcaagatggccatgtggcagggtaagaaattagcacttattsttctaactggtttttcctcctactctattctcta

SEQ ID NO: 31242 - DNA, 262 bp, Homo sapiens
  misc_feature 143: w=a or t
agactgctgtgctagcaatcagcgagactccctgtgagtaggaccctccgagccaggtgcggcttataatctcgtggtgcgccgttttttaagccggtcggaagcgcagtattcgagtgggagtgacccgattttccaggcawgcttacacacaggacatagttcagaaggcattagaaggcatagagtaaaaagggatggaagaagatacttggaaaaatcagggaagagtgaagaagatacttcaaaaaatcggggaaag

SEQ ID NO: 31243 - DNA, 222 bp, Homo sapiens
aagttttacttggccatgtaattgtttcacatttcagatgcagtcatcatttacatcttcagaacaagagctagagcgattaagaagcgaaaataaggatattgaaaatgtatgttatttgattgttttacttgtaacctatgatttgtttttagcattaacggttgtctgaagatctatagtttaagattactttatagttatgctcttaatatcttgggt

SEQ ID NO: 31244 - DNA, 255 bp, Homo sapiens
tttagtgtgactgtaagacaaaaatttaatagagggccagatgtggtggctcatgcctgtagtcccagcactttgggaggctgaagtgtgaggattgtttgaggccaggagtttgagaccggactgggcaagaaagtgaacctcatctctagaaaaatttttttaaaaagctgggtgcagtggcatgcacctgtagtcccagctacagaaagctgaggtgggaggatcagcttgggtgacacacacacacacatc

SEQ ID NO: 31245 - DNA, 350 bp, Homo sapiens
  misc_feature 121: k=g or t
  misc_feature 229: b=c or g or t
  misc_feature 302: k=g or t
  misc_feature 306: k=g or t
gacgctccggagccgtcgccagggtggtaatacctggtgcagagcttgagtctggccagcgggtcaggctcttgctagatcagcaccggaggtggaagactggtacattttacatactttkggaaaaaaaaacgttgctgaagttactagaaaagagacagttcttctgctgacaactcttcaggaaataattttctacctccttaggattcgaagaccagttcattcbtagtgtcttctgaaataaaattagaatggattgggatgatgaatattctcataattcttttgacctacattgkttgktaaactcatttcctggagacttggagtttgagcagatcttcagt

SEQ ID NO: 31246 - DNA, 302 bp, Homo sapiens
  misc_feature 125: s=g or c
  misc_feature 226: w=a or t
  misc_feature 227: b=c or g or t
aagtggggccaggcgccgtggctcatgcctgtaatttcagcactttgggaggctgaggcaggtggatcacctgagggtcaggagttcgagaccagcctggccaacatggtgaaacccatgtctastaaaaaatacaaaaaattggccgggcgtggtgacggtcgcctgtaatcccagctactcgggaggctgaggcaggagaattgctttgaacccgggaggtggwbgttgcaatgaggtgagattgtgccactgtattccagctggggcaacaaaagtaaaactcagtctcaaaaaaaaaa

SEQ ID NO: 31247 - DNA, 322 bp, Homo sapiens
  misc_feature 85: m=a or c
  misc_feature 121: s=g or c
  misc_feature 139: m=a or c
  misc_feature 195: k=g or t
  misc_feature 279: k=g or t
  misc_feature 307: h=a or c or t
gcatctttctctgaccagtgaagtcgaagcagtgagcaaggaggcctctccaaggaactgtttcaatccactggatgtgccaggmctcaccaggaataaaaggttagtctctaagccaggsccaaatgggggctattamcacttagcactacttcagaccagccagtgagagtcaggatgcacagggaaggagaktgggagaccctggaagggaacttctaggtcatctggttaattttcctccactaacaggagtgagtagcagtgttggtggtcaaktagtaagctaggaggagaaaggacatahctagtcttttacaga

SEQ ID NO: 31248 - DNA, 314 bp, Homo sapiens
  misc_feature 294: k=g or t
cattagctaaataaactgattaccaagcagaggtggatacattgcaattctgtcattgtgtttgagtgatacacttttctcagttaactttgcaatttaaactctgcccccccagcacgcaactctgatccacactgaagcttgagaaccgcttccctctactccctgaagcctttccaggcatttctcctttagtccaagggagtcctgcaggctgttgacgctctgactaccgccttattagagagtcagtactttccgtacccagattcatgtttgccagggcgttgcatkgttcagcgctagaggttctc

SEQ ID NO: 31249 - DNA, 78 bp, Homo sapiens
tatttctttttgttctttcagtttttgctgcatgtttgaagacctgttattaggtgtatatatgtttaagatttttat

SEQ ID NO: 31250 - DNA, 242 bp, Homo sapiens
tttgtgattttcctttgttttaagtctggtataagatctcgctcacataaatatttaatactctttttgatggtgactgacttttggtcgtatgatggacatttaggcccttaaatctgccccatgagcaagatgacacacctttggaaaaacagaagctattctgggaggtacatgaatatgttcacattttatcactaagtttcatttaatatgccttattagtaataagcatgtatacc

SEQ ID NO: 31251 - DNA, 268 bp, Homo sapiens
  misc_feature 64: b=c or g or t
  misc_feature 65: k=g or t
agatttagaagttagtggccggaggggcctggtccgagtacagctttcatcgcctttactcccbkaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccacca

SEQ ID NO: 31252 - DNA, 151 bp, Homo sapiens
  misc_feature 110: d=a or g or t
  misc_feature 117: d=a or g or t
tgaccaggatggtcttgatctcttgacctcatgttctgccagcctcggcctcccaaagtgctggaattacaggcatgatcaaccaccccaagtccagaatttcctaacadggtctcdagagatgaaggtgctactgttcagtgacccctca

SEQ ID NO: 31253 - DNA, 301 bp, Homo sapiens
gtgaacatggaattgtgactgttttttagttagcttgcaagaatgctatgaacaatattaatgtaaaacaaaaatgaattaaaaattttaatatttataataactgatattccactagtaggtgatataaaacttgagatgccacaatgaagaacaattaaaaatagagattagaatttcttgttgagaaacattttagaaacatttttttcttcagcataccactgttaccaaatagcttgggaacagagttagccattgcaatggaaaatgaatttgaaattcaccctgtaagtgtcat

SEQ ID NO: 31254 - DNA, 416 bp, Homo sapiens
  misc_feature 387: m=a or c
  misc_feature 412: v=a or c or g
tgataggaccaaaataatttgaaaacacgattagcttattgttttgttttattttgtattgttttgttttgttgatgtgtatattttctagggaaatctcttaagggaaaattcttgagttatatcctgaggactttatggtttttgcctcattttttacttgctagacttgaatatgtttgttaatgtccgtagtccagaggaagaggatgtgagggcatgataaatcagttcagctcttatcttcaagttggttttatgagtcactgaagtaatacatttttatccccttcctttaaaaaggcattggaagtatttatgaaatcaactgatagtgatcatgctttaaacatataaaccattgtgtaaattctaaatccatttagmctatctaactatattatttgtaggvcctc

SEQ ID NO: 31255 - DNA, 215 bp, Homo sapiens
gaggctatggatcagttggaagaatgggaatggggaacaattacagtggaggatatggtactcctgatggtttgggtggttatggtaagtatctctagttcagtttgtgttagtccgcatatgtagtgcaaactttaaagtgcaggtattacttttattattttatgcagatatctcctgctgagtgattcttaatatctttttcttaaggccgc

SEQ ID NO: 31256 - DNA, 399 bp, Homo sapiens
  misc_feature 127: w=a or t
  misc_feature 128: w=a or t
  misc_feature 240: h=a or c or t
  misc_feature 241: b=c or g or t
aatacaataataaaacgttttaatcagtactaaaactttaattaagccaataatgatgcatgcctgttgtagctgacagcatgggtcagtacatccttcagcgagtgccttactctaattgaaaccwwgcacacgtaaggtacaatatgttagactctgtgattttgttttcaaaatcctctgttatggctatatttaaatttattttaaatattcctgtatgtattcatctaagcatthbggcatttggagtcttaatatacaagaaacacgtacttaaatttttatgcttatcaccgcaatgatggcaaacagtgattttttttttcatagtttaggtgtcattgttgccagcacctttagtgctcagtcttcagtgaaaatataaagtgccaaaaa

SEQ ID NO: 31257 - DNA, 420 bp, Homo sapiens
ctaactcggatacctgcagaggtgtcacaggcaacagaacttcatgtcctggatgtggcagggaacaggttgctgcatctacctttatccctgactgccttgaagttgaaggctctgtggctatctgacaaccagtcccagcccctgcttacattccagacagacacagactacaccacaggagagaagattttaacctgtgtcttacttcctcagctgccttctgaacctacttgtcaagagaatctgcctcgctgtggtgcactggagaacttggtaaatgatgtctctgatgaagcctggaacgagcgtgctgtcaacagagtcagtgcgatccgatttgtggaggatgagaaagatgaagaagacaatgagacgagaacacttctaaggcgagccactccacacccaggggagtta

SEQ ID NO: 31258 - DNA, 78 bp, Homo sapiens
  misc_feature 32: y=c or t
tctgtgctgtgtcataatactaaatggcatayagtgatgtaaatcaagcatgatcgaaaggcacctaatctactccca

SEQ ID NO: 31259 - DNA, 431 bp, Homo sapiens
  misc_feature 315: b=c or g or t
  misc_feature 377: h=a or c or t
tttcacagtgcaggttgagtatgccatatctgaaatgtattggatcagttttttggattttggactttttcagattttggaatattcacagagtacataccagttgagcatcccaaattcaaaatctgaaatgctccagtgagcatttcttttgagcatcacgttggcatttgaaaaagttatagaccgggcatggtggctcacgcctgtactcccagcactttgggaggccaaggcgggcagatcacatgaggtcaggagttcgagaccagcctggccaacatggtgaaacctgtctctactaaaaatacaacbattagctgggtgaggtggcaggcgcctgtaattgcagctactcaggaggctgaggcaggaghgcacctgaacccaggaggcagatttgcagtgagctaagatcatgcctctgcatt

SEQ ID NO: 31260 - DNA, 215 bp, Homo sapiens
gcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggaatgctggcactggagatgctgggtcgccgggcacacaacgatcaccccaacac

SEQ ID NO: 31261 - DNA, 328 bp, Homo sapiens
  misc_feature 218: w=a or t
ttcaccatgatcaggtaggttttttcctagatacaaggatggttcagaatacacaaatcaataaatgtaattcaccacataaacagaattaaaaaacaaaaaccatattcttatgcagtaaaatccagcatctctccatgataaaacctcaacaacctaggcatcagaggaacatacctcaaaatagtaagagtcatttatgacatacccacagccawcatcatcctgaatgagcaaaagttgaaagcatttcccctaagaaccagaacaagacaaggatgtccactctcaccattccttttcaacatagtactagaagttctagcca

SEQ ID NO: 31262 - DNA, 353 bp, Homo sapiens
tcgtacattgagatctttgaaagaagttgttttgtgccttcttaggtaagcggaattgatagactttaaaatttctatgtgaacataaaaccattggtttaaaaagctaaaagtgcatcatttatcacttactccccaaagtttttccaaagtcaagaataattatagaactatgagagtcaggatggcaaaatctgtcatccattctcatgggtggttagggctgagaaaaaaatgtgatccactctcatgggtggttagagctgagagatagagaggcttaatttgggtttacctattggccctgaggatccttgaccaaatttttatgaactttaatttcttagggtagt

SEQ ID NO: 31263 - DNA, 390 bp, Homo sapiens
caaccaaaaattataaatttattaagatgtggccttacatatggcattccttgtgttcgtaatgtgagatttttgatttagataaatcaagattcaggattaaagtttcattgtaagttgaaatagaaaatgtattaaaatgtctaggcttctgggaggaagttcttatactcttctttcttggcattagaaagaagcaatatgaatttttgtgaatattctaaatattcaggcaacactgttcagattgatttaggtttgtcttaaccaatgttctttttttagaatttcaggttgtggcattcactgagtatgcagctactatggtttttgtatgggcgtataaatacttgattatatacgcagattttaatgtctttaaagcttcct

SEQ ID NO: 31264 - DNA, 333 bp, Homo sapiens
cctgcaatagggtggtcacatcattgtttagattgcttaggtttaataatagctaccacgcctgtaatcccagcactttgggaggctaaggtgggcggattttttaaggtcagaagtttgagaccagcctggccaatgtggtgaaaccttgtctctactgaaaatataaaaattagccaggcatggcggtgggtgcctgtagtcccacatacttgggaggctgagtcacgagaattgcttgatcccaggaggtggaggttgcagtgagctgacaacatgccactgcactccatcctgggcgagagagggagattgagtctcaaaaaaaaaaaa

SEQ ID NO: 31265 - DNA, 125 bp, Homo sapiens
agcaaggagtgtttgaagtttctgctttgaactccgtccagcctgatccctggcctgagcaacttcacaacagtaattgcactttaagacagcctagagttctggacgagcgtgtttggtagcat

SEQ ID NO: 31266 - DNA, 320 bp, Homo sapiens
  misc_feature 132: m=a or c
cttaagctgcagtgtgaaagttggattggaggaatggattctagagagtgtcataccattaggagattattctgttaaaacaggtcatagatacacagtttttagttacagactaaagtagtaactagagamagacgtgtctgtctcggagacggataacgtttaagtatttgtttgattaaagcaatttttctcaattgtttaagaggaaagcagtaactacatcatgtgcgctaaaatttgtaggtttactttcttttggaatggggattagattagattcaaggatgctgcattacctgaaaattcggattgaatat

SEQ ID NO: 31267 - DNA, 323 bp, Homo sapiens
  misc_feature 231: r=a or g
aactgacgaaaaatactgcagctacatttcagtcttttaaggtaaaacaagatctagaatattctagttcagtatactgggctcaaaaccaactttccttttgaaatgcatctagactagactatattccttacataatatcattgtcatcatcatcttcatgttttctcttcagtgggtttgcttcattggctgtgttctgtgacgaaaccatgttggtggtaataagartatttttgggcccaatcattgaaggattaatcagaacattttgaactgcagttgttgcaggaactgtaaacagagaagaaagccccccaaaa

SEQ ID NO: 31268 - DNA, 263 bp, Homo sapiens
  misc_feature 14: y=c or t
  misc_feature 27: s=g or c
  misc_feature 42: m=a or c
  misc_feature 76: s=g or c
  misc_feature 90: y=c or t
  misc_feature 109: y=c or t
  misc_feature 162: s=g or c
catttctgcctttycttgaccactgasgctataaaaactgamacttaagtcaatttgtttcagtaaaatatctcasgttaaacccttctyacctctccctgcttctgtyttacttagtttttggcaatttcttactctcttgccaacttgtaggtgcttttsggaaaatgtttttcatatttcatctagcattttaaatcattttcaagagaagggctggcctgacatgtagcccactatgctattagaaatggctgccgcga

SEQ ID NO: 31269 - DNA, 119 bp, Homo sapiens
taggagaaaagaaaaactaacaataatgataattacaaaatagtccataataaaactttcaactccccatggaattaattctactttttggtatgtcttgctgacctcttaacccccct

SEQ ID NO: 31270 - DNA, 242 bp, Homo sapiens
  misc_feature 92: w=a or t
  misc_feature 93: r=a or g
  misc_feature 94: r=a or g
  misc_feature 103: r=a or g
  misc_feature 175: r=a or g
  misc_feature 176: s=g or c
caacgggtaccctcttcagtggatattggaatttatgttttacagacaaggaaacttagttatgtgttttgcccaggctaataagttatggwrrcacaattcraaataggtctgtagctttggctttgaatacctgggtagtgagtaaaattttcatttcatgtggtggtttttrsatagttgtaatccaagcagtaacacttacaggaagattagattgtcagtaatgtgaacagtagatt

SEQ ID NO: 31271 - DNA, 151 bp, Homo sapiens
tccttttgtttataagtagatagctacagataaaaaggttaagtatttccacaggtagctactctatgtttaccttatgtaaggtgccatttactgattgtgagatgaatacataattgactattctcctacttgctccttcccagcccca

SEQ ID NO: 31272 - DNA, 99 bp, Homo sapiens
ctcataatgttttaagcaagtgtatgaatttgtattgggccacattcaaagcagttctgggctgcgggttggacaagcttgctctaaattctgtcccgc

SEQ ID NO: 31273 - DNA, 201 bp, Homo sapiens
  misc_feature 115: r=a or g
agcaatttgtaaggatatttagatggagcactgtcacttagacattctctgggggattttctgcttgtctttcttgagctttttggaaggataattctgataaggcactcaagaracgtacaaccacagtgctttcttcaaatcatatgagaaatactatgcatagcaaggagatgcagagccgccaggaaaattctgagt

SEQ ID NO: 31274 - DNA, 281 bp, Homo sapiens
  misc_feature 278: k=g or t
cactgatgtctgctgtttattatttccttttttctacttttttttgcatttactttgctctttgttttcatttcttaagaagagaacataggccattgactttagatctttcttttttttttaaaatatgagcatttatagctgaatatttctctttaagcactgtttttgctgcatcttacaaattttgacatgtattttaattattattcagttccatattttccaattttccttgtaaacacattattgatccatggattatttagaagtttgtkgtt

SEQ ID NO: 31275 - DNA, 201 bp, Homo sapiens
catctaggatcataattctgaaacaagatctggtactgtcattcccctccttaaacatgtcaatgtccatcattctcagaatattaacatcttaagctccttagtttagcatttaggttcttcaggattccctttagtcagtcactgaccaccagcttcatctcgttgccactcccttctgattcttcatccccccgctat

SEQ ID NO: 31276 - DNA, 274 bp, Homo sapiens
caaactggttaccctgccacatgtatacccccttctccccattctcacttcctcgttagacgaaatgatcatccagtgaagccatagattatattggccatctaatatcaaaccatattggtctcatttgaaaatctttcatgatgctttgtggtattcacagtgaagtttagattccatggataagagcatcaagtcctctataatctggtctctgattctctgttttctttttatcctgcacacacacacacacacacacacacacacacac

SEQ ID NO: 31277 - DNA, 312 bp, Homo sapiens
  misc_feature 98: r=a or g
agattgctgtcaggtaaattagggagttggtgggaggcccgttgattaggattaagagctagactctattctggggagtgcagaaaaggagagactaratggagaaggatgggaggctgggagggagatcaaagaactagcaggcgagaactaatgaagtcctagtttagagttggggtaggaagaggtggttggaggattcagtgatcattactgtagttgttaaatccaggtgcttgttcccgcttctgccacacgcaaaattgtctttgtttgcctttggatcgcaaaggcagaagaacagcatcactg

SEQ ID NO: 31278 - DNA, 301 bp, Homo sapiens
  misc_feature 28: k=g or t
cctgttgtatgaatggcatttgtatatkaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaagaagccaacttttattccctttcctctcccccccccaca

SEQ ID NO: 31279 - DNA, 336 bp, Homo sapiens
  misc_feature 90: k=g or t
ccattggtgtgtgatgtaggaaatcctgtagttgtattttcttgaactgaaatatttgactcaaaataattaagactcattgtcattttkcatcttggcattattgtggacaagttgacatattaaatctctttgctttctggtaagcttagcttttaaaatgcattttcccttgtcctgtctttaactagatatacatgcttatatttatagtgggtttcacagactataaaattgaatgtatgaaatttttatttatatcagtgcttttaataatgaagatatttttggagtaatggtgctgtcttgtagcgagttattaatcatagtaagatt

SEQ ID NO: 31280 - DNA, 160 bp, Homo sapiens
ccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaa

SEQ ID NO: 31281 - DNA, 131 bp, Homo sapiens
ttaattggagcatttagtccatttacatttaaagttaatagtgttatgtgtgaatttgatcctgtcattatgatgttagctggttattttgctcgttagtttatgctgtttcttcctagtctcgatggctg

SEQ ID NO: 31282 - DNA, 171 bp, Homo sapiens
  misc_feature 27: m=a or c
ctgatatttaaacatgtgatacctggmagtctcgtttaacaggtacaaggaaaacgtgcctagattcccaggaacatgcaaaatcctttctttcttatctctttagctctggactgtgattggcaaggtccttcttccagcattcagcccagctaagcccccaggtgccta

SEQ ID NO: 31283 - DNA, 213 bp, Homo sapiens
  misc_feature 97: s=g or c
  misc_feature 183: k=g or t
  misc_feature 195: k=g or t
  misc_feature 198: r=a or g
acaaaaattaaccaggcatggtggtgcacacctttagtcccagcttctcgggaggctgaggcatgagaattgcttgaacctgggaggcggaggttgsagtgagccgagattgtgccgctgtgctttagcctgggcgatagagcaagactccatctcaaaaaacaaacaaacaaaaaaaaaackgcttcaccactkggrgaccaagcacccaga

SEQ ID NO: 31284 - DNA, 341 bp, Homo sapiens
  misc_feature 66: r=a or g
  misc_feature 97: k=g or t
  misc_feature 111: k=g or t
  misc_feature 167: m=a or c
  misc_feature 211: k=g or t
  misc_feature 214: m=a or c
  misc_feature 249: k=g or t
  misc_feature 275: m=a or c
  misc_feature 276: h=a or c or t
  misc_feature 314: d=a or g or t
  misc_feature 322: m=a or c
tcaattataaaaatgaataatacatttccaaccatttgggctcacataaaatgtattcatataggracaaaaagaatgcctgcaaagaactagttakacatattccatgtkactttttagattttgacagtttgctactgtctaataattgagatacagtatctgamatatttttgcagggcctatttatatgcatagcaagtctctcttkttmgtggtttatgagactccaccctcattttgcctgtkagcaactacttgcaaattaagccagmhttaagtaggagattagtggtggctatcaaagatgggadccatcatmagctaataataccatccca

SEQ ID NO: 31285 - DNA, 410 bp, Homo sapiens
  misc_feature 155: m=a or c
  misc_feature 327: n=a, g, c or t
  misc_feature 328: k=g or t
  misc_feature 338: y=c or t
  misc_feature 370: b=c or g or t
  misc_feature 376: k=g or t
atgatatttattctttcaatccatgagcatggaatgtttttgcatcatatctctatgatttctttagcagtgttttgtagctctccttgtagagatctttaaccaccatggttggatgcatttctaaatatttttgtgctattattttaattaamattatgttcctgatttggctctcagcttgaatatttttgatgtatagaaatggtactgatttttgtacatttattttgtatcctgaaattttactgaagttgtttatcaggtctaggagccttttgggggattctttagggttttctaggtatagaattatattatctgtgnkgagagagttygacttctcctatttggatactttttatttatbtctctkatctgattgctctggctagcacttctagttctat

SEQ ID NO: 31286 - DNA, 277 bp, Homo sapiens
taaaaaagcaacaatctaagttctccagttcttgatgggtgtgcgagcaggggagggtggtggccagcatgtaggcgtgcttatgaagaccaacagcctgttttctcgtcagaatccactagcttccaccaatgatgatggatttacgactacctatcaactaaaaaaacagacgtaaggaacagaaacagcaagaaccagaaagaagactggatatagataaacacacacatctcttcagatgaatctacctttgtctttcctgctgttttgtctt

SEQ ID NO: 31287 - DNA, 139 bp, Homo sapiens
  misc_feature 89: m=a or c
caccaaagagacacagcagaaactgctggagaaacacggatccgaaagcccagtaatgacggctcctctcctctttctattctctccamcccatctgttcccctacttccttcaaagcacacatagacacacaccccga

SEQ ID NO: 31288 - DNA, 200 bp, Homo sapiens
aaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccaact

SEQ ID NO: 31289 - DNA, 286 bp, Homo sapiens
  misc_feature 186: n=a, g, c or t
  misc_feature 250: k=g or t
aaaatacatttttctcatagaaatacttcctaaagggccatatattgtgcactgaaaggaactttgaaattgactaaaaatacagaaagatggagggaagatagtcgaagttattagattctgtggttagataggcatttttaggcttcaataccttttaggttccacatttattgggtgtttaanataaacacccaaattaaagtcagaggctaaaaggtacctgtagattccatgtttatttgttatktgtctggtagatattgcaagtactcttcaaatcact

SEQ ID NO: 31290 - DNA, 265 bp, Homo sapiens
tgacactatgatcattcaacatttttttaaaataaattaattttttttagttttagggattaggcctcactctcttgcccaggctggagtgaagtggcgcagtggcacagtcatagctcactctaaccttgaactaactcctcaactcaactgatcctcctgcctcagcctgccaagcagctgggattatagacatgagccaccttgcccagctcagtatcatttttcacattcaagctaatgaaataattcaatagaattaaac

SEQ ID NO: 31291 - DNA, 232 bp, Homo sapiens
tcccacttataagagacaacacgtggtgtttggttttctgttcctgcgttactttgctaaggataatggcttccagcttcatccacgtccctgcaaaggacatgatctcatttcctttttgtggcggcatagtatctcatggtgtatatgtaccacattttcttcatccagctttgtgatactaaagaggccagttacttactacacactcaccaaaaatacagtggcaaaa

SEQ ID NO: 31292 - DNA, 325 bp, Homo sapiens
  misc_feature 288: m=a or c
gcagtaaccatgtggatgtgctgctgaagcgtttcctcaagctcgctggggtgggaggagaggaggaggaggaggtggtggtggaggaggaggcagggggtggagagagagaaagcgcacgccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcamccctcgctgggcttgctttggcaacagagtgcctgac

SEQ ID NO: 31293 - DNA, 290 bp, Homo sapiens
ttggatgattgtcaaaggatgggaggttggttctgggttcagagaatggggaagtacattgcccattaagaattttaagagatctaaaagtgtgacccacaattgatgattttattatcttcacttcagtgataaaattcttcaccctcctcattccataatattctgctgctttcacctgaagttcgccaggtatgattaaacattgagtaattcagaccaaagcttccagatatctagtaacaatatacactagtcaaaaaacaagatcacacacacagacaccacac

SEQ ID NO: 31294 - DNA, 356 bp, Homo sapiens
  misc_feature 31: r=a or g
  misc_feature 33: r=a or g
  misc_feature 38: k=g or t
  misc_feature 39: r=a or g
  misc_feature 44: r=a or g
  misc_feature 325: n=a, g, c or t
  misc_feature 327: w=a or t
aatcagtaataaaaccttttttaaaactttrtrgtaakrccatrtttgtaatgttttgtacaatagggttttttgaggtaaaatttgtcaatcttaagtgtacagtttgataaattctaacaaatatatacactcaggtaatcacgctaataaacataaggaatattttcatcatcccagcaaattctctcttgccacttttcagttttctctttctacctccagaagaaatcattgttctgattctataatcgtgagttagttgtattaaagcaaatggaatcctatagtaactagtgctctttgcattggttcctgtcacttngwaggatgtctttgagattcatcttcctctt

SEQ ID NO: 31295 - DNA, 296 bp, Homo sapiens
  misc_feature 126: d=a or g or t
  misc_feature 128: b=c or g or t
  misc_feature 252: n=a, g, c or t
  misc_feature 254: n=a, g, c or t
gtgagggtacatttttcttgatatatatgtactttaaggatattggatctgtttatggatctgttttaggaaacagatttgcaagggataattgtatatatagtagtatttaggtttatttcaaadtbatcttagggatgcctagatgcataatttttaccaggacatattgaaaatattgcaaagagatagccagttatattatcccattcattagaaattaccagtgtaactaaacataaatattccagntnagagtgcttaaacgtagctatctttcttaaggccaggatggg

SEQ ID NO: 31296 - DNA, 236 bp, Homo sapiens
  misc_feature 136: k=g or t
  misc_feature 163: w=a or t
  misc_feature 176: r=a or g
  misc_feature 217: v=a or c or g
aaactggctgggcgtggtggtgtgtgcctgtggtcccagccactcgggaggctgaggcaggagaatcgcttgaacctgggaggtggaggctgcagtgagccgagatggcaccactgcacctccagcctggtgacakagcgagactccatctaaaaaaaaaacwggtgaggggatarattggtgggatgtggcagctatcttaggtggtctgggaaavctgctccctgggtgtccta

SEQ ID NO: 31297 - DNA, 213 bp, Homo sapiens
  misc_feature 67: m=a or c
cacatcagctgtcggggtggaattgtggtcatatatagcctgtctcacattacagtgagtcagagamtgactgtcccaaacagtattttcttctaggatggaagcggtgtgaagttatcttcaagtctctatccatcaggacagatgcaggaattattttaaaacgtgtatggtaagaatttcagccaatgtagtttaaaataagatgcccat

SEQ ID NO: 31298 - DNA, 78 bp, Homo sapiens
  misc_feature 59: m=a or c
gaagtgcattttacacttacaggatattacaatttggaatagccgcatttccagtgctmagtatttgtgcatggctaa

SEQ ID NO: 31299 - DNA, 64 bp, Homo sapiens
caattggccaagcatttgacctggcatacaggaaatttctagaatcaggaggaaaagatgttga

SEQ ID NO: 31300 - DNA, 279 bp, Homo sapiens
  misc_feature 89: w=a or t
  misc_feature 94: y=c or t
  misc_feature 99: m=a or c
  misc_feature 111: r=a or g
  misc_feature 124: s=g or c
  misc_feature 131: y=c or t
  misc_feature 186: r=a or g
  misc_feature 206: d=a or g or t
  misc_feature 207: d=a or g or t
  misc_feature 208: y=c or t
  misc_feature 243: n=a, g, c or t
  misc_feature 244: n=a, g, c or t
ctaaaaataacgaaaaatgcaaaaaattagctgggtgtggtggcgggtgcctgtgatcccagctacttgggaggctgaggcaggagaawttgcyttgamcctggaagttgraggtggcagtgasccaagaytgcgccactgcactccagcctgggcaacagagcaagactccatctcaaaaaaaartaaataagccgggcacggtddytcacacctgtaatcccagcactttgggaggctganncgggtggatcacaaggtcaagagatcgagaccatc

SEQ ID NO: 31301 - DNA, 123 bp, Homo sapiens
  misc_feature 22: w=a or t
ttcatatagtgagccattatawaccaaggagattggagttagaagtattattaaagttgaatgctgttgttgagttacattattaaaaacagtgaatttaatattgcattacttaatcttttt

SEQ ID NO: 31302 - DNA, 282 bp, Homo sapiens
caattgagcaagcaattcacagaagaaatactagcagagaataaacagaagttatttaacctcagtagtaattggacagctgcaaaccaaaaacaatacgatcccccgcccccattccaattggcaaatatttccaagacaatgtaaacgcgcgcgcgcgcccgggtgagggccgcgcttcgcacctgggactttcctgccaggactcttactttgggatctaaacttttagtttctaggataccagcttactgggtttcagagaacatttggccagcacct

SEQ ID NO: 31303 - DNA, 278 bp, Homo sapiens
  misc_feature 87: m=a or c
  misc_feature 199: n=a, g, c or t
ctgaattctaacagtgctaaattacattcaagtccaggaagatcacctggaattaatggcatttcagttggcaggcatcattcccamccctcgggtcttaggaaaaggaggtagaagccccagaaccacacggcagagatcagcaagttttgtctcaagtcagacaaggtctaggtggccttggccttatgcaaagtgngtgacatatttgattatatttccctttacctccatagtagtcaggccagcagcatggactgcaagaacctaagggagct

SEQ ID NO: 31304 - DNA, 146 bp, Homo sapiens
tggagtgcaggtgcacaatctcagttcactgcaacctcctcctcccgggttcaagtgattcttgtgcctcagcctcccaagtagctgggactacaggcatgtgtcaccatgctcagctaatttttgtattttttgtaaagacaggc

SEQ ID NO: 31305 - DNA, 250 bp, Homo sapiens
  misc_feature 93: y=c or t
ttattattatttggggttacatttaaagtttgaaaacattatcaaaaatgatttcctgctcttcctatctgaatggaacattccctgattttyctctttcataaagaaaaagtcaggcttataattgagcatatttcttggaagttgagaactttgttctccaattattgtggcttaggtgattgatagcaaacattcaaaaacatacaaagataaacaaaaatattcaaagttctacaaggcacaaaat

SEQ ID NO: 31306 - DNA, 234 bp, Homo sapiens
  misc_feature 71: v=a or c or g
  misc_feature 72: n=a, g, c or t
  misc_feature 73: n=a, g, c or t
  misc_feature 78: v=a or c or g
  misc_feature 82: r=a or g
  misc_feature 87: m=a or c
  misc_feature 103: r=a or g
  misc_feature 128: n=a, g, c or t
  misc_feature 146: n=a, g, c or t
  misc_feature 147: k=g or t
  misc_feature 151: r=a or g
  misc_feature 184: k=g or t
  misc_feature 185: k=g or t
  misc_feature 194: r=a or g
catatggaaaaaaattgtcaaaagtactccgggaaagcccttaaatagttggtaaagtacagaacacatgvnngtcavtatrtgtamatacaggatgagctargacagaggggcccttctttcacacnacttaaattagttcccankttarccttgtttgagattgacttctggagagttaaakkccagatagrcttaactctcctaagtcaggtgagactgagagctgactgc

SEQ ID NO: 31307 - DNA, 253 bp, Homo sapiens
  misc_feature 238: r=a or g
catgctaagaatcttttaggaactgattgtcctagtagagatttttaaaaatatttaattcagtctagaagtgaaaaagaaaaatgacacgtttactagttataaagcaaatttatttggctttatgttgttttttttgcttatccatattctaggctgtactcctgctcgcatacagagcaactgtcaactttccttaaactcagcaagccccaaattaaaacctgcaattccttgraattaactccccgca

SEQ ID NO: 31308 - DNA, 248 bp, Homo sapiens
  misc_feature 85: r=a or g
  misc_feature 90: y=c or t
tttgtgatgaagagtgtgactcacctgaatcagtcaaccagcaaacccaagaggagagtcctatagaagttcacactgctgaagrtgttyccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccaaca

SEQ ID NO: 31309 - DNA, 222 bp, Homo sapiens
  misc_feature 31: r=a or g
  misc_feature 34: r=a or g
  misc_feature 37: w=a or t
  misc_feature 41: s=g or c
  misc_feature 60: s=g or c
  misc_feature 83: m=a or c
gtggtcccggctactcgggaggctgagtcarggrgawtggsgtgaacccaggaggcggasttgcagtgagctgagattgtgcmactgcactccagcctggatgacagagcgagactccgtctcaaaaaaaaataaaaataaaaataaaaaataaaaggatagatggctaaatataaaatgtgaacttaaaactatgttacccagtgagagcatcaaatgcaa

SEQ ID NO: 31310 - DNA, 296 bp, Homo sapiens
  misc_feature 80: w=a or t
  misc_feature 169: m=a or c
  misc_feature 250: w=a or t
  misc_feature 251: w=a or t
  misc_feature 253: m=a or c
  misc_feature 266: w=a or t
  misc_feature 270: r=a or g
  misc_feature 274: w=a or t
  misc_feature 275: r=a or g
tatagtagtggtgttcacaatagtcccaaactggaaacccaagtgtccatctccatcggaacagaaaactatactttggwctgcttctacagtggcacatcaacccacctttgagctttagatctaagaagtgtgttcatgcaacagccatagagatggtgctattgamaggcaatctgcccatcctgtgtattgacaagcatcaggattccaggaggattcttcctgattcaaagactgtcaaataggwwamaagaaaacagtawatgracawraacatcaacatggagtccgga

SEQ ID NO: 31311 - DNA, 69 bp, Homo sapiens
  misc_feature 54: s=g or c
gattctgttttctatctatgcaaatttaagtattccaagtaccttatataagtsgatcatacactatcc

SEQ ID NO: 31312 - DNA, 245 bp, Homo sapiens
  misc_feature 196: n=a, g, c or t
  misc_feature 197: n=a, g, c or t
atgcactcttattcaaagtgtagagtttattctcccattcataggaatgcaaaatgagaagttttaaatacacggattcacttcctaaacccagtttctcagaagattaatgaatagtcatcctgttgacccatctgcttctcttcttcacatcgttttgtgcggatgaggcacacacagacacagagttctcacnngcagcagtccggcacatacagcctcacacgcgccacaccagggggtgt

SEQ ID NO: 31313 - DNA, 58 bp, Homo sapiens
tgaatagcttccatactgttttctgtagcagttgcatcatttattttattttatttat

SEQ ID NO: 31314 - DNA, 245 bp, Homo sapiens
agaactcagactggaattcttaacagaaaacacatctatttcctcctgtgaaaatatggcattttatacttaaattcaaacttggttaaatgagctgccccctcatcctctgttgttgggagcaggaagcctggtgtgaaatcgcacttggttaccttcattaccttgatgtgtggtagctgatctaggaatgcagcctgaagaaatcagcacctcctagatacagaatgaacagaagggctccc

SEQ ID NO: 31315 - DNA, 149 bp, Homo sapiens
gagtaccatgacttaaacacaggtaatagcagggttagtggactttatttcattcacttttaaaatacgtaatccattttagttgtgaaaatacaagataattttttaaaatagccataatctaaatttacttttttcttttttttttt

SEQ ID NO: 31316 - DNA, 320 bp, Homo sapiens
  misc_feature 121: k=g or t
  misc_feature 211: n=a, g, c or t
atgtggtttttcaggaaaggacttaggtgaactgaggtttttaccacaggcagtgaatgaccttggttcaccaaatttgcctctgttttgaggggcttggtccagagtgacttgttaattkactctaacttccttgtgtgttgatgggtaagtacactcaaacactgaatacaggtgtgtgatgggtagatttcacagcccttctactacnagtgagtgtgaaggcaagcttgatgcaaaacctcctgacctttcctacctgaagagccctttgacttctaggaagaaaggtcaaaaatgttatcttcagttgtgttaat

SEQ ID NO: 31317 - DNA, 177 bp, Homo sapiens
  misc_feature 71: s=g or c
  misc_feature 84: w=a or t
  misc_feature 103: s=g or c
  misc_feature 174: y=c or t
gtgagatcaagaaaaacctggctgaaactggttggaaccaagatggctaactggagcttgcacagaataascttgctgatgtcwtagcctgaatttccaccasgtttcatactaactctccctgaatttgccatgcaactcaggagttaacatgaagaaataactatgcatgcycaa

SEQ ID NO: 31318 - DNA, 225 bp, Homo sapiens
  misc_feature 85: r=a or g
  misc_feature 95: k=g or t
  misc_feature 117: s=g or c
  misc_feature 160: r=a or g
  misc_feature 187: w=a or t
  misc_feature 200: w=a or t
  misc_feature 210: n=a, g, c or t
  misc_feature 211: w=a or t
  misc_feature 222: m=a or c
ttatttgaaatgataggttgagagagaaaagtcattcaacagtggtgggataaggttccctctctcttttctcttttttttttgrgatgtagtckcactgtcacccaggatggagtscagtggcatgatctcactgcagcctctgcctcccgggttcgarcaattctcgtgcctcagcctcccaagwagctgggactatwggcatgtgcnwccacgcccggmacc

SEQ ID NO: 31319 - DNA, 184 bp, Homo sapiens
ctgtctcaaaaagagaaaattcctcattatctttgccatcactccctgttccctcctctcctagccctgggcaacctagtctcctgtctccaaagattagtctttttatttttttagacagagttttgctcttgttgcccaggctggagtgcaatggcacggtctccgctcatctcaaccacct

SEQ ID NO: 31320 - DNA, 340 bp, Homo sapiens
  misc_feature 61: k=g or t
  misc_feature 96: r=a or g
  misc_feature 161: v=a or c or g
  misc_feature 275: r=a or g
  misc_feature 281: r=a or g
  misc_feature 291: r=a or g
  misc_feature 301: y=c or t
aaagcttggtattttatagtttccttttgtaagaactcaagtttttgttgagttgcatatkttatattttctggaattttggtgtcattttatccrtagttaataatattgtttcaccataaactcctctttgattatgtaaccagcaaagtttctaacavtaaagcatattttaggggtacataccttcctctcagtcaatgtatagaaagtattacattatgtattaaaacctcagtgccatgacaagatagtcaacatctttagtcatcagraaaatrcaaatcatarctacaattgygtgtgtgtacttatcaattgtgtactttatatatatgta

SEQ ID NO: 31321 - DNA, 284 bp, Homo sapiens
  misc_feature 114: v=a or c or g
  misc_feature 215: w=a or t
  misc_feature 216: d=a or g or t
acagcattatttataatagccaaaagtgcaaataacccaaatgtcatcagctgatgacagcataaatataatgtggtatacatacaatggaatattattctgctatgaaaatgvaatgaaatactgatacatgctccaacacaggatgaaccttgaacatatgctatgtgaaagaagccagatgcagaaggccacatattctaagattctagatwdagtatccagagcaggtaaaaacagaggcgggaaagtgtatgttgcctggaagctggaaggagggtaga

SEQ ID NO: 31322 - DNA, 155 bp, Homo sapiens
cattctagcctggatttctccccactggaggtggagggtgggaagagaagggagtcagctctgacagcttacaaactgggaagttctgtgcatctccagggattccagagttgaagatctggttgttggaagctgggcgcccagtgctttttttt

SEQ ID NO: 31323 - DNA, 283 bp, Homo sapiens
  misc_feature 210: d=a or g or t
actctatgcctgaataggaacagaaagatctggcctgtcactgtgtgggtgtatgctgtggaaggcctccccccagggggattcatcccagcaatttgtttatcccaataaagtttgtagacctgttaacctaggaactccctacatgtcaattagaggagccatgaaaacctctcgcatcgcagggagggttggttagaagtgtcagtdcagggaaccggaaattgcttggctcagctgacacaaaagaggatctgaagggtgcgggcagagagcaggcagt

SEQ ID NO: 31324 - DNA, 329 bp, Homo sapiens
  misc_feature 224: y=c or t
attcattcctctcgtggaagtgagtgagtcctgggatcccgcgacctgttttaacttttatggtttggtcgtaggatcagcagggctcgcacttcggtcagcaggaaaagacgctgcggcgagcagcggagggcggagttgaatggctgggcagctgattgccttactgtatccggagctgctgcgttcggggcggttcgggagtcccctggttggaagtggayctgaatggggaggcgtctgaggatctcctgggctctcagcggcccgacccgccttcccccacctcccacagctctgtcgcttcctagcggtgtaacgttgggaaa

SEQ ID NO: 31325 - DNA, 304 bp, Homo sapiens
  misc_feature 261: k=g or t
  misc_feature 274: d=a or g or t
caactttgatctcatttgagccactctatttttttgatctctaacttagagcagcttagcatataacttggagttggggaaagtgtagtctgctccaatcagataatttaggaccttgtagactgcagtaaggattctggactttgtcttaagggtaatgggtttttgctgtatttctaggtgttgtgtattatgtttatccaagaatgaactgtagatcagaactgagttgctttgtcagtgcagtggtccaatcatggktcattgcagcctdcaacttctgggctcaagcaatcctcctgct

SEQ ID NO: 31326 - DNA, 77 bp, Homo sapiens
aaaaaagttttttcagaggaaaatgcagggtttgtccttcaccctgacgtcagatcttgctttaataaaacccccca

SEQ ID NO: 31327 - DNA, 304 bp, Homo sapiens
  misc_feature 87: h=a or c or t
  misc_feature 93: r=a or g
tagatcccaggtgattcctaatatgcagatgaatttgagaaccactgaaacaagcccttatttgaatttggatctcctaataaagahaattaraagtgactcccagtgcagatcctacctggatacatttttattagtttggtttagagatctctttatcgacttatttgtagtccagatttatgagggtgataattcattctccattccctttaacaggtctctcatctcctattttccttccttagagttggtggagacataacgaattagagtgctttaaacattctcccaggaagccctt

SEQ ID NO: 31328 - DNA, 90 bp, Homo sapiens
ctcttgttccccttttccagcttcccttggactactgccccaatggccccttggactcgcgtttcatgtatgcgagcacacacacacaca

SEQ ID NO: 31329 - DNA, 304 bp, Homo sapiens
  misc_feature 271: r=a or g
ttttataaaattacttttaggccatgtatataaggtagatgtgaaacataaatgaatttcatatttaaacttgggcaccatccccaagatataaatgtatgtgcaaatattccaaaatcccaaaatacccgaaatctggtcccaagcagtttgggtaaaggatactctcaacctgtgtaaggttgtgagacatagcaacaaaaggctatgtgataaagaaacaggaaatgacattgcataatgattcatggctgtggtgatgtttgaaggrtaaaaatcatgattgttccagtttgaaaacaga

SEQ ID NO: 31330 - DNA, 242 bp, Homo sapiens
tgagattgcactagggggacgttgctaaactattagaaactactcccatgatccagtcacctaccaccaggccccacgtccaaaattgtacaattcaacatgagatttgggtagggacacagagccaaactatctcaacctggcttccaaataacatggaccagttattcatagcctgatgagttatatatttaccatttattgtgaacaacaaatacctttctagatgttgtaatggacac

SEQ ID NO: 31331 - DNA, 123 bp, Homo sapiens
caccatgccacattcatttatccattgtctgtggttgttttcatactgcattgccagactagaatagttgccacagagactatatggcccatcagagctgaaaatatttaccatctggccctc

SEQ ID NO: 31332 - DNA, 305 bp, Homo sapiens
  misc_feature 292: r=a or g
caaaaaatgtaaaaatattccatgtttatgaattggaagaatcaatattgttaaattgtccatactacccaaagcaatctacagattcaatgcaatccctgtcaaaataccaatgacattcttcatagaaatagaaaaaaaatactaaaatttatatggaactacaagatctaaaatagccaaagttatcctaagcaaaaagaacaaaactagaggaatcacattacctgacttcaaattatatactacagagctatagttaccaaaacagcatagtactagcataaacagrcacatagaccaat

SEQ ID NO: 31333 - DNA, 306 bp, Homo sapiens
  misc_feature 295: n=a, g, c or t
caaatgagtaacagccgcagggtgtggtatgtgtcttcccttttggttgtgcatctaaattgcccttgaagtataatgaatcccatggttctcaccaccatggaaggtattttcctaatttaatggaataattattttgttgttactggctttaagtgtgtgtctcgttttaggtgctcagtttgtgttgactgaaagaagaaaaacagaacacttagctacttaaagtttcaaaattcaactgttttagggcagacaattagtctgttagacaaactggagcactgattgcctntgggggaaggg

SEQ ID NO: 31334 - DNA, 196 bp, Homo sapiens
  misc_feature 93: k=g or t
  misc_feature 95: r=a or g
  misc_feature 96: w=a or t
  misc_feature 108: k=g or t
  misc_feature 109: w=a or t
  misc_feature 113: k=g or t
  misc_feature 177: k=g or t
atagggtgaaagatagggatctagtttttttctctccttatctagaagcatctctccttatctagaaagcatttatttagtgtctcaagtatktrwttagtagtcatkwattkccacattgatttgtaatactacctctttcctatgccgtatttccatgtatgcatggattttgtktgtgtgtgtgtgtgtgtgt

SEQ ID NO: 31335 - DNA, 307 bp, Homo sapiens
  misc_feature 86: m=a or c
  misc_feature 106: r=a or g
  misc_feature 113: m=a or c
  misc_feature 128: m=a or c
  misc_feature 155: r=a or g
  misc_feature 203: r=a or g
  misc_feature 290: d=a or g or t
gttttcatttatctgcaacatttcttaaggcttatttgcatgtgggtaaaattcaggctacaataatagtcaaggaagtatatttmtcttgttctgctcccatacraaatggmgcccccccgcaagcmtcttctgaattattcctggacacccarataaaaatggtaatttttctttccttttctcctggattcttattctarcatctgctaggaggatccacaccctgtcctaggctagtagtgtacagaccatggttttgatgtctgtgcaaaaggtacaggtttgtdtgcatctcttcaatttt

SEQ ID NO: 31336 - DNA, 155 bp, Homo sapiens
  misc_feature 100: n=a, g, c or t
atacagatgaatttctcttcatctctgtgttataactttggcatcaagtaatgtttttcatcatttaattttcttctttgaacttcagtataaaattganaaacaaatcttaaagacacagaaattgaacctgtccatttggcatcgggatacat

SEQ ID NO: 31337 - DNA, 355 bp, Homo sapiens
  misc_feature 100: r=a or g
  misc_feature 187: n=a, g, c or t
  misc_feature 268: r=a or g
  misc_feature 329: b=c or g or t
ttgatacagtcagttgacttagtttacatgcacatgtttgtgtatgtttgtgtgtgtgagagacagagtgtgctgtgttctgtgtagctcacatctgtgrccaccaccacagtcaagtccagaacagtttcattatcaggatcccttgcgttatccatatatagcctcagccacctcccttcccctncccattgtcctaatctctagcaaccactaatctgttctctctctttgtaattatgtcatttaagaatattttataaatggratttgccaggtgtggaggcttatgcctgtaatcccagcactttggaaggccgaagtgagabgacagcttgagcccaggagttcgaga

SEQ ID NO: 31338 - DNA, 148 bp, Homo sapiens
  misc_feature 61: s=g or c
  misc_feature 78: m=a or c
  misc_feature 121: k=g or t
attttaatgtagaaaaattttactttttcaaatatgcatacaatttttaaaacagtagaascaaattcattttaatgmccatgtaaagagcgaatgtcatagtattattacccagtttatkcaaattacatacatgttcctaccaagt

SEQ ID NO: 31339 - DNA, 64 bp, Homo sapiens
  misc_feature 3: r=a or g
  misc_feature 15: k=g or t
ttraaatggtgcgtkggtggtcatacttagtgttctaggctgtgaagatcatggagttcttcca

SEQ ID NO: 31340 - DNA, 309 bp, Homo sapiens
  misc_feature 220: r=a or g
  misc_feature 225: h=a or c or t
  misc_feature 228: k=g or t
  misc_feature 306: m=a or c
taagatgtggcttggctttaaaactcagtgaactatctttatggtacagttggtttccatagctgtaaacacaaaagatctatggtttctgcctacccaggatagtcttgtctctagacaatgtattgatgatgcaaatgttctggaactaaatagtggtgatggtggcacaacactgtgaatgtactaaatgtcactgatttgtacgtatttaatatgrattahatkttaaaatggtgaattatatttatgtatattttaccataataaaaatatgcattggaagatgcattttttgtgacccamtca

SEQ ID NO: 31341 - DNA, 155 bp, Homo sapiens
  misc_feature 96: k=g or t
gtttttgatgttttctgtttgttttgttttttaaaatagcagtttacaaccagaattagaacaatcttaattctacgtttaacttcttgaaaatcktagtacttttttctgcggcctttggtttgtggctgaaagctgttgagtgactctcgccc

SEQ ID NO: 31342 - DNA, 89 bp, Homo sapiens
tgaaaatctaccaggggataaaaatgcccaagaatatcttgtggaacaatttaaaatttttagcttatattggtcatttctacacttgc

SEQ ID NO: 31343 - DNA, 78 bp, Homo sapiens
  misc_feature 19: y=c or t
ttttatgtatgtctatcaycttaaacatttaactttcctttatgctgggaatattcaaattactctcttctagctatt

SEQ ID NO: 31344 - DNA, 306 bp, Homo sapiens
  misc_feature 130: w=a or t
  misc_feature 131: h=a or c or t
  misc_feature 133: n=a, g, c or t
  misc_feature 237: m=a or c
  misc_feature 240: s=g or c
  misc_feature 241: y=c or t
  misc_feature 248: m=a or c
  misc_feature 268: m=a or c
cataattatgtgaagtgttttaagaactttgttcaaggtgctatgagaacccagaaaaggaaatgtcaaagctaggatactagttcaaaaaggctagtctaaattgattccttagaggttaagtgaagtwhtntgctaggtggacaagaggctggacatatacaagaacattaggtgttttgggaactctctgagtaggtgtgattatctgcaatatacatgatggttcatgggggmgasyggtgtamggagatggctagaggaatgmtcatgaaatgcccttatatatcatgctaaggagtttta

SEQ ID NO: 31345 - DNA, 345 bp, Homo sapiens
  misc_feature 312: n=a, g, c or t
ttacctactaaaatgaagtgtgaaatattggaatggagttgggggattatttaaacagttccctgccaaatgactgccattggatgccctgattgattaaggatccaggctgggcgcagtggctcgtgcctgtaatctcagcactttgggaggccaagctgggtggatcaccggaggtcgggagttcgagaccagcctggccaacatgatgaaatcccatctctactaaaaatacaagagttagctgggtgtggtggtgcacacctgtagtcctggctactcgggaggctggggcaggagaatcacgtgaanccgggagacagaggttgcagtgagccgggatca

SEQ ID NO: 31346 - DNA, 337 bp, Homo sapiens
  misc_feature 321: r=a or g
cacatttatgtctatggtttggtgaaaactccttaaattctttgtgctctttagagaagttgtggatctgttagatgtgaattattttgtgttctcgtagttgtgaaacgcagagaagagtttaggtgtcagaaattcaggaaagtggataaattttattgtgccaacaaatcttaccttgactagtttcacaattttgcctcaagtgtactttgctacttttgatattgccttgttctgtaacttaacagttaaattgggtgctaatagaaaattaaaaagtgtttgcaaccattggaacaatgcaaaaatagattaagraaaattaatggtgtaa

SEQ ID NO: 31347 - DNA, 114 bp, Homo sapiens
tttgtttctgttaatagggttttgtggttgtctttgactttatgccatattttccaattaatcaaaaagttcaccatagttgcaatcgcagatttgtatttttcttctgatcta

SEQ ID NO: 31348 - DNA, 183 bp, Homo sapiens
ctcagctcactgcaacctccgcctcccgggttcaagcatttctcctgccccagcctcccgaatagctggaattacaggcgcctgctaccacgcccggctaattttttgtaattttagcagagacgggtttcaccatgttggcaagctggtctcgaactcctgacctcaggtgatccacccact

SEQ ID NO: 31349 - DNA, 104 bp, Homo sapiens
  misc_feature 103: r=a or g
agcatgtgcgggagactcacgttgccggcgaagtgggagagagaaaagtggtaacctggggctgggggccggcgcggcggagctcggagtagtaggatcggarc

SEQ ID NO: 31350 - DNA, 98 bp, Homo sapiens
attactttcattaagatcatcgctgtgctcttactttccaaatctagtgagtattctcttttcagtcctgtgacagactctgctacttgcctacccaa

SEQ ID NO: 31351 - DNA, 263 bp, Homo sapiens
aggttcagatacgattccaagctgtctggcaagaaagtcaaaatggaaaatgtgctcttactactcctagggggaaacattgttccttgcatgacttctgaaaggactatgatgaaaatgcaaatcaaccaacactgagtatttacaatcaagacgttgactctggtaggagctgcaattgatagaaagatgtataaaataggaattattaccaacgaagaggagaatatggcccaatacccataatgtctatacccggactc

SEQ ID NO: 31352 - DNA, 272 bp, Homo sapiens
  misc_feature 191: s=g or c
ttcccgtccgaacgccccgagtctcactttgccgcgccccctccctgcgccccgctgccgcgtctttgcttgcaacctgacctcacctttcctcgctaagcggtttgagatcctcaagtgtaaacaggactctccctggaggctgctcctccgggcccctccccgcggcccgaccgtcgctcgcttctctscccggacggcggccgcctctgttttctcgttccctcccctcagctggctttcagctttcttttctcttcatcgtccccttc

SEQ ID NO: 31353 - DNA, 246 bp, Homo sapiens
  misc_feature 72: w=a or t
  misc_feature 83: w=a or t
  misc_feature 88: k=g or t
  misc_feature 98: s=g or c
  misc_feature 104: s=g or c
  misc_feature 112: r=a or g
  misc_feature 122: k=g or t
  misc_feature 142: w=a or t
  misc_feature 157: v=a or c or g
  misc_feature 159: m=a or c
  misc_feature 177: w=a or t
  misc_feature 210: m=a or c
atggaggtgacagaaagaaagaaattctttgtttgagggagacttcccctttctggattgtatttgtagagwgttacgagtgwatcakgtgattatgstttacsggtataaragattctgtkgtgattatttgaatagtttwatattaataaaagavgmcaaaattttttaaatgtwagaaaaagcagatctgtcattgcaaagtaacamaaattttaagcttttaaaaatgtagatttttcatat

SEQ ID NO: 31354 - DNA, 189 bp, Homo sapiens
  misc_feature 35: r=a or g
  misc_feature 42: h=a or c or t
  misc_feature 96: w=a or t
  misc_feature 100: n=a, g, c or t
caaattcttttaacagatacactgttgtctggtgrgtgtgthcagtttttatgcaaatgtatgagagtataagagggattgatttgatggaaaggwgttnagacagtttctatttagcaaataaaatcatggaacaattctttcagtcaaaggtggtggtgttttcagagcatctgaattttagaagtc

SEQ ID NO: 31355 - DNA, 201 bp, Homo sapiens
  misc_feature 151: m=a or c
atctggcccaggtgaggaattttaaattggaacaagagcaagaaaaaaacaaaatcttgtcagaagcactggagacgctggccactgaacatcatgaattagagcagtctctggtgaaaggctctccacccgccagcatccttagcgaggmcgagttctatgatgcgctgtcagattccgagtccgaaaggtccctgagta

SEQ ID NO: 31356 - DNA, 154 bp, Homo sapiens
tggatcattctggtatggatcattctgataaataggtaggggagccgaacagtgtttagtaaaaagagttaccaagtgacacaaggtgacgtctgagatttgaacatgtaaatttataacagcacctatttgtggttctgttgatttttttttc

SEQ ID NO: 31357 - DNA, 232 bp, Homo sapiens
  misc_feature 186: s=g or c
ccttgaacaatgtagagattgaaaacctatgtataacttttgacttcccaaaacttaacctgaagccttactgataacagttatttgtattatatgtattatatactgtattcttacaataaagtatgctagaggaaaaaaaaaagttaagaaatatcataaggaggccgggcacggtggttcttscctgtaatcccacattttggaaggccaaggcaggtagatcacttga

SEQ ID NO: 31358 - DNA, 147 bp, Homo sapiens
tatctttatgagacgatctcactctgtcaccaggttggagtacagtggtacaatcacaactcaccgtagcctcaaactcctgggctcaagtgattttcccacctcaggcacccaaatagctggaactacaggcatataccaccacac

SEQ ID NO: 31359 - DNA, 133 bp, Homo sapiens
  misc_feature 103: r=a or g
  misc_feature 105: r=a or g
  misc_feature 114: w=a or t
gatattttacccaaaagtctgttgaaataaaaaaaaggagtattttagtgactgcagaaagttatcttggacagtgctggtttagaagcccataagacagagrgrctatagtawgttaatgaattatttatat

SEQ ID NO: 31360 - DNA, 232 bp, Homo sapiens
  misc_feature 44: m=a or c
  misc_feature 46: r=a or g
  misc_feature 53: r=a or g
  misc_feature 55: r=a or g
  misc_feature 104: y=c or t
  misc_feature 105: y=c or t
  misc_feature 109: y=c or t
  misc_feature 113: s=g or c
  misc_feature 162: r=a or g
  misc_feature 163: h=a or c or t
cttccctgtccctgcttgggcaggaggcccaagccctgacaacmaraggtgararaggctgtgccagcccttctctgggcgtgtctgggctcaagggccaaggyyctgyctcsagtctagggccaagctggggcctgtggcaggatcagatagagatgcagrhactgaggctcagaagcgttcggccacgtgcatgcattgcctttcccattggtgctccatcgccagtaat

SEQ ID NO: 31361 - DNA, 294 bp, Homo sapiens
  misc_feature 98: m=a or c
agtcgccgcgcgaacatggcggccgaaatccactccaggccgcagagcagccgcccggtgctgctgagcaagatcgaggggcaccaggacgccgtcamgggccgcgctgctcatccccaaggaggacggcgtgatcacggccagcgaggacagaaccatccgggtatggctgaaaagagacagtggtcaatactggcccagcatttaccacacaatggcctctccttgctctgctatggcttaccatcatgacagcagacggatatttgtgggccaggataatggagctgtaat

SEQ ID NO: 31362 - DNA, 92 bp, Homo sapiens
ctcaggaatttgagctggggatctgcatcctggccattgcagtcctttagcatcctcgccgcgccctgagcggctggaggctcgcaggctgc

SEQ ID NO: 31363 - DNA, 248 bp, Homo sapiens
  misc_feature 74: b=c or g or t
  misc_feature 88: r=a or g
  misc_feature 94: r=a or g
  misc_feature 107: d=a or g or t
  misc_feature 113: m=a or c
tacatgtaaaacctcaaactataaaaaccctggaagacaacctagggcaataccatcctgcacttaggaatggbcaaaaattttatgrcaaagrcaccaaaaagcgdtcacamcaaaagcaaaaattgacaagtgggatttaactaaacgtaagagcttctgcagagccaaagaacctatcaacagagtaaacagcctacagaatgggagaaatatttgcaaactatgcatcagacaaagatctatta

SEQ ID NO: 31364 - DNA, 251 bp, Homo sapiens
  misc_feature 91: k=g or t
  misc_feature 113: m=a or c
  misc_feature 180: k=g or t
  misc_feature 190: n=a, g, c or t
  misc_feature 238: r=a or g
aatttaaaatattaaaagctttgtagtcatctgttgaatggaaagctctgtaatgaaaagcataatcttggatttaaatatgaggcctgckgcatgttaattaatcctatgcmattgagtgagaaggaagatggtgacaccttagggggaagtattatttgttcattaaatctgccactkaatgactagnttttagcaagttacttagtctgttcctcagtttcctcaggtgtaaaarcagggatgattaa

SEQ ID NO: 31365 - DNA, 299 bp, Homo sapiens
  misc_feature 106: m=a or c
aggacaagacgtatcgggtggggaggcattaaaagaacaagtttccaatgcagactggtgtttggggtcagaggtgtgttaaagggcaaatagggaagggaatgamgtgggtttccaagcagagagttccaggcctaatgggggtgggcagacaaaagatgagatgtgttaagtgggaagttaaatggcaagtactagaatgccactatggcaagcactagaatggtctaggtgtgaaatgagggagtaatgtcagggagtcaaggtggccatccatagcagtgattcttatctggggt

SEQ ID NO: 31366 - DNA, 242 bp, Homo sapiens
  misc_feature 108: w=a or t
aacttaagtatgacaaaagacactgaatattagagggccagccacagacgtggaaggtacttaccttgcaattatctaccaggaactgacaaaggaagtgtcccaaawttacataaaggactacttaaggggggaataaatgagtgatatatgagagagaaccaaaaggtcaattaacagaaaaatgttttagctcactaggagtcaaggaaatgccagtcagcacagttagataccatttc

SEQ ID NO: 31367 - DNA, 249 bp, Homo sapiens
  misc_feature 95: s=g or c
taatgggatattattcgactgtagaaagagatcaagtactgatacatgctagaacatgggtgaaccttgaaaatattatgcaaagtaaaggcagscagacacaaaagactacctagtgtatgattccattgatacgtaatatccagaacaagtaaatccttagagacagaaagtagatagtggttgtcggggactaggaatggggagggaaagaggaatggctgcttagtgagatggggtgaggggcga

SEQ ID NO: 31368 - DNA, 243 bp, Homo sapiens
ttgtttttcctgtcatttgttggaagcttcttgagttctgttattagcattcagggaattgatacccatcaacttgaatggaaaatcgtttgtaggtattacttaagtgaatgttaagagttccaccctgagtggtaatctaaggctgtgcagtcagttacttcagactgctcagaatagttcattagaaaggtaacaaatgagaaatgtattattatacagttctatagtagtgaagtgata

SEQ ID NO: 31369 - DNA, 287 bp, Homo sapiens
  misc_feature 161: s=g or c
  misc_feature 172: r=a or g
  misc_feature 208: r=a or g
tcacttaaggagaaatgtaatttccaccatcatttcttagaactgaagaagatactaagcaatttgacttacagtcaaccaagagggggtggggttgccttaagacactttattttgtgaataatctagaaattatgttaatgtaacttataggaaaagasattctgaatgrtgatatctttgaattgtgatttttctatcagcctgratgccaagtttactaaacaagttctcactaaaaagacaaaacatgtaaaggaagataatcttgtattctatagcattca

SEQ ID NO: 31370 - DNA, 254 bp, Homo sapiens
  misc_feature 68: s=g or c
  misc_feature 175: h=a or c or t
  misc_feature 194: s=g or c
cttgtggccgaaggctgggactggccatgagattacatgtcctagcatgctcagccaggcgcgcgcastctgccccttcctccagtgatgcgcacagtccctgatccctgtgcacgctgggattgtagtcctgcagccctgcgatcacttgcaggtaacaagaaatttcagctthcggcatgatgggcgaaggsccccaccttcagcctcgctcctccatgccttcagagctgttccgccatggcagacgggga

SEQ ID NO: 31371 - DNA, 321 bp, Homo sapiens
  misc_feature 92: r=a or g
  misc_feature 98: r=a or g
  misc_feature 100: w=a or t
  misc_feature 136: h=a or c or t
  misc_feature 137: r=a or g
  misc_feature 148: w=a or t
  misc_feature 195: r=a or g
  misc_feature 216: w=a or t
  misc_feature 217: k=g or t
  misc_feature 283: r=a or g
  misc_feature 284: r=a or g
  misc_feature 286: v=a or c or g
  misc_feature 287: n=a, g, c or t
  misc_feature 294: r=a or g
taatataatttatcatattactaggtgagggagatacagtttcttgatgtattctagaaagacattttattacatccaggctacattcttgrtttaarawcaaagtttactaaattccaagcagtataatatttthrtaacaaaatawagaacatctatttgaaatttagtggccaccatagattgaacagtagracaataaaacatttattttcwktgacaacaggaattgggtgaagatgcttctcaccaacactttagaagttctataaaataaatgtarravnaagaatraattacattataatgagccatgcatgt

SEQ ID NO: 31372 - DNA, 358 bp, Homo sapiens
  misc_feature 98: y=c or t
  misc_feature 99: k=g or t
  misc_feature 110: y=c or t
tataataaagtattccatttctttatctttgacagcttgttaagttcttgaataagttagttagtgaaaagtccataatttcaaaggtaaatttaacykgaataaatgtyactcaggaactcttagagaatggttgggtgcagcggttcacctcggtggtcccagcacttcgggaggccaaggcagacggatcacctgagtccaggagttcgaaaccagcctggccaacatggcaaaaccctgtctctattgaaaatacaaaaaaagtagccagctgtggtggcacacagctgtagtcctagctacttgggaggctgaggctgcagtgagaggagattgggccacaccactccccgct

SEQ ID NO: 31373 - DNA, 73 bp, Homo sapiens
  misc_feature 20: y=c or t
acttcggggccgctcctgcyccctggggatactctgggctcaggcggatgtccactctggtacccccgggtgc

SEQ ID NO: 31374 - DNA, 201 bp, Homo sapiens
  misc_feature 90: y=c or t
  misc_feature 98: m=a or c
  misc_feature 103: k=g or t
  misc_feature 106: w=a or t
tatggttcagtttatgcccctgacaagtttccattgtgttttgccgatcttctggctaatcgtggtatcctccatgttattagtaattcyggaatccmatttkgtwaacgcctggtagatgtaacctgctaggaggctaactttatacttatttaaaagctcttattttgtggtcattaaaatggcaatttatgtgcagca

SEQ ID NO: 31375 - DNA, 53 bp, Homo sapiens
gcatatcctatatagaatctattacagagctacgttatctccacaccttttga

SEQ ID NO: 31376 - DNA, 335 bp, Homo sapiens
  misc_feature 96: k=g or t
cacctttacatcctcaggtacatgggcctgtaattcattaggtggtattaatttggtggcagggagtcggggtgggatgagggatatgtagctcgkttgttttgtagacttgcttttgctcacctttcttcaaatgcaaatccaaaatttcctgtgggcacacttaaagatttatctcttgtttcatgaagctccatttaattaagctgaagatctgtttttttaaatacagtagttagtatgtattgaggattcactttgtacttaggcatccagcgctaaatctttctattaacgctacaggatagatgatagatccattttgcatgtgagga

SEQ ID NO: 31377 - DNA, 228 bp, Homo sapiens
  misc_feature 96: w=a or t
  misc_feature 154: d=a or g or t
tatgaagaaatccagtgtcagtcagaccatgtaacatcaaagcaaaatttcattgaagcctatccttgtcttaattattctaaaataaagtaccawtaaagtgaattattttgccctttgtagtagcatagtgttaagttatatatatattttdatatgcatactcctaagtaaagtttcagagaccacatgctggagagcagtggctttcagacagcatcagcatca

SEQ ID NO: 31378 - DNA, 238 bp, Homo sapiens
  misc_feature 91: w=a or t
  misc_feature 94: r=a or g
ataaatatgataagaaaatctactttagaataaaactcatcttcttaaaaagaatgcatgtgagaaatcttaatatactataatgtcttawtargctagtgaagtaactgctgatagaatctgtcttccagagctgcgtgtccacatattctaaataatatgtcttcctaaatagaagataaaagatgaaatttatagggtccagaagggagcagagttctgcctgcatttttgacta

SEQ ID NO: 31379 - DNA, 298 bp, Homo sapiens
  misc_feature 99: m=a or c
ctttgaccgttgtctgcctctcttttcctcagtcttgcccaattctaatacttaagtctgagtgaatttaaatcaactatttagaaattagggtaaaamcagaagcaaatacattgtatccagagaagaagatatgttttgaagttaaaagtgatttaaaaaattacaacacaacaaaataaatatgaaagaagcacttgattcctcagcaggtgaagtcatcagaccatgttactggaccaaggttatctaggtagtgccaggctgggattaaaagataaatttactcacatacact

SEQ ID NO: 31380 - DNA, 371 bp, Homo sapiens
  misc_feature 101: k=g or t
  misc_feature 320: v=a or c or g
  misc_feature 321: h=a or c or t
aaataatgcgacgatatggagaacagcctgctagctatgtttcatgaatcacgtatcctgcatttgtgggctgccttgttcttgttgagttgttgcaagakgtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgavhaggattaaagctggtattctagaacatgcccttcactggttgtgtaaata

SEQ ID NO: 31381 - DNA, 252 bp, Homo sapiens
tacagtgatttgagaaggccataatgtggcatatttattttatatccctgaatgctgccattcctgtataccaggccctgggtttaatcctccatcaatctcatgatatgttgggggtattacccccattttacagatgaggaaagtgagacccagagaggttatgtcacttgcccaaagtcacccagtgaagggatagatacaagctcaaatggtctggtttcagaattaaattttttttttttttttttt

SEQ ID NO: 31382 - DNA, 409 bp, Homo sapiens
aagacagtccctgccattgctatttacaatctacaatagataatatataaacaagacatattattttagtagacagatgcatccagatacactttaaacaaacaagagtacagcaattaatgtgcatatgaaatccgtaagataaatcagctattgtagcacgtgaaggaaattaatacaaattaaggaattggaactgatttgggccatattcgactgttttcatattaagaaacattattttagaagatctgtttggctgcagcggagtcaggaactgggcaagcagtgttgtgacttgcttgttccacaggcagagcctgggcagcactcaataacacccctcaccttcataggccatcagccgtagagaggcaaattagagcactggcataagccacaaatcaca

SEQ ID NO: 31383 - DNA, 73 bp, Homo sapiens
tcccttactgtacttcctccttttctgcgtctctaccaatatattttatcactacatttcttttttttttttt

SEQ ID NO: 31384 - DNA, 78 bp, Homo sapiens
  misc_feature 2: b=c or g or t
  misc_feature 34: k=g or t
abaagttcagaagttgatctcatagaaactttgkttagttgctactcattttgccctttgctaatttgtcattgcatt

SEQ ID NO: 31385 - DNA, 178 bp, Homo sapiens
  misc_feature 116: w=a or t
acatcttctattagcttgttcacaaacacctcaaacttcataggtccagaactgaagcctctccctcccaacctccctatgtaccgtacattcagtgctcaaggcagaacttggawataattcttgatttttttcctttctcttaacctgtcagtaaattctatagattcagtcccct

SEQ ID NO: 31386 - DNA, 370 bp, Homo sapiens
tatacccataatagtggtttttaaccaaaggtgactgtatcttcccagggcacatttgttaatgtctgcaaacattttctattattatgacttagggggaggggtacaattagatctggagaatagaggctaaggatgctgctaagcatcctacaacacagaggaaagactcctgaaataaagaattatctgactcaaaatgtatcgactgtgggtcaggaaaccctggtctacatattagaaaaaaaatgcacttttttcttttaaagttattaaaatattcagatatactttttgcaggaaacttttgaagccagaaatctttaacaactatttttcaaaataggagaaattaggtcgttatcaatat

SEQ ID NO: 31387 - DNA, 319 bp, Homo sapiens
actgagtgagaaagaacattaaatccattgtactgaggatatggtatggataattaaaggagttagttggtgccttagtcttaatcttagtgcctgttgaaagcacctagtgtgttcagtgaatggtattctgtttgtaattcaaccattcatagcagtgttgttcatttgggactctgctggcatttaggacctattctttgtcaagtgagactgtacctcaaattgcaggatgctccgcattcctctctctgcttattaaatgacaatagcatcttctcagtcattgagagacttgtgacaaccaaaagacaaccct

SEQ ID NO: 31388 - DNA, 173 bp, Homo sapiens
  misc_feature 84: r=a or g
  misc_feature 94: k=g or t
  misc_feature 106: r=a or g
  misc_feature 123: r=a or g
caaccagagtttggctaaaatggtttaattagaaatgacagcttttagactggatgtacgtgaaccccaagcagcagagagccrggtttacttkactcctcccttraagcttttcagatgtaraaaatcagtacacattaacatgttactgaaatgtcagagtacccaaaaat

SEQ ID NO: 31389 - DNA, 70 bp, Homo sapiens
  misc_feature 26: y=c or t
ttattaattaaggggatctcttagcygtctctttgaccctacaaaaaacatggtggtactgagtttttta

SEQ ID NO: 31390 - DNA, 65 bp, Homo sapiens
  misc_feature 9: s=g or c
  misc_feature 11: k=g or t
  misc_feature 14: s=g or c
  misc_feature 24: y=c or t
  misc_feature 44: s=g or c
  misc_feature 52: v=a or c or g
gttcaaagsakaasatagatcacyaggtaagcttcttataaatstggatctvaccagttttggaa

SEQ ID NO: 31391 - DNA, 51 bp, Homo sapiens
  misc_feature 32: d=a or g or t
  misc_feature 49: k=g or t
tacagaactcttttggcataaatatttgtgtdcccagtacctcacttgktc

SEQ ID NO: 31392 - DNA, 167 bp, Homo sapiens
atttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctgggcat

SEQ ID NO: 31393 - DNA, 404 bp, Homo sapiens
  misc_feature 140: k=g or t
aatgtagctgattttggtaggggtttcaaatatacttttctatgctgaatggcaatctgaaatactgaagatactgaatggagctgacatgcaaacataggcacatgtttggaaggctggcagagtgtgttatcaatatkgcttaaagtgctagtctagaccaaacagaagtgcctcaaaatagtggtagtgcccaactgtcattccatatgtcagtaggatttgtcctgaagatattgcagctgacttcttggccagtactctcagtatcatgtggtaataatggaaggataagattactaacaaaagatcccaggctataatgagtccactaacattaaatggatgctttctgcaatgtacctcccatctcaagctgacatgtatggaaatgaacaattgca

SEQ ID NO: 31394 - DNA, 157 bp, Homo sapiens
ttcttgatcctgaactgggttaggtgccgctgttgctgctcgtgttgaatctagaaccgtagccagacatgggactggaggacgagcaaaagatgcttaccgaatccggagatcctgaggaggaggaagaggaagaggaggaattagtggagccccc

SEQ ID NO: 31395 - DNA, 406 bp, Homo sapiens
  misc_feature 144: r=a or g
  misc_feature 344: m=a or c
  misc_feature 403: m=a or c
ttctgttcactgcctctcaatttttttgcataattgttaaaacttaatgtttaggtctagagtgaaatcataaaaaataaaggctcatcaaatcaactcataaatatctgagtagatttttcactgggctttgtaatcttatarctccatcctcacatttctagtggctctctcgacctttcctttcattacatcccaaactgtaatcatttccagcagcatgtcccgtgttctgtgttactgtgtcctgttaattaactctgccatgtgagtcattcaagctggaaacattgcaattacatatgatctctccctttcccttcacatttaatccacacttttamcaactcctgccaactcttctactacaccatttcccttccctttatctgtctaatcccamcaa

SEQ ID NO: 31396 - DNA, 427 bp, Homo sapiens
  misc_feature 136: s=g or c
  misc_feature 239: w=a or t
  misc_feature 396: r=a or g
  misc_feature 408: m=a or c
gaaaattttttcagaaattaagattctgggttatctgtgcatttcatttatacatgcttttctaatattgtccctcttgtgcagacaacccaagatcttattgcaggtgagtagagaatagatttgtttcagccascatgctaagaagccttgctgtgctcagcagtctatagagtgaaaatggagactcacatggaacgcacatgccagggaccgggcactaataggtaagctgatcwattcctcacagccatcctctgaaggaggatatacctctatgatcctcgttttatagatgaggaagccaggcacagagcaggtgacccacttgcccaaggtcacccagctcatgagtagtagagctgggatttgaactcagcaatctaatttcagggrcagtgcttgaamcgtcttttcttttctttct

SEQ ID NO: 31397 - DNA, 190 bp, Homo sapiens
atatccgggttcaggtagcaccaaggagcagctgctcatctcaaatgaagacgctggaggactcagagccccaaagcagacatgagaacgtggggggatgccctggctgagaccctcttagacacgacaagcctttaggtaaatcgattttgtattttttatcccataattcatatgagagtcaaaccaa

SEQ ID NO: 31398 - DNA, 495 bp, Homo sapiens
  misc_feature 354: w=a or t
  misc_feature 355: d=a or g or t
  misc_feature 442: d=a or g or t
  misc_feature 443: n=a, g, c or t
  misc_feature 451: m=a or c
ctagacaaagagggtttgggtttctaggggcaaaaaaaatattgtgggaagatgacatatatgggggaaactaatgacaggtaagggttatttcgtaagggttgattatgcaaactcatttcagtgttctctctgtctctggtgataaggatttgttcttcatttgctggcacgggagtaggagcgggccttcacaagagagaattaatgcccgcttttaggcagatgggggagggcagagagctattcctgtttctgttttttctcagttgccttcagctcaaaatcatccttattccaatgtggcatattttggggtgacatattctggttcccttaagtataatcattgtwdgcaaatgcagacacagtacctgtgatgtaaatatttagtgaatgaatttagtcctgtgtgaaatcctccctcccctcccttcccatdncttcccamcacttcacgcttaaccacagtgcagcattcttactttttgaggt

SEQ ID NO: 31399 - DNA, 210 bp, Homo sapiens
  misc_feature 143: s=g or c
  misc_feature 144: m=a or c
  misc_feature 147: b=c or g or t
  misc_feature 152: k=g or t
attgtctttgctatcaaggataatataactgaacgtaatatattagcccactttgctgctttaggaagaatactaaggtgagcccagtttaatctttaacatattgttacctctcatttctgcttgttcaaatccaaggctgsmaabtcagkgccatcttcttcatgattatctttactcctacccctctctacctccattcccccaaga

SEQ ID NO: 31400 - DNA, 456 bp, Homo sapiens
  misc_feature 135: k=g or t
  misc_feature 139: m=a or c
  misc_feature 142: s=g or c
  misc_feature 143: m=a or c
  misc_feature 323: n=a, g, c or t
  misc_feature 352: m=a or c
  misc_feature 353: h=a or c or t
  misc_feature 354: n=a, g, c or t
attccatcggtttgctgcgtttggagaatcatcaagcagtggcactgaaatgaacaacaagaacttctccaagctgtgcaaagactgtggcatcatggatggcaagacagtcacctccacggacgtggacatcgkggtmagsmaaagtcaagtgaggagccaaaaatatggaggtgggggtgagaagaacctgcgaggtagttggccacggaagggttcacgtggtggaacatttgcagtgggcctaccaagcaccacagggtacctggcgctgtgctatcctttgtcttcgagacactcactgattgataggacaaaagaanccaaatctgagtgaggcaagagttggacmhnggaaggtaatgcattcatgctccaaagtttctggatttctgtctaactgaccagggccaagaacgcccgaaccatcacgtttcaacagttcaaagaggcagt

SEQ ID NO: 31401 - DNA, 252 bp, Homo sapiens
  misc_feature 132: v=a or c or g
  misc_feature 136: w=a or t
  misc_feature 144: w=a or t
aaaaagcccacaattatatcatgcatttctccaaattgtatagaatgatttaatgaaaatggatgcctttgaggaaaaaataaggcaaaatgcaagctccaaacttaccatatatttacagggctcagctcvaaawtgtggccwagcaagctttagaaatgaaaatatctacccccacaccccaactttctatatattggagctttttattatagaagcccttggaagaatctgcatgcgttagggccggat

SEQ ID NO: 31402 - DNA, 358 bp, Homo sapiens
  misc_feature 136: r=a or g
  misc_feature 142: y=c or t
  misc_feature 149: m=a or c
  misc_feature 358: r=a or g
cttgaagcttaattcaaaccaccctttataaaagagaagggaaaacacaatttcagacttaatagccttgtagttacatgttaatttttaatccccaaatttgagttgcctttgataacacttatccctactatgratgggycatatamctaattattattaaaaaggtttcagaaccagtgttctaaggaagttgtaaggataagataatttcagatgataaaaaaaaactgatgaaaaggattaaactttctaataaagttactagagataaaacaggtatagcaatatctcaccaaagcatagctctcacccccaagcccacccccccaaataaaagatgataatggcctaaggr

SEQ ID NO: 31403 - DNA, 299 bp, Homo sapiens
  misc_feature 2: h=a or c or t
  misc_feature 3: n=a, g, c or t
  misc_feature 143: w=a or t
  misc_feature 144: d=a or g or t
  misc_feature 145: k=g or t
  misc_feature 233: s=g or c
  misc_feature 247: h=a or c or t
  misc_feature 248: d=a or g or t
ghntgctttgccctgacccgggccggggctgtagactagagagggagagaagaaaacccaaaagcagtaaagcgagcggctttggggtgggggcgggggtggggtggcgaggaaggggagaggtgatactggttttggaggawdkggtagtccgaactgaggttgggctgagtacacggcccgctatgacgccgagcctgttttccctgcagatggcctgggactgccggagstggtggcggcggghdcgcaggctgcgcacggcttacaccaacacgcagctgctggaactggaggag

SEQ ID NO: 31404 - DNA, 246 bp, Homo sapiens
tctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcg

SEQ ID NO: 31405 - DNA, 255 bp, Homo sapiens
acatttaaaataattagtagaacggggtatagtggtatatgcctgtaatcccagctactcagtaggctgaggtgggaggattgcttgaacccaggaattcaagaccagcctgggcaacatagcaaagacccatttcttccaccccatgaatgaatgaatgagttattaatttaagtttaagggcaaaagctaataactaataggggcacagtatataaggatgtggttttgtgacatcagtaaccaaaaggggct

SEQ ID NO: 31406 - DNA, 133 bp, Homo sapiens
cttctttgtccatagccaaggctgatcagcataggacaatcaggacaatatgaatgatgctcaaatatgtgctaacagtcattttgctgactgttctggagactcccattccttttgaaaacaaagatggacg

SEQ ID NO: 31407 - DNA, 174 bp, Homo sapiens
ttaaaattgggaagtgtgagttctccagctgtcttcttttttcagtattcttttggttattctgagtcccttgcatttccgtataaatcttagggtcagcttatccatttatgcaaaaaaggcagttggaattttggtagggattgcactgaatctgtatatcaatttgggggg

SEQ ID NO: 31408 - DNA, 388 bp, Homo sapiens
tgccagcctctggattagaggaatgatatagactgtatatctgatgtaagcagggtagttgaacatttgccataatattaatatcacaggtacaggttatgaatttacaatgggctgaataactgtatccaaaacatgttaataaatggatcatttgtcaacctgaagggaagtcttcaggcattgtgtcatgaggatctgtccttgtttttctggtcagcatctggaatcatggttaaagccatttcagaagggatgcttatttttgtagatgactcagtacagttagaagacagaattaaaattcacagttattgccaaaccaggaagattaaattcagttgcgataaggattaaattatatacttaaagtatttttcaaaacaga

SEQ ID NO: 31409 - DNA, 452 bp, Homo sapiens
  misc_feature 116: m=a or c
  misc_feature 130: h=a or c or t
  misc_feature 142: y=c or t
  misc_feature 144: w=a or t
  misc_feature 150: r=a or g
  misc_feature 166: d=a or g or t
  misc_feature 296: m=a or c
  misc_feature 297: w=a or t
  misc_feature 304: m=a or c
  misc_feature 333: n=a, g, c or t
  misc_feature 362: m=a or c
  misc_feature 410: s=g or c
  misc_feature 413: s=g or c
  misc_feature 435: r=a or g
cactttttgtttctatgctttcttgattgcaaataattttttgagattttgttaattttagttacttctggaatattccaacccaaattatagatgtttagtcctttttaaaatcmacttataatttathtgaatcctaggycwtagttrcttgatcaatgtttadgcagcagaataattgagtagcattccgcatagctaagtagcactgtttcgcaacctgtgccctcttgctctagaaaatactattgcttgacatataccaggagttttaggttagagtatttggcagtgtmwatatggmatcaaaaacttgcattaaaatggagaagnatatctttgtgaatcctctagatggcagmacaattacaacaaatatatcttagaaggtgtccaagaagcgtgtggasgasagagtgtagaagagatggggtrgaaggggactgcgggct

SEQ ID NO: 31410 - DNA, 188 bp, Homo sapiens
ttaagtaataatgagaatgggtttataaagaaggcaatatgtgtgtccataacctctacactcacaggtgagtttcttatattcccagtcatttctcaaaatggcgccacattttcattttcataagtaggtagattatggttttcttgtatggtttagggtttgtatcttgttgaaagggggataat

SEQ ID NO: 31411 - DNA, 133 bp, Homo sapiens
ttgtcagtggagggtgagggtgaccccatctgctatttttgtgctcatcctcatacaaccatttggggatgtgcctattagggctccgtaagaactcagatgcctgggaagcccagcccctcaggtgccccct

SEQ ID NO: 31412 - DNA, 243 bp, Homo sapiens
  misc_feature 209: m=a or c
tcttgaggccattcacgttcctgcttaaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgmgagctgcagctgcagtggtcacgtgagcagggaa

SEQ ID NO: 31413 - DNA, 139 bp, Homo sapiens
  misc_feature 106: s=g or c
tccggagcggcgactggcgagccatggcgctggggctgcagcgcgcaaggtcgaccacggagctgcgcaaggaaaagtcccgggatgcggcccgcagccggcgcascaggagaccgaggtgctgtaccagctggctcac

SEQ ID NO: 31414 - DNA, 437 bp, Homo sapiens
cgggtgtgtagcagagcctgccaagcctgggtgagtgctgcaaggagggatcccgggaagggatgggaaaggtggaggaggtcaggatgaaagcgatggatgcttgagaatgaaaaggatggtcattttataggtggctggaatgaataaaggggagctagaaaaggatttcagaaagccctcccaaaatttaaccaacttcacaatttggcctgtagctggctatcttgttaggttattaaataattgaaggtaaacctgacatctctcttctggattacttaaaaaatgcatttctaaagcaattcattttgaaaattggggtcagtgacctctacaaatcaaggtaaaatggtgccagaccctttttatttagccattggtcagtctgtcgcttgcacaaaaagcaaatggagtgaacaacagttagacgggac

SEQ ID NO: 31415 - DNA, 287 bp, Homo sapiens
aaaacgccttgaggataaggaaggagaatcagcaagtcccgagttcctacggtgtgtcagcatcgtgctcccactcccgggagagaggcattatcttcagtttacaaaaggggaaaacaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggcccct

SEQ ID NO: 31416 - DNA, 192 bp, Homo sapiens
  misc_feature 134: k=g or t
aggaaggaggaaattttgccttgaaatgcaaaacaccaaaaataattaggtggctgccagtataactcttaaaaactttatatgaaatatatttaaataaatacttttactttcagagaaaaaatgatccctakactcttgcatccctggtgtcctttgaagttaagaagatgccttatacagatcagccta

SEQ ID NO: 31417 - DNA, 368 bp, Homo sapiens
  misc_feature 105: r=a or g
  misc_feature 119: s=g or c
  misc_feature 124: b=c or g or t
  misc_feature 128: v=a or c or g
  misc_feature 129: k=g or t
  misc_feature 133: r=a or g
  misc_feature 138: s=g or c
  misc_feature 140: s=g or c
  misc_feature 293: k=g or t
  misc_feature 294: k=g or t
  misc_feature 337: k=g or t
gcaggtgcaccagcctcggtcaggatccaggacaatgaaccgcgtcctcaggccaaaggagcgactccgtttccagtttcggaaggggtttctccagaataccaracaccagtcggtgsctctbctcvkaaarccagsasctcggggtggggagcgcgttcagaagttcacggttgactcaattactgggttaatttgatgtatgctaacttctatagccccgagtactcgatgtgcctgttttcaatggccatttaaaaaacagctggacctctgtatcaatctagagttakkcatccttcttggaagggagcagaggggcctcttaaatgttatkggaagactcatcactgcatagaaccgcgtca

SEQ ID NO: 31418 - DNA, 214 bp, Homo sapiens
  misc_feature 126: s=g or c
gtccgcggacggggcgctgcggggccggggggcgccggctcttcctgtggcctccacgctggtgccgcagccagtgcggttttaaataccggagaaggtccccaagtcaggagagtctctcggcgsccacgggttcctctgggagtgcgccctggccttgccttagggtttcagcctcggaggaccggttctgggcagtggagaagggacggta

SEQ ID NO: 31419 - DNA, 250 bp, Homo sapiens
  misc_feature 195: v=a or c or g
  misc_feature 196: w=a or t
  misc_feature 207: k=g or t
  misc_feature 208: w=a or t
aggtgccctgtaaggcaggcaggtagacgtacgcgtcgctccgtgcgtaggagcgcgcgcacggcttgtagaccccgcgagaaggaaggtcgagccagattgaagatctcaaacagacaaatcatggcttggaagaatatgttaggaaactcttggatagtaaggaggtggtaagcagtcaagtagatgatttavwcagccacaatkwgcatctttgtaaagaattgattaaaattgaccaactagcaga

SEQ ID NO: 31420 - DNA, 498 bp, Homo sapiens
tagatgttatgaaactcaaaattcataaaatggtaaatagtgaaaagtctcccttgtgctctgtcctcaatccaccagttcctttctcagagataccattttcttgtgtacccttaaaagggtattttttgcatgtacaagctagcactgtgtgtgcacatattcttcttttttcctcttttttttgttgcagaaatgataacctactattcactattctgtgccttgctttgtttgcatactgaaaattatccatggaaggatacagcaccatttttacttaaggaaccccttatttagggacacttaggttgttttcaatattctgctcttgtaaagagtgctgcctcatttcacacacatgtgagtgtatctataggataaatccctaggattggaattgctgcatcaaggagaatgtgtatttgtaattttgatgcttgttgccaaatttctgtccatagtggctccaagttcccctcctattggcaaggtctc

SEQ ID NO: 31421 - DNA, 436 bp, Homo sapiens
  misc_feature 117: r=a or g
  misc_feature 171: k=g or t
  misc_feature 228: s=g or c
  misc_feature 239: s=g or c
  misc_feature 246: s=g or c
  misc_feature 255: s=g or c
  misc_feature 274: r=a or g
gtgactcgaatggcataaaagccacgcaaacagctataaaatgcacagaaaaaatgactggaaagacatatacctgtacgcccaattattatctgtgactataagtgggtttggagrtttattttctaagacctcttcataattaatttctcttttcttttttttcttttktctttttcttttttgagacagggtcttactctgtcacctaggctggaatgcagtggsacaatctcggstcactgsaacctctgsgtccgcctcagcctcccgrgtaactgggcctacaggcgctcgccaccaggcccagctaatttttgttacttttagtagaggcagggtctcgccacgttggccatgctggtctcgaactcctggcctcaagcaatctgccagcctcaacctcccaaagtaatgggattacagacgtgagcca

SEQ ID NO: 31422 - DNA, 109 bp, Homo sapiens
atgtttgaagagtacccgggtttggtagagtgacttctattcactaaaaccatgtgtctgaactgaagaagcttgggctcacttccacaaatgtaagtgctgatttttt

SEQ ID NO: 31423 - DNA, 416 bp, Homo sapiens
  misc_feature 127: w=a or t
  misc_feature 333: r=a or g
  misc_feature 387: w=a or t
  misc_feature 396: r=a or g
taacatgaatctttcctatcatctggtccctcacgcattacctgctcataaattactgaaaaagaaatattgatgaattccattttcaaaagagcaaaaggtgagagaacatgccaaggctgtcttwagtatgctttacataaagaatacatcctcattttaaattctaactggggcagagaactgggtagagtttccatttgagaactttccagagagataggatcttcaaactctcaagtgaatatttaagacaatttcatgtcttcttaaacctacatgtctgaattactgctcctttccatttcatagttggtgaacagattcatttgracaatcactttgaagagtataggtagaagcacaataaccaggtgagggaacatwaaaatatgrccattatggctgggtgcggt

SEQ ID NO: 31424 - DNA, 390 bp, Homo sapiens
  misc_feature 131: y=c or t
taaattaacaacacgtaaatgatatgcagctagcataaacatatgtgaatcaagaggataatcaatttgagtgactaggcttattttgtttcagtaactttaatgttcctcaacctcatctcccaaggccyttcccctagccccaaattcctgtaggtttacaagaaggaagcagtctcaggctgggaggagggtggagaaaagacaagatttctaactagtttaatttattttattttattttattttattttattttattttattttatttttgagatggagtttcgctctgtcacccaggctgtagtgcagtgtcaccatctcggctcactgcaaccccctgcctcccgggttcaagcaattctcccgcctcagcctcccgagcaga

SEQ ID NO: 31425 - DNA, 151 bp, Homo sapiens
  misc_feature 119: m=a or c
  misc_feature 123: y=c or t
  misc_feature 134: s=g or c
attttggcaaaagccatgcacatactcaagatttttgacatattgggtagagttaagatttaaatccaggtttgcagcctctgaatctgtgttctacccaccagtccacaccctttcamcttyccctgttctcstcacctcacgcccggta

SEQ ID NO: 31426 - DNA, 203 bp, Homo sapiens
  misc_feature 124: k=g or t
gactggcatggtcattcatcaagtagaagccaagccctccgtctatttcatcaagtttgatgatgatttccatatttatgtctacgatttggtgaaaacatcctagatgtcatcacaaactctkgccaaatttgtggaactatgaaatgtattatttgtagacataaagacttgattgctttccagtttaatgaaagcttaaa

SEQ ID NO: 31427 - DNA, 298 bp, Homo sapiens
  misc_feature 126: w=a or t
tggaatagggtgtaaactagactttgatcaagaagaaaccaatgagaagccctctttgatacttcgtacacagcttctttctaccagaaccagtctgtgggaggtaatcctaggagagtctaaatwaagaggtttggtttggtttgatttgataaagaagtagctgcttattgcatattgggactaaataaccaaagttctttgtggcttaatgtgcttttccggtcatttggtgacaggtttcatggacccaggcactacggaccatagttaaaaactgttataaacagcatgggcg

SEQ ID NO: 31428 - DNA, 220 bp, Homo sapiens
tgcattggcacttttgttctggttttaacttgacttgaattgctggatactttggttttggttttgacttgtcttggattttttggtactcggattttgaatttcgtgattttggtttggtataaacggtaaaagtgtatgtgtgccctttttacctgttctttgtcttgtggtgagtgtgtgtgatgtgagcatggtattttgtatcaaaaaaaaaaaa

SEQ ID NO: 31429 - DNA, 200 bp, Homo sapiens
tattaggctcctactcatcttgaaccagaaaaaaatgaattgaagttgttgagtactaattggcaaagacttttaatcatgggccaagaactttcactgacttgaaagtaacttctccacagggaaggaccaaaaacctggtttaccttaaaacaaaaacctgttggagttcagcgtggtgtaaaaatgtaaggaagcaa

SEQ ID NO: 31430 - DNA, 403 bp, Homo sapiens
ttccggtcccgtcaaccgcccaacggctgaggagtgcggcacgcgccagagactggcgggcagctccgcccgcggccgggatgcactaggcaaagccagctgggctcctgagtccggtgggtacttggagaacttactacgtctagctggaggattgtaaatgcaccaatcagcatgctgtgtctagctcaagagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccatatctccgtcaagtgcagtaaccagttcgggggggatc

SEQ ID NO: 31431 - DNA, 226 bp, Homo sapiens
  misc_feature 134: k=g or t
  misc_feature 135: r=a or g
  misc_feature 138: w=a or t
  misc_feature 145: k=g or t
ggctgcataaatgtcttcttttgagaagtgtctgttcatgtccttcacccactttttgatggggttgtttgtttttttcttgtaaatttgtttgagttcattgtagattctggatattagccctttgtcagatkragwaggttgkgaaaattttcccccattttttgggttgcctgttcactctgatggtagtttcttttgctgtgcagaagctctttagtttaat

SEQ ID NO: 31432 - DNA, 224 bp, Homo sapiens
  misc_feature 134: k=g or t
  misc_feature 146: k=g or t
ttacatggatgatgggatcttatagggtcacacaaagacaatttggcagcttatcttaatttcctgcagtgagacaacacatgtggaactgggaaggacagctgttgtttcgagcagtttttcctggtcatggktgttaaagctckgtaacccacattgtaaagccgtgaatgtttttagtcttgttgacgagtttttagagactgctggacctctgagggcta

SEQ ID NO: 31433 - DNA, 243 bp, Homo sapiens
  misc_feature 129: r=a or g
  misc_feature 134: r=a or g
atgtggtgaaggagtattttgtggatccaaagtagacagggcataagcagaaaatgcaggtgaccccagcagccgctgagccggcctggattcgggcaaagaaagcagcgtcctcctggtgcaaacagrcacargccacaagtgcaggacacgcagtctagaaagtccggaagacaggtctcactctgttgcccagactggagtgcagtggtgcgatttcggctcaccgcaacctccgccttt

SEQ ID NO: 31434 - DNA, 119 bp, Homo sapiens
  misc_feature 14: s=g or c
  misc_feature 48: m=a or c
  misc_feature 90: m=a or c
atcaaggtatttasaaggcatcaaaatttggtgcatagcaactctggmtcatagaggcttttaattcttgagggcacaaagggtattgcmaggggaactcttgcaataacctcatgtga

SEQ ID NO: 31435 - DNA, 343 bp, Homo sapiens
  misc_feature 143: k=g or t
tgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctkgggaattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagct

SEQ ID NO: 31436 - DNA, 336 bp, Homo sapiens
  misc_feature 142: s=g or c
  misc_feature 149: r=a or g
gttgtgagctgcggcagagactggtggctggaggagacgccggcgctggagagtgcgctgcgccgcccgccgctgagggaccgcggggttagccactgctggctgcttccagtgttcgccgagaggtaccgggggtgacagsctccggraccggccgaaaggcgaggaaccggtgtggaaattaaaagaacacacatattttgactggggctttgatcaaccaaatgctaaaaagccacataaagaagatccctaatagtcatttctcaacaattatatagtcaactgatgtaacaatggtactaatattgggacgcagactaaacagagaggatc

SEQ ID NO: 31437 - DNA, 446 bp, Homo sapiens
ttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaa

SEQ ID NO: 31438 - DNA, 251 bp, Homo sapiens
  misc_feature 145: y=c or t
agatttgatggagtagcattttgtagtaaaccgatctagggcaaaagtgttccacattcccctagagcttttctctcccatttcccttctgtgatttcagacacccatttatgtctgctgggagaatcattaagtcttgagcctyctgtgctccttcctcttaccagacctgatagtgactttaagcgggagggggagttaggagaaaagtattttgtttccttcttgaagggggtgtgtcccaggcatag

SEQ ID NO: 31439 - DNA, 126 bp, Homo sapiens
  misc_feature 126: s=g or c
aatggtgggcatttttttttttaagtttgcagaagctgcctgtgatgtggtccatgtgatgctcaatggatcccgcagtaaaatctttgacaaaaacagcacttttgggagtgtggaagtccaggs

SEQ ID NO: 31440 - DNA, 306 bp, Homo sapiens
  misc_feature 138: r=a or g
  misc_feature 145: k=g or t
  misc_feature 147: k=g or t
  misc_feature 224: b=c or g or t
atatataaatattgggatggagtctcactacgttgcccaggctggtctcaaactcctgggcttaggcaagcctcttgctttagccttcctagttgctgggactacaggccctccaaacctgtacttgacctgaagggrcaaatgktkgtcacatagtctattgtgttgaaaatcaaaacaacactgatatccattgataggagatgagattaataaaataaggbacacctacaagtgagattggcctggtactgtgtctcttcacctgtattcccagcgctttgtgaggccaaagtggaaggacca

SEQ ID NO: 31441 - DNA, 246 bp, Homo sapiens
  misc_feature 143: r=a or g
tgagcttatacatcaagggatctttataattgttatttctaatgatcttgtacatcgagggatctttataattcatacctttgagtggtttgcggttcacacagagcttgtcagtcacttagcctccttgttgggcgaggtarggtggaagctgttactttccccgcatagatgaagaggtgaacagggggtagaagagtctggaacatcagtctcccctgctgatgttcctccacctgccgtgct

SEQ ID NO: 31442 - DNA, 153 bp, Homo sapiens
  misc_feature 141: r=a or g
  misc_feature 144: y=c or t
gagttaggtgagttatagtctaacgtgagtgagttacctgcgtggtggctgcaggctgagctctaaccagataacatgtccacggattcttgacagagagaaataagatcacttagaaagaaaggatcatttctcccttgrgtyacaaggagc

SEQ ID NO: 31443 - DNA, 156 bp, Homo sapiens
  misc_feature 123: w=a or t
taccttatatagtaaatctctgcccctcgacctggcctgtcgtatctgggacgtgttctgtcgcgatggggaagagttcctgttccgcacggccctgggcatcctgaagctgttcgaggacawcctgaccaagatggacttcattcacatggccac

SEQ ID NO: 31444 - DNA, 362 bp, Homo sapiens
ttggaatattaaaaggaggatatttcctacttagatttattttacttattagggaactgaaaatgccgtctaagaatgaggggcaacaagattggcctgtgctcaaattttaggaggcacggtgcccagagagggctccagagctcttttgctggctgcctcttctggaggagctgactggccagctgcagagcacattgatctggtcatgattgctttcatcctggagtagagcaagttcacacaatttaaatcaagagccacattagaagctcctgacctcaggataacctctcatttcctacctttgaaagagggaacaagagggaacagttcagtcacttcctaacatctagccacat

SEQ ID NO: 31445 - DNA, 237 bp, Homo sapiens
caagtcttttttgcaatcttgaactttcattagcttcaaagagaagctgtatttacaggagaaagaggtgattatggagggaatcaaaaatactgctttcagttagtagctagctttaagtcaggagttagtaatgagaaattttataaatgtgtatttctgtgtattcacatacatatatatatacacacatatatatgtacatacacatacatacatattaccatactgaagggc

SEQ ID NO: 31446 - DNA, 87 bp, Homo sapiens
catcaaatctgtgataagcatcataattctaagtaatttgtggatcaaagcagaaatcacaaggaaataattttttttttttttttt

SEQ ID NO: 31447 - DNA, 317 bp, Homo sapiens
  misc_feature 177: w=a or t
  misc_feature 267: h=a or c or t
ctaaaaatacaaaaaattagctgggcatggtggtgcatgcctgtaatctcagctacccaggaggcttaggcaggagaatcactggaacctgggaggcggaggttgcagtgagccgacattgtgccactgcattccagcctgggtaacagtgaaactccatctcaaaacaaaacaaawcaaaacaaaaaactagaatgtaaattcctgaaggcagaatttgcttgcttgtctgtttttctcttttgtttcctgctctaccccgggachtagaatggtgcctggcacatagtagatggctattaaatagctactggatg

SEQ ID NO: 31448 - DNA, 436 bp, Homo sapiens
  misc_feature 26: m=a or c
  misc_feature 187: s=g or c
  misc_feature 273: r=a or g
  misc_feature 420: m=a or c
tgaaataaaaaaggaattaaaagggmaaataaggaacaaagatataggaagaaggaaacaatttggtggctgtgattaaacacataatttggctcagagcttcctggcaggcaagacaaaaaagaacacatgataaattgcataattcttactttcaaaaagaggaaacatactagtttctggtgasagggaaaacttttcctctcaccaaattgcgaaagactttgcacacatggggctttgtggagaggttttgagtgctaaaataatacraggtaaacaatgaatgtggtatggaagctaagagcatacaggctctggcattagaccacctgggctcaaatcctagcttgattacctaccagctcttgtggcctaaacagtcttctctgtacttccactcctttatctgtaatagtmattgacagcgcatcgt

SEQ ID NO: 31449 - DNA, 213 bp, Homo sapiens
tgaaaaaaacatctcttgctcatggataggaagaaacaatattattaaaatggctatactgcccaaagtaatttacagattcattgttattcctatcaaactgccaacaatattcttcaaagaactagaaaaaactattttaaaattcatatggatctaaaaaagagccttaatagccaaggcaatcctaaacaaaaagaaaaagctggaggg

SEQ ID NO: 31450 - DNA, 392 bp, Homo sapiens
  misc_feature 344: w=a or t
tttctacatttttaaatgttcaccttcccccagtgaccatgacaacactgggaaatatgaccaggcccataaagcatgacactagtacaaaatttcctcaagtttatatattgggcatcctaaacttgagtgtaggtatgggcaacatcagctggtggagtgtgagatggcagggactatggtgagcagaggagtgtgtgctcatgtgagcggggtggcggctgctggatgcatggcaggtcgctgctgttggggagtgctgatttcatgttgttggttctttccatttttcatgagaagccagaggtctggaattttggatgaaattttcagtttaaaaatcwcagcagcttattcaaatatttaaaaaaatactctgtgatcccaataaa

SEQ ID NO: 31451 - DNA, 261 bp, Homo sapiens
  misc_feature 91: b=c or g or t
tttttaagatagggtgtcactctgttgccctggttggagtgtattagcagaatcataggtcattacagccttgaaatcctgggctcatgcbaccatagctgggctcctgggctcatgcgccaccataagtggctaattttttttttcatacctggctaatttttatttttattattattatttttgagacagggtctctgtcaccctggctggagtatagtggtgcaatcatagctcactgcagcctaacccttgcaggct

SEQ ID NO: 31452 - DNA, 326 bp, Homo sapiens
tgataatgaaagtgaaaatactaatcttaagaagaaggtatttgaaaaggaggcccatatccaagaactttcttgtttgtttcagagtgaaaaggcaaatactttgaaagcaaaccgttttttcccaatcagtaaaagtagtacatgaacgactacagatccaaattcataaaagggaagccgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatca

SEQ ID NO: 31453 - DNA, 107 bp, Homo sapiens
attatggatatatttgggtttatatctcccatcacattttgtgctatttgtcccacctcttgtgtttctttttctctccttttctttcttttttttttttttttttt

SEQ ID NO: 31454 - DNA, 449 bp, Homo sapiens
cattttaaagttacctaacgttcttcttgaataactaatacagtgggtcaaatattataaaataggcaaacaccaaaatggtattaaatattgaactcctgaccttttcgacacttacctagtaaagtattcttaggcatcatcataacttttcctcacctttattcgaatagaggaataaatgtcttcagttgtctctccattacccctaagttattagtttgtctagtttatatataaagaccatgttttaaagtacataaagtggaggtttatttatcatacaggctttgaaacattaagaagcagtatttttattaactttttgagacatattaaaatacattttgccttagaagactgcttctaaagtaatttttgtaagtaatgagatgggatggtaatctagtaatttgactttatagaaatccctcagtttggcccccact

SEQ ID NO: 31455 - DNA, 451 bp, Homo sapiens
  misc_feature 119: r=a or g
  misc_feature 376: n=a, g, c or t
  misc_feature 382: s=g or c
tatttgtcctagtgcttatatccttatattggaaaaaacactttatttttgtgtgttggagtcattttacagacaaaccacctcccactccaaatagaccttatgcagggttgtcttgrtattcttgtacatttattcttccagaagaactggattatcagtttgtcaaaactccccacctcaaaataaaaaggagctttttaaatgtgatacacgtgtctttatgtatttatttcagacttattgcccttctgtcatttattttattttattttattttttattgttttttatttttttggtgattcagtctagttctgtcacccaggctggaatgcaggggcatgatcttagcccactgccccctccacctccnagggcscccctgcatcagcctcttgagtagtttggattacaggctcatgccaccacacccggctaatttttgtgt

SEQ ID NO: 31456 - DNA, 211 bp, Homo sapiens
  misc_feature 158: r=a or g
atgtttcttaatcattggacatcaattatttttagagagtaatgtataatttcatagcattttaaatttagtgtatcatgcgagttttttttggtagatgctgaagaatgtggttgctaaacaaagaatgctaaagaatgttcaaactttatagatarctttattgttattatttattttcacacatttaattcctattaagtacagccgc

SEQ ID NO: 31457 - DNA, 470 bp, Homo sapiens
  misc_feature 400: r=a or g
  misc_feature 444: n=a, g, c or t
ctctcctcgaatgaaaggaaacaacctccggcgacagagccccgctctcaggcactgctggagaaccgagaccgacttctttctctttaccctcattggcgcttctctcctgcagtccgcctctgggccctgccgcatttcttgaagacttaaagtggcattctaaaggcaatttaaaaatcatgtcaagctcagttgaacagaaaaaagggcctacaagacagcgcaaatgtggcttttgtaagtcaaatagagacaaggaatgtggacagttactaatatctgaaaaccagaaggtggcagcgcaccataagtgcatgctcttttcatctgcttggtatcatcacactctgataatgaaagtcttggtggattttctattgaagatgtccaaaaggarattaaaagaggcacgaagctgatgtgttctttgtgccattgtcntggagcaacaattggttgtgatgtga

SEQ ID NO: 31458 - DNA, 129 bp, Homo sapiens
aaaagttattttgtagagaggggttctcgctataatattgcccaggctggtctctaagtccttgcctaaagccatcctctctcgtcggcctcccagcgtgctgggattgaaggcatgagccactgtgcc

SEQ ID NO: 31459 - DNA, 279 bp, Homo sapiens
  misc_feature 54: r=a or g
  misc_feature 55: m=a or c
  misc_feature 56: m=a or c
  misc_feature 134: r=a or g
  misc_feature 147: m=a or c
  misc_feature 148: s=g or c
cccgccttggcctcccaaagtgctgggattacaggcgtgagccaccgcccccgrmmtacttccagttaaaattctgacatttctgacttgacttaggcacccacactgatgacatttcccttgacgaaatctgrataatccaagggmsttgctaattaattgattggatttacttggacatgtcaagttttcacaattgtccatgagagtgtggtgtctatatatatttaaatatatattatatatgttttatatgtacacacacacacacacacccac

SEQ ID NO: 31460 - DNA, 188 bp, Homo sapiens
  misc_feature 132: s=g or c
  misc_feature 141: w=a or t
  misc_feature 146: y=c or t
  misc_feature 148: m=a or c
tgcttcagtatagttattgacttaagtaaatttaacattgatatacttgaatctatcatttgtattacagttttgtcagctgacccaataatgtcctgtaaagaagttctcccactaccctataatcccagstccagtctwagggycmagccattacatttacttgtcttgaatccagctttttcttt

SEQ ID NO: 31461 - DNA, 457 bp, Homo sapiens
  misc_feature 139: y=c or t
  misc_feature 146: k=g or t
  misc_feature 151: r=a or g
gtaattgctataaaaagcaccatattttataacttttaataacgtttgtagttttaaaatcattaccttattagcttggagctgaatatagaacgaaaataacgaggaaaaaatttgttattctctcttactaagctcyccccackgtgartagaggcagaaatataattatataaaatagagtaacttttttcattacttatttcttgtaggaatctccaactgcctcaaaaccctgctttcctgaaaatgagtcttctccctcctcaccaaagcaccaagatacagttagtatgatagaagcatatcttataatgtagtccagttatttcaatcaattttagcaagttaatttactcttaatgtaatgtttaaatgagcttctattaaatttcattggtttttctaaaaaatcacaatcaaaataagtttaacaatcagattttattgatttaaa

SEQ ID NO: 31462 - DNA, 235 bp, Homo sapiens
  misc_feature 143: k=g or t
  misc_feature 146: r=a or g
  misc_feature 151: w=a or t
caggaattttttactagcttgcattattatgttgagcaaggtctttcctttcttttgccgctggaaggttgcctggcatgtattagatgtttaggaaatagttactgaataaatgaacagaataatttttgattaagtttttkggraattwaaatctgtcacataggaagcttcgttaggtgttttaataggggaagacaggaacagttttttggaaaaatatatacagcttgac

SEQ ID NO: 31463 - DNA, 241 bp, Homo sapiens
  misc_feature 140: k=g or t
  misc_feature 142: r=a or g
  misc_feature 145: s=g or c
  misc_feature 146: s=g or c
  misc_feature 150: r=a or g
  misc_feature 154: n=a, g, c or t
aaaacagaaacaaacaaacgaaaagaatttatcagcaatatggtatggacaacatagcaagaccacacctctacaaaaatgttttttgaatagccaggtgtggtggtgcgtgcctgtggtcccagctaatgaggaggctkargcssggarggtncacttgaaggctacagtgagctatgatggcaccactgcactccagtgtggatcacagagcaagaccccagctctaaaaaaaaaaaaa

SEQ ID NO: 31464 - DNA, 116 bp, Homo sapiens
gtatttaatatttgcataatgattaatctcctgctccagaggaaattcccaaaggaagagacaactcagaagcactttaaattgcaacaccacggcaccacggcaaagagataaga

SEQ ID NO: 31465 - DNA, 125 bp, Homo sapiens
cactttgtataaaaacaagaaacgattagttcattaaactttttctttaccttctggtagtaaaaatagataaaataattccgtttcaactactgtgtgtaaaaagcctgtatcatatgtaactg

SEQ ID NO: 31466 - DNA, 382 bp, Homo sapiens
  misc_feature 43: w=a or t
  misc_feature 127: r=a or g
  misc_feature 146: w=a or t
  misc_feature 147: m=a or c
  misc_feature 153: v=a or c or g
  misc_feature 157: r=a or g
  misc_feature 216: v=a or c or g
  misc_feature 296: m=a or c
  misc_feature 310: s=g or c
  misc_feature 318: v=a or c or g
  misc_feature 324: v=a or c or g
  misc_feature 376: r=a or g
tataatttaattatttggtattcaaaaacttatttttattatwtagtttgattgtttccatccattgccatatgaactccacaaaggcaggaagtttttctgtcttgttcccttgctgcacctccartgcttagaatagtgccagwmtctcavtaartctttgtcaagtgagtgagggaaatgttcagttagctcccatgctggacatcatccagvatattaggagttgggtgagcacctcatactgcagaatcttgattgccctctgagggctctcttacagtttgattgggcamtgattcctacctasccaattavaagggvagggttccagcccttcactcctttgtaaagtggaaacattgcctttgcctcrctaaca

SEQ ID NO: 31467 - DNA, 278 bp, Homo sapiens
ccagggggtaaatttgtatctcattacaacagagccttgtattaggcctggagtataattaaatgtgaggaattataattggttccctctttgaaagctctctgagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacacttcc

SEQ ID NO: 31468 - DNA, 236 bp, Homo sapiens
  misc_feature 107: w=a or t
  misc_feature 120: w=a or t
  misc_feature 127: y=c or t
  misc_feature 133: m=a or c
  misc_feature 140: y=c or t
  misc_feature 144: b=c or g or t
  misc_feature 151: k=g or t
catttagcacccagtttcttaaacagtgtttcagggccctgtctggaacttggcatgatggttctgttgcgaccagcatggtgggtgttttttaggttttttttttwaatgggctgaggwaatttcycatgamatgtttycctbctaattkgggacagcctttggggtggatttctaaagttatacccacacaattaaactatcccagaaacactgggcaatgttaacgacactgt

SEQ ID NO: 31469 - DNA, 106 bp, Homo sapiens
ttcttgatggtgccctttggtgcacaaaagtttttaattttaccaagttgtattaattgagttcttttgttgcttgtgcttttactattaagaatccatcgccaaa

SEQ ID NO: 31470 - DNA, 131 bp, Homo sapiens
aggagatcaaagtctgggggaagaggtgcaacctcaccgggccttggtaagcactgaattactgtactttcattttccaacttcctgtcactacagaaaatgagaattgctcccctcctccccatccacta

SEQ ID NO: 31471 - DNA, 311 bp, Homo sapiens
tatggaagaacaataggcaaggataatcaagacccagctgataaaaaaggtggaagaacttgccctaatgaatatcaagattaaaactatagtaattaagatgctgttgcattgtacacagacaactagactattggtacaaaatagtctggaaatagtcacgtgtattagtctgttcttgagttgttataaagaaatacctggctggtcatggtgactcatgcatgtaatcccagcactttgggaggtgatccacccacctcggcctccgaagtgctgggattacaggcatgagccactgcaccccgcaa

SEQ ID NO: 31472 - DNA, 419 bp, Homo sapiens
  misc_feature 293: r=a or g
ttgttctttgaatttttttttcagatctaaaataaagttccaaatcttgataatcacagcacgtttaggactaatgtcttcattgttttatctgtcttccttttagttgcctaatcatttaaagatcaaattaaattgaaatctaatataattcctgctggtaaagtgacttttatagtaacttccaccatttatttgttttcttagtaggaaactgatttaccttacttctacatgtgtttttggtatctttattctgaaattgtcttttctttgtcaatcaggatctaggrcttcagaacccatttgtatcaactcctaagaaactaaattaggtcacctaacagtgtcaaatgcctttttcttctgcgttttcactgacattttagaactccaatactgtcatactgtcatttttt

SEQ ID NO: 31473 - DNA, 228 bp, Homo sapiens
  misc_feature 133: k=g or t
gagaggaagtgtaatgattattttaatatttctattaaaactgtatatttttatggctgctcttttatgttacccactgtctctttggggttgttaattggtttctgaaagggaacttcaaaactcctttackactggccttccatggttggtccctattaggttgttgtgagaacgtcgaccaactctttgatacccgccaggtagaccgtagtacctgccatgtcc

SEQ ID NO: 31474 - DNA, 293 bp, Homo sapiens
  misc_feature 121: w=a or t
tttctcgcttttaaactttgccaaaagtaacctcacaggtgaaaacaagaagcctgaactaaggttatgacttaaccacaagtctatgaggtactttcaaagaggtggcaaacagtttttwataaaatctagaatcttcaaaggtaactaagagaaaggaagatataagaagggaagctagaagatgctcatggtgggggaaaagaatcagcaaatggtaaaggccacacagacattaaccagaaagtactcatttcctaagccagaccgccattgtaaaatgtcagacgacc

SEQ ID NO: 31475 - DNA, 463 bp, Homo sapiens
  misc_feature 462: y=c or t
caagctagtgtttatctcctccccctccccaaaactgtggcacagcatataaaaatgtacctcaataatgttctattaaaaatgggacaggggccttatgttttcataatttcccaacaatgtgccgccatatttttgcctcaaggtaaaggttttaacagatgaaaaagtacttcccaattcccccgtgctattcctaacctataatgcccaaatgttttgtgcaatgtgtagtgtgtgtgtataaatacatatattcttgaaatagacataccatcagagacatcattcacaagtaactgatgtattggcatctcattcatatttctgatgtgtgaggtatatggtactaattaccttttccttgatgtttgccaaatttgaataaaggcattggtacgaaattacagaatgtaaagaaaatgtttttggcttgaaaaattaacatattttatgacgtayc

SEQ ID NO: 31476 - DNA, 295 bp, Homo sapiens
  misc_feature 120: r=a or g
  misc_feature 122: r=a or g
ctcagcccttcacttgtggcagcatttcttactctgaggttctgggcctagaaacccagtgtccataggcaaggtctagggacagagagagtttgtagaaagtgggaatgcatcagtggrarggctaaatccaaacaggaactgagctggcctgggtggctttgtccttttgccatcttcgtaaccctttaaaggctttaagacacttcttttgtaataactaccccaactaaatttggccagagctgtgaagggaaagaaaatctaagacccttgagggagatgacagccgact

SEQ ID NO: 31477 - DNA, 486 bp, Homo sapiens
  misc_feature 308: v=a or c or g
aacctccgtcaaaatgccattttagtgatcttccttagcaaaggcatcttggtgtgaattatttcagatagtcacccctcctatcgcatcactgcccttagtgaaggcagtggaatatcaagaaagcctgcattctcccgtatagcaataggcccagcctttaaaataggaggctgaggagacagaactctatgaccagatgatgtatggagtctgagattcctaagccttcacctacctcagggatcatctcagttgatccagggcttagagaaacctagatggggcatcatgaagaagtgaaaccvtgccagtgcctgtcttacacaaaggaacactgacagtagcacaacagcagtgcagctgacgaggaagcacatcaaggctgcagagacctcactgctttttaaaggcataatttctgcctctctctgtctctctctgagaaggccaaatgggtggaagtcaatcaatcacacactggtt

SEQ ID NO: 31478 - DNA, 51 bp, Homo sapiens
gattttgaaaaggctctgacagattaccgggcagagctccgggatgaccca

SEQ ID NO: 31479 - DNA, 207 bp, Homo sapiens
  misc_feature 133: w=a or t
  misc_feature 138: k=g or t
  misc_feature 144: m=a or c
  misc_feature 147: k=g or t
tttttttaattgcgaaaaaatttgctgaatgcacttttggtttgaacttcattttaacattaatactgctgatttagattataaggaaagagattaagtctcatatgaaggaaatactatcttcaaaatgaawccttkggttcmaakgactttcagataccattttcaccaacttaagtttgtaaacgttctcaaagtttccgtggc

SEQ ID NO: 31480 - DNA, 270 bp, Homo sapiens
  misc_feature 14: m=a or c
  misc_feature 113: r=a or g
  misc_feature 116: w=a or t
  misc_feature 123: r=a or g
  misc_feature 124: m=a or c
  misc_feature 131: y=c or t
  misc_feature 141: w=a or t
  misc_feature 144: w=a or t
  misc_feature 163: h=a or c or t
aatatgtttttggmtctgctcatgtcgaatcacaggggattttttttcctaaattagctcatatagataattctttccataaggatattgttagaacttcagtttctactggraawaacctarmcttcaaytaattttctwctwcctgttcttaaaaaaggahaaaaatgccaagcaaatatgattactgacattattacattctagagtgctttaaattgtcctaacagattggtagcctaattttttcacctttctccatatgcaccg

SEQ ID NO: 31481 - DNA, 275 bp, Homo sapiens
gctgagaaatgtgctagtaagtgaagaaggaaggatttgaacccaggtcaaaccttctttagaaggttggggagggaaaggagtgaatggatgctaaatctgacgctaactgattttactaccttggatctcgttgctcaatgcattatagtatttcgctgttcagcattttaacagcaaatcctcttatttaataaggcctggagcccacagtgtggctcctgatgcattgctgaggttatgtaaggtcctgcgccgctgcattacagccacca

SEQ ID NO: 31482 - DNA, 262 bp, Homo sapiens
cattaaattttctttaagggaagaggtcaaaggaatatctttaaaaggtaattattgtgattactctttgatccagcaatctaatttctaggaatttaatctaatgaaataattaaaaagaggcaaaacattatattaatagagctactcattgcattactatctataacagccataacaagaaatgacttaaagtttctaaggttatttcatacagtaataatatagctcatgctgattgattgctcatcatgtaccaggc

SEQ ID NO: 31483 - DNA, 399 bp, Homo sapiens
gaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgc

SEQ ID NO: 31484 - DNA, 477 bp, Homo sapiens
cacaatttaggaggttacagagttgaagacagtatgaattgttgtgaaggccaaaatcaaatgtgaaagttaggttctctgagaaaagggtaagcagaaaggatgatttctcaagcaattaataaggaattattttcttgtgccatgttctagatgcattgagcacagatcctcttgtcctaagctgtcctagaggctcaggttagcatctatccaaagttgtcctttgattttattgtctgaaagaacagaaggcatcagagtttccagtcactgaagagtagggtttgttcatcacttcccagcaatcacatcactttgtgtaggtaaggatatatgatgtgcttagattacttatgaagctctctctaagtgggagaatgacctgtccatgggacaactccccgttttcatggtcatttcagaagtacctctttttgggcagtgctcctggatctacttctacagcacattcta

SEQ ID NO: 31485 - DNA, 375 bp, Homo sapiens
tcactccagaaataaaaggccagtaggattagggactcactggtagtttggagtctcccagcacacatccctcctagtgggatgatctattcacatatctcccagcttttttatttttgcttctgtatatcacagtgagtggatggcccttcagctttttctctcctggccagacatgcagtcttgcctttagatatcgcagagacaaaattcacagcatgtcttaaatcttccaggatttgcaagaaccaaattgctcaacagtatgtatgtttagaggggttagactcctttttaaaatctggatatctaaccacctacttaaatctgtttgatagtgtcaaaccacccccacccttgatcctcccaccctcc

SEQ ID NO: 31486 - DNA, 276 bp, Homo sapiens
cctggctaagttggtgaaaccccgtctctactaaaaatacaaaaattagcggggtgcggtggcgggcgcttgtaatcccagctgctcgggaggccgaggcaggataatcgcttgagcccggtgggcggaggttgcagtgagccaagatcgtgccactgcactccagcctgggtgacagagtgagactctgtctcaaaacaaaaaccttcttataattcctgtaagagcttggtaactggtagcctcctgagttgagtgctgtagggtttgaggggc

SEQ ID NO: 31487 - DNA, 101 bp, Homo sapiens
tttgatttgcatttctctaatgatcagtgatgttgagcttttatatctatatttgctggccgcacgaatgtcttctttttagaactgtctgttcatgtctt

SEQ ID NO: 31488 - DNA, 322 bp, Homo sapiens
  misc_feature 125: w=a or t
  misc_feature 128: r=a or g
  misc_feature 136: k=g or t
  misc_feature 176: d=a or g or t
tttcagagtctgtgctgtttagctgatgacacaatctttcagctttaccatcccgagcagaatttcccaatgccacaatgctcatcttaaacatgaagactggtgaagtgatatgttgccattawtgratgcatckgttccagagattatgtcaccacaaaggagttaattggtcdtgttttgagggtcatgtttaattgcataggtcagcaaaggaagataaatgactacttctttaagtctgtgcctcactttttctctaagacagctgaaacagtacaatcgatttccttatcgccacagctggcaccatgagaatgac

SEQ ID NO: 31489 - DNA, 206 bp, Homo sapiens
  misc_feature 105: y=c or t
  misc_feature 126: k=g or t
  misc_feature 130: m=a or c
  misc_feature 137: m=a or c
tgaatgttagtgctggctcagctgtacctgaattccagagggagggggtataacaaggcctgtgtgacccttcttcccatcatgacctgagctcgtttttcaggytaactttggaatatccctttkggcmaataggmggggtcccttcagtcagttagggggcttagaattttatttttggtgtacgtgctcaaactgcagccgct

SEQ ID NO: 31490 - DNA, 376 bp, Homo sapiens
cataaggtcttcatcagaaatgcatttagtttattcaaccaagcattaccatttgagcaattgtctcatggaggtgaacactagataaataatcacataaccaaatatatccttacaaattgtggatgatgctatggaggaaaaatagccatgaaagttaacagagtgaggttttttttaaaattgggcattcaaaggtgacttgtctgaagaaataacatttaagctgaaacctgaaggataaattgaaattagcttattttttctaagtgtttaaataaccatattttgaatttttgcaaatcagtgtcatgctcattggtatagtatatagttcctgacatccattctcctgtaccctttccccgcccccagt

SEQ ID NO: 31491 - DNA, 250 bp, Homo sapiens
tgactttgatgactctgcccctcagcagggcttactaagcactaccccttaacagggatgactccgcactgcccctcaacagggatgactcagcagagatgactcagcactgtcccttagcagggatgacacagcaaggatgactcagcactgcccctcagcaaggatgactcagcactgccgctcaacagacatgactcagggatggcttagtactgcccctcagcagggatgactcagcaccgcctcc

SEQ ID NO: 31492 - DNA, 398 bp, Homo sapiens
  misc_feature 151: r=a or g
  misc_feature 185: k=g or t
  misc_feature 227: d=a or g or t
  misc_feature 228: r=a or g
  misc_feature 240: r=a or g
  misc_feature 272: k=g or t
  misc_feature 274: k=g or t
  misc_feature 280: k=g or t
  misc_feature 295: r=a or g
  misc_feature 304: k=g or t
  misc_feature 308: y=c or t
  misc_feature 336: k=g or t
  misc_feature 341: y=c or t
  misc_feature 374: r=a or g
ctttccagaaagtcaaattgtttctaatgtggaaatgaatatatgtgagatagcattgctgtctctagaatgtacatgtttataagtaaggaacttaatgcaaaacttgataggaaataagagtaaaaataaattgctttgccaagcaggrctcataaattttctttgcataaataacacattgkttatagaagatttggctaaatcctctaattcttctgcttcadrtacatgcacagrtattactgagtttttattgaaacttaaaaagkgktaatgkttaaaccacatttgrtattcaggktgcygaactgtagggcattaggagtcaatgtktaccyaaatttgactaaaatgtttaaggcacagaggcraaaagtggaggaattttgagttgt

SEQ ID NO: 31493 - DNA, 491 bp, Homo sapiens
caactgttaacacaatggtgtttgatattcgaattaaagccataaaggaattaaaattaatgaaggaactaggtaatcatttacattttcttttcggttcttagtttagcttaattttggtcttgaaattgaagaaaatataggagaatacaaaaaacagtttagggagaactcacatacctaccacccaaaatggacaaatattaacattttgtcatatgtttgtttttgtttgaaacattataaatgaagttaaagtcccctgtgttctcctcctcagacctattctttctctccttccccagatacaatgagtatatctgatgtgggtgtgtatctagtccatgtattcatgttgtactatactgaatgtatattctgcaaactcactattcacttaccattaggctttctgtgacagccttattaagatataatctacataccataaaattcactcagtttaagtgtttaattcagtaatcatcagt

SEQ ID NO: 31494 - DNA, 106 bp, Homo sapiens
ttttgttttctgtaaggaccatcctcattactggagtgtcaaatggttccccattatagttctaattgatgtacttttatgttcttttttctctgctttttttttt

SEQ ID NO: 31495 - DNA, 238 bp, Homo sapiens
tgttttaaactattaagtttgtggtaagttgttatggcaacactaggaaactaatatagctaacaaatggcaagtctgggatttaagccttggtctgaggctaaaatttatactttttttgtgatgccatgatcatgtgacttcaagcactaaatactaattcatgggtacatatatataaggcacccagggccgggcgcggtggctcacgcctgtaatcccagcactttgggaggct

SEQ ID NO: 31496 - DNA, 229 bp, Homo sapiens
  misc_feature 72: n=a, g, c or t
  misc_feature 162: k=g or t
aaactcgggtaaagctcctcggcctcggcgtgctgcgcctccgcggctgccctgcgccagaattcggttccntcaaaattataaaagcaggaaagctcaagacaaagaaatccaacaaggctagtgatttcagtgatatggagaattggccaacacccaagkgaattagtgaacactggatttcagagcgtcctcagccaaggaaataaaaagccacaaaatagaaaag

SEQ ID NO: 31497 - DNA, 235 bp, Homo sapiens
caagttgacactcagtattaaccatcacaactactgaaaaagcattaaaattctgtaaacattaatggtcttcctgcatcctgtttataagcaaatttgaaatttaaaaaatgtgtgtgatgttagaaggcagcaataaatgtagaaaattaaaaactttgcttagccaataaattcagtcatctctgacagttaatgaatgattatacattaaatacatatagaagggggcgcc

SEQ ID NO: 31498 - DNA, 225 bp, Homo sapiens
  misc_feature 170: n=a, g, c or t
ggctgcataaatgtcttcttttgagaagtgtctgttcatgtccttcacccactttttgatggggttgtttgtttttttcttgtaaatttgtttgagttcattgtagattctggatattagccctttgtcagatgagtaggttgtgaaaattttcccccattttttgggtngcctgttcactctgatggtagtttcttttgctgtgcagaagctctttagtttaat

SEQ ID NO: 31499 - DNA, 459 bp, Homo sapiens
  misc_feature 398: s=g or c
  misc_feature 400: n=a, g, c or t
ccattctggtcgatcaaaccaaacaatgtttccattgttttgcatgcagaggaaccttatattgaaaatgaagagccagagccagagccggagccagctgcaaaacaaactgaggcaccaagaatgttgccagttgttactgaatcatctacaagtccatatgttacctcatacaagtcacctgtcaccactttagataagagcactggcattgggatctctacagaatcagaagatgttcctcagctctcaggtgaaactgcgatagaaaaacccgaagagtttggaaagcacccagagagttggaataatgatgacattttgaaaaaaaattttagatattaattcacaagtgcaacaggcacttcttagtgacaccagcaacccagcatatagasgngatattgaagcctctaaagatcacctaaaacgaagccttgctctagcagcagcagcaga

SEQ ID NO: 31500 - DNA, 165 bp, Homo sapiens
  misc_feature 127: r=a or g
  misc_feature 128: w=a or t
aatgaaagtaagaaaatttatataaaacctattttttcttaaagccactaatgaataaggctgatatatcattttatgaaattatagacatttatttaaaataaattttaagttgtgcaaatacagrwattatttgaaataattgacaggtctatagccatacca

SEQ ID NO: 31501 - DNA, 198 bp, Homo sapiens
  misc_feature 130: s=g or c
cgcgggacacagctccggggaccggggtctgactcccttaaacgtaagcacgtgtgggggcccccatagtatttttcagggacccttcacattttctgccgaagcaatggcccagtgttttgaagggcgscggtggaaacctccgaacccagcaccccactccctctgagcacggcccgcgccaggccagcccacccc

SEQ ID NO: 31502 - DNA, 153 bp, Homo sapiens
tatcagatttcatggtaagacttgtcactatccaaaaggagaaaaaagtaatcagaagaacatggcaaatattaagattggaaagaattatgatagaaaaaatacaaatatgaatggactaactctccaggtgagagattgccagatgtggaa

SEQ ID NO: 31503 - DNA, 432 bp, Homo sapiens
  misc_feature 127: r=a or g
  misc_feature 172: n=a, g, c or t
ggcacggaaatgtttcttaatatgcacgtgagtctccagagtacaggaaatgtgctttcctctaaatggtcaatgtaaagaatcttaaggatatttcttgtgttgaaatttacattcgattttgtgrattacacttggaaatatgtgttaaattgggtttttaattgtagcncaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaa

SEQ ID NO: 31504 - DNA, 340 bp, Homo sapiens
ccaatttcaaactgtaagtcatttttctgtgtactttgtttttgtaatatccatgctacttcagatgtcaatgacattgtctttggcaacaaatgtcttgtaaagcacttttctctgaactaagcagcattttatgataattttatccattgaaatatataatcataatatctttgccatcacttttagaatctaattttttcaagaaggaaatgaatatgtaaaaatgaaagaaaaggccaactgtattgaagatacaaaatagagttggtagcggtatatagaagaaaaatcaagaggcttctgtgtagaaaaccaatttgtaatttaaggatcgggt

SEQ ID NO: 31505 - DNA, 188 bp, Homo sapiens
  misc_feature 126: d=a or g or t
tattatgcagccataaaaaggaaacagatcgtgtcctttgcagggctgtggatggagctggaagccattatcctcagcaaactaacacaggaacagaaaactaaacactgtgtgttctcacttatdaagtgggagctgaacaatgagaacacatggacacagggagaggaacaatacacaccggggcc

SEQ ID NO: 31506 - DNA, 404 bp, Homo sapiens
  misc_feature 148: r=a or g
  misc_feature 150: w=a or t
  misc_feature 152: r=a or g
  misc_feature 154: k=g or t
  misc_feature 371: r=a or g
ccacaaaagttagccttagagtttttttccccctgaagttttaatttttttaaaaaccaaatctaaggaagttttcctcagctcattaattagaagcagaatttgtaaaagtataaaagttttcaagcactcgtctttgcctttgagrawargkggttttttaaaagaatcactctcaacaggggagatgtcctctagtcgtttttcttctgcctctcctgggaagggttcaaagttcatttttctaaaatgctgaccctcaagcataaggaggaagagtcaaagttaatggccagagttcatatactcagatgaaaccagtcttcccaaggcctcaggctccaaaaaaggttgtagctatcaaaaagtgrccaaagtgggaaagggagaaaggataagcttaa

SEQ ID NO: 31507 - DNA, 79 bp, Homo sapiens
tccgagcctcttattaaatattaggttgatgagatgatgcatgcaaagcgcttagaacagtactaggcataaagcgtcc

SEQ ID NO: 31508 - DNA, 350 bp, Homo sapiens
  misc_feature 146: r=a or g
  misc_feature 154: w=a or t
  misc_feature 157: r=a or g
  misc_feature 160: w=a or t
  misc_feature 187: n=a, g, c or t
catcttttctcacccagagaataatatataaaccaaattggtttacttatgtgtaaaatatgtagtagagatatttttgagcatgaggtgctttggtgttactttttcttttaaaatgcagggaatttaatagtatgcagtttcarggtgtgtwaarggwaatcttttggtggatgaaatatatttngtggatgaatatgctgtgatttgcttacacccaccccaaatccattttgcagcaccctactcactgtccagagattctgggaaaaaacaatagagaagacaaagccagtctagacaccatttgactctaccttgtgaatattctgaaagttacattaggctaa

SEQ ID NO: 31509 - DNA, 143 bp, Homo sapiens
tatgtttgtgttggccttgtgcactctgaaagatgaggcaggtggctggccaggctcacagtggtgcctgccttaggacttatgggcagccctttgtctggacaaaggtgacagaccaacagttattgacttagtaacagctc

SEQ ID NO: 31510 - DNA, 215 bp, Homo sapiens
  misc_feature 122: w=a or t
  misc_feature 124: k=g or t
  misc_feature 126: k=g or t
cacatttgcattttctctgttcaacaagcagaacaggataattcagacaacaacaccatctttgtgcaaggcctgggtgagaatgttacaattgagtctgtggctgattacttcaagcagawtkgkaattaattaagacaaacaagaaaacgggacagcccatgattaatttgtacacagacagggaaactggcaagctgaagggagaggcaaac

SEQ ID NO: 31511 - DNA, 427 bp, Homo sapiens
  misc_feature 131: y=c or t
  misc_feature 133: w=a or t
  misc_feature 134: s=g or c
  misc_feature 160: k=g or t
  misc_feature 394: w=a or t
  misc_feature 395: b=c or g or t
ctcggcccccgcgccagttttgggctggttggcgcggaatcgggagattcgggaccatggcacctgtgcacggcgacgactgtgagataggggcgagtgctctgtcagattcagggagttttgtaatcctycwsgagcccggcgaaaaaaaaaatcaaakaaggggcgccaagaagccctagaaagactgaaaaaggctaaagctggtgagaagtataaatatgaagtcgaggacttcacaggtgtttatgaagaagttgatgaagaacagtattcgaagctggttcaggcacgccaggatgatgactggattgtggatgatgatggtattggctatgtggaagatggccgagagatttttgatgatgaccttgaagatgatgcccttgatgcwbatgagaaaggaaagatggtaaagcacgcaatg

SEQ ID NO: 31512 - DNA, 384 bp, Homo sapiens
  misc_feature 120: w=a or t
  misc_feature 314: r=a or g
  misc_feature 327: h=a or c or t
  misc_feature 328: k=g or t
aaaattaagcataccaaaaaaattcttaaaccttacagggaaataaaggtggagaataaaagaaacaggacagtaattttaaaaaagtattctgtatcacacataattatatatggtatwctttttctaccactggcagtaaaggtctgtttatagcagcatcaccacaaacacacaagtaatgtgttgtgctaagaagttatgaagtctacaacatcactagatgactggtaatttttttttattagatgcaatcattgtaatttttatgttgtagagtgctagattttttgttctagtgtataattaagtarcttgaagaacaghktaatcctttagaagcttgtttttaagttttgttgtgtgtggtttgttattaatagt

SEQ ID NO: 31513 - DNA, 200 bp, Homo sapiens
  misc_feature 116: r=a or g
  misc_feature 119: m=a or c
caaattcacacataacaatattaactttaaatgtaaatgggctaaatgctccaattaaaagacaaagactggcaaattggatagagtcaagacccatcagtgtgctgtattcaggraamcccattcctcaacgggcagagacacatataaggctcaaaataaagggatggaggaagatctaccaagcaaatggaaaacgc

SEQ ID NO: 31514 - DNA, 404 bp, Homo sapiens
  misc_feature 126: m=a or c
  misc_feature 132: v=a or c or g
  misc_feature 155: k=g or t
ttttctccttccctgggaccaactttagaaaatagataggaacttaatagcaaaaatcatgttaaatggttttgtggttttagactgcgtctctcttttgcaaattccttttctgtgaaagaaaamctttgvaacacattgctatttgacatttkattaatttggtgggtttgagggagaagggtgagtttcagttttgaagttaaagaattttacaatttaggagggactgaccctacagatggcctgtctcctggtttccttcgcctcaatagaaactgcccttgtcgacgtcccaaatggcctctgatcattgaagcctgttgtcacttgttagtccttgacatgacttttcctgtagtatttgattctgctgatcattcctcatcaaagctgtctcttct

SEQ ID NO: 31515 - DNA, 249 bp, Homo sapiens
  misc_feature 118: m=a or c
  misc_feature 123: k=g or t
  misc_feature 126: k=g or t
  misc_feature 128: k=g or t
  misc_feature 129: y=c or t
aaagtcatccctgatcccaccagtgaagagttactatcctaccaacatttttctaagcatatatacaactttaagacaagcacgaaagaataatactgtgccaggcgcggtggctcamgcctkgtkgkycccaacagtttgggaggccgaggcgggtggatcacttgaggccaggatttcgagattagcttggccaacatggtgaaaccccgtctctactaaaaatacgagaattagcgactcccagca

SEQ ID NO: 31516 - DNA, 75 bp, Homo sapiens
  misc_feature 2: s=g or c
  misc_feature 65: y=c or t
astttctgctctgtgtctgcccattgccacgatccaggaggactccgcgccgcccggctgcctcygagctcgggc

SEQ ID NO: 31517 - DNA, 72 bp, Homo sapiens
caggctgagttctactatttgccatttctgttactcatttcttactgattcagagtttcatttttttttttt

SEQ ID NO: 31518 - DNA, 79 bp, Homo sapiens
ctggtagaggctaatgatttatactttgagattaatagcttgtagattattttcttttctttttctttctttttttttt

SEQ ID NO: 31519 - DNA, 114 bp, Homo sapiens
ctgctccacatccaccctctaaccccgacccctgctacaaccccagaggccggactcctggattcatctccctagcttccctgggcctgccttagccgccagtcgctgccgagt

SEQ ID NO: 31520 - DNA, 302 bp, Homo sapiens
  misc_feature 130: s=g or c
  misc_feature 142: s=g or c
  misc_feature 144: d=a or g or t
  misc_feature 281: k=g or t
  misc_feature 287: s=g or c
  misc_feature 291: s=g or c
  misc_feature 294: s=g or c
gcaaaatggcggaaccgccgagccccgtgcactgtgtcgctgccgcggcccccaccgccaccgtctcggagaaagaaccgtttggcaagctgcaactctcctcccgggaccctccgggttctctgtccgscaagaaaggtcsgdactgaggagaagaaggcaccgcggagagtgaacggagaagggggcagcggcgggaacagcaggcagctgcagccgccggcagcaccttcgcctcagagctatggcagccccgcgtcttggagctttgcccctctgtktgctgstccstcsccgtccac

SEQ ID NO: 31521 - DNA, 140 bp, Homo sapiens
  misc_feature 132: s=g or c
  misc_feature 139: y=c or t
tgtgtaaatgtcccccatgtttctgaaaagtgctgtagtttagtcccctcacccccagcactgcccaaacaggggccaagtgcgccccaattccaagaatgaaggcagagcgacaacagtgcggacaacccsggctgayt

SEQ ID NO: 31522 - DNA, 224 bp, Homo sapiens
  misc_feature 104: r=a or g
  misc_feature 133: r=a or g
  misc_feature 137: w=a or t
  misc_feature 138: r=a or g
ttgtgtatttcagttattgtccctggcttccttactatggtgtaatcatgaaggagtgaaacatcatagaaactgtctagcacttccttgccagtctttagtgrtcaggaaccatagttgacagttccaatcragtwrgctttaggaaaaaaaccgtgtttgtctcttctggaatggttagaagtgagggagtttgccccgttctgtttgtagagtctcatagt

SEQ ID NO: 31523 - DNA, 117 bp, Homo sapiens
tatgagagatataatataaagatataatatagggatactaagcatatccctctaaatagaagggatctccactaccttaagcctataaaacagtcagagctagtatagcagctgcct

SEQ ID NO: 31524 - DNA, 181 bp, Homo sapiens
agaaaatctaagtgcagtattctttctcagtattccaagatctgtgggggaaacgtaggtagtattctttgtgccatgcccttttagacagttttgctagctgacatagaaataatacacaaacaagggagatatacccaaagggattttgtgtcctcctttgtttttgagacccaggaca

SEQ ID NO: 31525 - DNA, 86 bp, Homo sapiens
  misc_feature 5: s=g or c
cggasggaggcgagggtgggtgagcaaagggattgggtctgtggggtccaggcccgaacccctgaagacgggctccgcccccggct

SEQ ID NO: 31526 - DNA, 310 bp, Homo sapiens
aactatatttagaatatggcaattctacaaaactaccttcaaataaatttaacattctttcagattttttccggaaaatataaaatttcttacttttctttttcttctttgaccgttttatcctcaagttctaaaatataaaatttcaaagatgacattgtaattgccattttcagtgatgtgccatctttgcttaagtatttaagttttagataggaagtatagagacactcagcagagtctgggcaatgactctaataactagaagatatacagtgtttatataaaatttgagaatcagacagcccaa

SEQ ID NO: 31527 - DNA, 260 bp, Homo sapiens
atactaaattgtgaagattcaaacagaacgatcacagttcacccagccacccctggccgtacaccagtagggatgaccagaggttttgctacatgtccgactgaaggaatggctgcctcccatgtggaaagcagctcttggtttagaacaaaatctcaccgagtccagctcgagcctcagcgattttcaccgagatgcttggggtaaaggttgcattttccccctccagggagggggaagtccagatacttaggaggcct

SEQ ID NO: 31528 - DNA, 374 bp, Homo sapiens
  misc_feature 334: w=a or t
  misc_feature 335: d=a or g or t
ccaactgagtaataagcaacttgtctttggcttaaccttttgccagacgtggggtgttcagataagtaatcagatatgtagggataaacaatatgggaaataagaggaaactacagcaaataacctttttaaatttgagctgaagtcattgtgaaggaatgtgctttgtctgtagtgttgctccttgttcatattgaagcttatgtacagcacttagctgtctgacctttcacggcagctttgaatcatacattttcttttgaggaatttgttaggcttcttattgaaataaagtctcagtcttagacatcatcaggaagaataatatctcccwdataaatgtttacatgagcttgagaaaagaacagtggcct

SEQ ID NO: 31529 - DNA, 338 bp, Homo sapiens
  misc_feature 336: w=a or t
  misc_feature 337: s=g or c
tttagaaatattcagccaagtttagcttcaaattactttattgtgatgactttgacacagaaggtactgaataaatattttttaccatgggctgggcatggtcacttatgcctgtaatcccaacaacttgggaggctgaggtgggaagatccttgagcccaggagttgaagaccagcctgggcaacatagtgagaccctctctctacaaaaaaaagaaaattaatattagctgggtgtggtggcacacacctcacttgagcccaggaggtcgaggctgcagtgagctgtgatcgcaccactgcattccagccaaggtgacagagccaaaaccgtcwsa

SEQ ID NO: 31530 - DNA, 190 bp, Homo sapiens
tatctagtgctttcttgtcttgactcagtttcattttcctaaccacataaatgctgacgtctcatttgttttcttataatttgcagttgttctgtgagaatcgtgactgaaatatgaaaaatattttaaaatttaaggttttcaactcaaataccattgtagcatgcttggtaccagaatgtcccccagc

SEQ ID NO: 31531 - DNA, 190 bp, Homo sapiens
  misc_feature 145: n=a, g, c or t
  misc_feature 146: y=c or t
cagcaactatttttcatacagtaaaatgttactaatttagattaagggagtgctgggggaagacactgatgccgaaactgaacaaatgttttaaaagaaatgcaggtttattatccagcactgagagagttaacaaggactgganyaataaggctaacaaagaataggatgtgaatgttttcaagggccc

SEQ ID NO: 31532 - DNA, 295 bp, Homo sapiens
atttcatcctttggaggcttacatgaatgatgtaggatcaaattcacctctccaggctttcccccccgaccccctaggctgaaagcattttaaggggagatggaggcaaacgccatttttgagttgcactgaactcagttaaaaccttgatcctgctgtttcttactcatgtgacttgctttagttatcttaatttttgcactttgttttccttccttgcagaaaggatacaatactacttcatacatgttctattgaggatcagactaaatgagattaagaggtaaagcgccga

SEQ ID NO: 31533 - DNA, 333 bp, Homo sapiens
  misc_feature 333: r=a or g
agtcgagatggaggaagatgcgaccggcagacggcattcgctgggaacgacggatagactgggggctgcggcctagaggtccgggcttggagttcgcctcagacgcggtggagccgccggagtctgagaaggtaagaagccgccggcttgaggtccctgacaactaaggtctctgaggatctgcacttgtcagggaggcaaaggatgcctggggtgtcaggctgcggtaccatgcagttttgggaatgaaggacaactgcggtgaggcgtctcttcctggcagaggatcgtgagattcgctgacagcgaagaagcacggcaaggggcataggr

SEQ ID NO: 31534 - DNA, 197 bp, Homo sapiens
  misc_feature 30: k=g or t
  misc_feature 31: r=a or g
  misc_feature 149: r=a or g
caatatttcgaactttttcattattattakrtattattttacccagtgatcagtgatctttgatgttactattgtaattgttttgggcacctcaagccacacccatataagatgctgaacttaatcgataaatgttgtgtgtggtctgrctgttccatcaacacaccattcccatctcacactttccttgggccgga

SEQ ID NO: 31535 - DNA, 167 bp, Homo sapiens
gaaattagttggatattgtggcactcacctgtggtcccagctacccaggaggctggggtgggaggatcgcttgagcccaggaggttgatgctgcagtgagccgagatcacgtcactgcattccagcctgggtgacagagtgagaccctgtcttaaaaaaaaaaaaaa

SEQ ID NO: 31536 - DNA, 425 bp, Homo sapiens
  misc_feature 108: r=a or g
  misc_feature 116: m=a or c
  misc_feature 283: r=a or g
  misc_feature 360: w=a or t
  misc_feature 375: r=a or g
cagaataactgtaaggggttgtaagtttacctgtcctgcagatgaaaagattacttggcatgggaatgattggcaaaggcctgctggaagaaatgggacttgaaatgracctcaamcaatgggcaacggatgtggggtgaggtttggaaagttcccaagaccactctcaggttcaaaaatttgctagagggacttgcaaaattcagcaaagttgttacactcatagttactgtttgttacagcaaaaacaacaacaacaaaaactttcaaaaaactacacagrttaaaatcaacagcagaaaaggcacataggacagggactaggagagttccacgagtgagctttcagttgtcctttcwcagtggaattgtggrcagcacttactgctcccagcagtgatgtgtggtaacacgcatggagtatt

SEQ ID NO: 31537 - DNA, 282 bp, Homo sapiens
caactctcgggacagcattcctcacagagaccaagctgatccatttcctcaggactcagttaggtgtgcccagacgcactgacaaaatgacgtgacttcagggaagcctggacacccgaggcacctggaccagctatgggtagttctgtgggtggaacacattctgtgtaagagccccactgagggctctgcagcggagtgacagcaaccccagagatgaggcaccagagagtgccactgcatgagacacctgtgaccattcgaagtctgaaatgcggggac

SEQ ID NO: 31538 - DNA, 294 bp, Homo sapiens
  misc_feature 103: s=g or c
  misc_feature 107: s=g or c
  misc_feature 217: s=g or c
  misc_feature 271: h=a or c or t
  misc_feature 272: n=a, g, c or t
  misc_feature 273: s=g or c
ccactctctgcagccgcccgcacccgggcctccgtggccgtgtcatcctttgagcatgccggcccctcccttcccggcctttcgccgggagcctgctccctgsctgsccgcgtcggaggaggaggcctgggatctggacgtcaagcaaatttccctgggtgaggcacctctcaaggggtggctcccaacagctcggtcatggtggtgatgttcaggstgcttgctgctgagcaattcctttttctagccaagaagcccagttgccatgachnstatgtacagcttccccaccga

SEQ ID NO: 31539 - DNA, 166 bp, Homo sapiens
ccgcccgcctcagcctcccaaggtgctgacattacaggcgtgagctaccatgccctgatgagaaacatttcttaatgaaatggacagccgtatagtgaataggggatgaagagcaagaatttctgtcactccagtcctcagctttttttttttttttttttttttt

SEQ ID NO: 31540 - DNA, 393 bp, Homo sapiens
  misc_feature 47: s=g or c
  misc_feature 106: n=a, g, c or t
ctttttaggtttttagtagagacaaggtctcactatgttgcccaggstggtcttgaactcctaagctcaagcagtcctcccgccttggcctctgaatgtgctgggnttacaggcatgagccactatgcctaaccatattttttccaatattaaaaaatctttttttccccctaaggaatgtgttatataaggtcaacatgtttttagtgcttcagtttgacttgtctacatctaaagttaactctttaaggcttacatttatgattataattctttccatcgagggatttagtctccattattgtcatgtttcttgatttttttcattatacttggttcttctttttgtctaggttttatatataccttaattaattctttcttggctgtttc

SEQ ID NO: 31541 - DNA, 154 bp, Homo sapiens
cacaaagtttgttccctaaggaaatcaaatcccattgtcacctaactctgaagatctaaatagcccttggatcagtacgggaaccccaaatcccacagggccagatgtggagtctgtgtctgcccccgtcttctctccatcctcaaagcacccc

SEQ ID NO: 31542 - DNA, 251 bp, Homo sapiens
aaataatctgcacaccaaacccctgtgacatgcagtttacgtatatgacaaacatgcacatgtacccctgaacctaaaattaaaaaacaaattaccaggactgaatctatattgaaggcaggaattcagagagagaagcagagtattaaagactgcttttcttctgaggacatttgccacattctgaggagcttttactttgcttttgaaggcctcacaaggcacaggatatagaaatggaagcccaggat

SEQ ID NO: 31543 - DNA, 357 bp, Homo sapiens
  misc_feature 117: h=a or c or t
  misc_feature 257: s=g or c
tcatgtctattaggagtgtaaaagggcattcatgtatcaaaggcgctgacatatttgttgtaatgatattgtcataattaaaaggctgtagaatctaggtattgtgggggtggctthgaagaagtatctacttagtcgtgttgaataaaatttttaaatttcgcagagaaaccctaggatactgagtcattaattgaaggagtcaactttggggctggacttatggttgtgtcttatagcagtataaatctgcgcascagtagtatgtaagggattgcagaaagaatttaatttcatagaacccattattaatatgagagttacaaaatgatactgattttgatttagcatgcctga

SEQ ID NO: 31544 - DNA, 407 bp, Homo sapiens
  misc_feature 121: r=a or g
ttatctgcaacatctttgactacctgagggtgaacaacatgcccatgatggccctggtgaaccctgtctatgactgcctcttccggctggcccagccagacagtttgagcaaggaggaggraggtggactgtttggtgctgcagctgcaccgggttggggagcagctggagaaaatgaatgggcagcgcatggatgagctctttgtgctgatccgggatggcttcctgctcccaactggcctcagctccctggcccagctgctgctgctggagatcattgagttccgggcggccggctggaagacaacgccagctgcccacaagtattactacagcgaagtctccgactaggcctccagatcagggcttcctcaccagcactggcctttcttctacccacctctaga

SEQ ID NO: 31545 - DNA, 349 bp, Homo sapiens
ttcaattttaatttttattcagcctcttacctttttgctaaaaccaaaagttcaaaagaaaggtgatcagggcactcccaggaattttttagccatgtgagaatatatggtgaaatgattcaagtagatgcaacatggtctactggaaaagcactgagattttgaggagaaaacttagctctgccattagttaattgtcatcaaggtcttcctatgaaaattgtagttcaattttcaaacatttattgtttttctccaaagtgctaggcatatgcttttgtgctggagatgaaagatgaataacatgtaggtgctgtttttgaagaacatcactgaagagagagtgcgc

SEQ ID NO: 31546 - DNA, 314 bp, Homo sapiens
tacaagatatagtgcgtgcatgagtatgcgtgtattttttcatttttaaactcagtttgctacacaagtcatctgtcacttctagttacaataggcgttttacttggttttcgtattcctgttcgggaatgttaaagattccaaaaatacttagtttaaaaacaagcccagtagtttctctgagagtgtatttactttttaagtttaagaagctgccaaatggttcgcaattctgactccttggagagtagaggtaagaagccctttcctcacactgttctgttacaaccacttgattctaaccatttcccccc

SEQ ID NO: 31547 - DNA, 435 bp, Homo sapiens
  misc_feature 349: r=a or g
ctcaacaagtaaacagatgtagagcatgttatcatattttgaacatttcttaaaagaggtagattcaccttaaacacatttctttatacatagatgttcactaaaatgaatcattaaagtgatttattttaatagctcttttatcactaatggatgttgacctcagcccattattttgtgcttctccatactctttctggttggattttagcatgtttccgaagtgatcctaagatcttaaatgggctaaagatgtttcaagttctctaacatccttttattgtgataaaatatgcataacataacatttagcatcctaaccatttttaagtgtagaatttaagtggcrataagaactttcgcattgggccaggtgcagtggctcacacctgtaatcccagcaatttgggaggccaagatgggcagatcgcttga

SEQ ID NO: 31548 - DNA, 178 bp, Homo sapiens
cagtggggagagatatttactaaatgatcacacaaataaatgtgacatgtctatgaaggaaaggcataaagtgccaataggggggttagagatagcttccccctaaaaaggcaatgaagctaagatctaaggaagcagtaggagttaactaagcaaagaagaaaacaaaggggagcaa

SEQ ID NO: 31549 - DNA, 189 bp, Homo sapiens
  misc_feature 134: r=a or g
  misc_feature 135: m=a or c
  misc_feature 149: k=g or t
  misc_feature 160: k=g or t
  misc_feature 165: k=g or t
  misc_feature 167: k=g or t
gcgcgcggtcagctgttggcggtgcagggaggaggacgccggggctcgccttccctcctctgccgccgctgccgccatgattccggtgtcgctggtggtggtggtggtgggtggctggactgtcgtctacctgrmcgacttggtgcctkaagtcatctgkctatktkaaacattcttatggagactggc

SEQ ID NO: 31550 - DNA, 225 bp, Homo sapiens
  misc_feature 143: k=g or t
  misc_feature 150: k=g or t
  misc_feature 162: k=g or t
  misc_feature 173: r=a or g
cttgttaatgtctttcagaagagttttagggtttccatcatatagatcttacacgtcttttgttagataacagatctttgtattttgttcctaaatacttcagacatttgtattgccattgtaaatgggatctttcttccatkttctagkttagttattggkggtacatctgraaagcatttgaggtttgtgtgctgctctcttgattttgtttctagccaccaa

SEQ ID NO: 31551 - DNA, 287 bp, Homo sapiens
atagtaatgtgtatcttttggtatccagttttatttttggccttctaagaaagtgtctcataacacagaacattgccatttgctcttgtaggcctcaaatatgaaagctattagtcatagagcctaggaaaaaaagaattgattaatggtccttttattttgtaaccttataaatgctgtagatattatcaaaaaaaattttaatttcatattgtttacatcatgcaactaatctaagcctcaaactcgttattggggctataaagaaaacgtttacttacccagct

SEQ ID NO: 31552 - DNA, 319 bp, Homo sapiens
atcctgctgcccaacatggcggagttcgacaccatctcggaactggaggaggaggaggaagaagaagcggcaacgtcgtcgtcgtcgccgtcgtcgtcgtcgtcggtatctggggcccgacgatgacgaggaggatgaggaggaagaggaggaagaggaggaggaggaagaagaggaggaggaggaagaggaggaggaagcgccgcccccgcctcgggtagtgagcgaggagcatctgcggagatatgctcccgaccctgtattagtgcggggtgccggccacatcactgtgtttggcttgagcaacaagtttgatact

SEQ ID NO: 31553 - DNA, 441 bp, Homo sapiens
  misc_feature 111: r=a or g
  misc_feature 113: s=g or c
  misc_feature 114: m=a or c
cacttgatgatagacttgaaaattgacttgagaaactgcacagtttctgtgcaacattatataggatatctttacaaaggacaacattcgaagcaagaaattggagcttargsmagtattacactttctatcttacctatactactctctgagaaacccatttctagcctgtacagcatagcttgtaaactgtgatcttcgactagtatgaataagtcttgtgttgagtttaatttcagaggccgggagtttatcagctgagccatctcacctgcattccttgcaagtcattagagccttagatgcctggcttggctttgggcttctccagcagagagcagtgaaacactgtcaataaacctaattctggaaaccagagtagattccaagttgggaaaaaagcaaaggcagaactagcaggctcatcagagttataaagaa

SEQ ID NO: 31554 - DNA, 447 bp, Homo sapiens
  misc_feature 115: s=g or c
  misc_feature 117: m=a or c
  misc_feature 323: n=a, g, c or t
  misc_feature 410: n=a, g, c or t
tatgtcttttgaatttgtgatgtacatattaacagtagattaagttgaaataataaaatctgtattgtttatgatttatcagttatatgatgagtagaatatagtctattgtggscmagtgtgtatatataacataaacaatacattaacccaattttgtgtgaaaattattttgggacctagtagctttcttggtcacaacctttcaaacaaacaaattttttttaaattaattttttcccttaataaagaaaacaattcctcaatgtgtaatagcaaataccttttaacaggtcatatatcatcaatgctttctttgaaancgtactgatgcttacaagatgctttacgagtaaagatgcttacaaatcttttctttcaagtagctcatcctctgatcattattctgntgtttgatatctactccctagcatttatccatgacgt

SEQ ID NO: 31555 - DNA, 242 bp, Homo sapiens
  misc_feature 109: r=a or g
  misc_feature 115: r=a or g
  misc_feature 117: k=g or t
taatgaaaaatgattacttaatattatcaaatatcaagttagatgtcaaatttctcaattaccacaaccattattaagtgagtcaaattaatcatatttctttttttgrgacggraktcttgctctgtctcccaggctggagtgcagtggtgtgatcttggctcactgcaagctccgcctcccaggttcacgctattctcctccctcagcctcccgagtagctgggactacaggcacctgcc

SEQ ID NO: 31556 - DNA, 139 bp, Homo sapiens
  misc_feature 107: s=g or c
acttcattcacttgcaaatcagtgtgtgcccacaagagccagctctcccgagcccgtaaccttcgcatcccaagagctgcagtttcagccgcgacagcaagaacggsagaagcgggcgaacggcggcggcggcggcggc

SEQ ID NO: 31557 - DNA, 215 bp, Homo sapiens
  misc_feature 109: k=g or t
  misc_feature 114: k=g or t
acagaaggaatgaagtctgatatagaactagggatggccgtattggtgatggcaggtaagagtccctaattctttggcaaatgtgcaccagctgtgtatagaaacccakatttktggatgtctcttcagcaagaggtaaaggaagctgcaactacagccagaaggcatcacaggaggcctctgcatgatgtggcttccaaagactcaaggaccac

SEQ ID NO: 31558 - DNA, 463 bp, Homo sapiens
  misc_feature 12: m=a or c
  misc_feature 114: w=a or t
  misc_feature 119: d=a or g or t
  misc_feature 122: k=g or t
  misc_feature 230: s=g or c
  misc_feature 231: b=c or g or t
  misc_feature 299: k=g or t
  misc_feature 327: v=a or c or g
  misc_feature 379: h=a or c or t
  misc_feature 381: y=c or t
  misc_feature 388: n=a, g, c or t
  misc_feature 408: n=a, g, c or t
  misc_feature 409: n=a, g, c or t
  misc_feature 411: y=c or t
tttatgcttgamtcttgacttaccagttctgaggatggatggtacacagcacctttcccagggaaaaggtcttaactttggatttcattctgaaatgaaagtggtttatgggawttttdctkgtaagtccaaagataatacatactatgtgtaggacaatcaaggaatacagaaaattataagaaagtaaagctgacatcccaccactgtggaataacttggtgaatatsbattagtcatgcaggaaacatttaacatacttaatagataaacatacttaacagataaaccacaaatakatataggagaatggaaccatagagggcvtgccaccttggaaccagcgtctttgccttgacaaaatgatgtgtgttgtaghcytcttgcntggcccacctgtcagcctanntycggcctttacagggaattagcaggagtcagttcaataatgacatttcttctt

SEQ ID NO: 31559 - DNA, 453 bp, Homo sapiens
  misc_feature 21: s=g or c
  misc_feature 98: n=a, g, c or t
  misc_feature 114: r=a or g
  misc_feature 157: b=c or g or t
gtggctcgggctcgggcggastggagacgtgtggagctgttcgaggactcgcgggtgtgcagtgcacctatgatatgtgttttagaaatagccattanactttggtttgaattraagaatgtctctcaatccacctatatttctcaaacgaagtgabagaaaatagttcaaaatttgtggaaacaaaacagtcacaaactacttccatagcttcagaagatccccttcaaaacttatgtttagcatctcaagaagttcttcaaaaagctcagcaaagtgggagatcaaaatgtctcaaatgtggtggttccagaatgttctactgctatacatgttatgttccagttgaaaatgtacctattgaacagattccacttgtgaagcttccattgaagattgacatcattaaacatccaaatgaaacagatggcaaaagtactgctatacatgcaa

SEQ ID NO: 31560 - DNA, 428 bp, Homo sapiens
  misc_feature 129: w=a or t
  misc_feature 224: d=a or g or t
  misc_feature 225: v=a or c or g
  misc_feature 226: d=a or g or t
  misc_feature 418: s=g or c
cacatttcaaagctaagtttttgtcaaaattaacatttgttatgcaaaatatcatgtacatgaagtttttgttgtacattcatttctgtagcatataaccttaatggtgggggttttccaatatttggwattttcatataaatgcaaggcacaacatgaaagcaagaacaaagaaccaatctatttttagatcattgtctttcagtgggttggagtgatgagadvdgagggaggccctatcctaccccatgctggcatatcaggatctctgggggaacttttcaaactgctcattttctttggccccagtaggaagcaccaggtgtaatgtgagcttttgcctgacaggagtgtactattcttgaagaatattgaagcagaaaaaatgagagtactgttggaggaagaagttaatagstgatctgatt

SEQ ID NO: 31561 - DNA, 481 bp, Homo sapiens
  misc_feature 109: r=a or g
  misc_feature 112: s=g or c
  misc_feature 113: y=c or t
  misc_feature 115: s=g or c
  misc_feature 119: y=c or t
acacatgacctctgtccttccagctgccaccagtttctgggttgtcgagtgataccctgaaagtttacagtcaacactccttgtgtggggtcagtcctagaaatggcgrcgsytscttyctccgaagataggaaagaaaaggacctcattccactgagccattgaccgaaatattttctcaacaaagttgaactgagctgaaactgtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggagctgtggagtccaagtgtgact

SEQ ID NO: 31562 - DNA, 123 bp, Homo sapiens
  misc_feature 116: k=g or t
ctacatgcttcctgctgtggctgtctcggaacccgtggtcctccgcttcattctgccgagttcctgggattgcaggtgcgcgccgccactcctgactggtttttgtattttttggktggagac

SEQ ID NO: 31563 - DNA, 330 bp, Homo sapiens
taagtagaaattacaacttccgtaagcataatttgttgctgctgagcaattttgaaatgagtaacaatattctaaaggtagactctcataggaaataaaagcagaactgatgtccttccagaatgtatagaaagcatatttattttcaaaaactgtttgccagaaaattgagcaaaacttaaactgtatacttatcaactatttccttttaaagatactgatttggtagtcacagttagggaggaaattacaaaattttgttgttgaaaagatacaatccagggaaagtgcccgtccacattagttagtattgctgctgctgaagccact

SEQ ID NO: 31564 - DNA, 442 bp, Homo sapiens
  misc_feature 408: w=a or t
  misc_feature 409: n=a, g, c or t
gaccttaagatgttcatcaacccattttatccaagcaaagtacattagactgttggacctgctaaaataatatttcactgaaatctggcattaaaaaatttaagtgggtatttggagctccatgtaatgattacagttttttttcaatttgaaataaataagcgtcctttgaatactaaaagctgtttccttttgacatttaattaaccctgtttaaaacgtgagatgtagtggtggtttgctagtggactagactttttcttttaggctgccaagggctttgaagaggattatcacaaagttttgtgtcagaaactgtaagtagtgcatatttaatcttaaaaactcaggattgatgtaagcactggaatactttatttgcagaaatgtgtatcacattacttaatwnttttttgaaacagctgtaggaagagttagcact

SEQ ID NO: 31565 - DNA, 257 bp, Homo sapiens
tatttaggaataaaatgggaggcaggttttcctgacacagctcccagcctgacttttcccttggcttagtgattttggggtcctgagatctattttcgtttcataaacttcagtaggatcactctggctgctgtgtagagaatagggtagaaagaagagaccagttaggagactacagaagatgtgattaaaatttggatatatatcggaggtagaactgaggatcttgggcccgtgctacagaaagagaatagagc

SEQ ID NO: 31566 - DNA, 205 bp, Homo sapiens
cttgtgctgtgtttttcagctccatcaggtcatttatgttcttctttatactggttattccagttagcaattcgtctaaccttttttcaaggttcttagcttccttgcattaggttagaacatgcttcttcagcttggaggagtttgttattacccaccttctgaagcctacttctgtcaatttgtcaaactcattctgcatctg

SEQ ID NO: 31567 - DNA, 173 bp, Homo sapiens
  misc_feature 69: s=g or c
ccttagaatctcagaaattgactttgcatgtggtatgctttgtttgtatggcattttaaaactgcggasatatagaagataattacatatgcattgtgcatattagaaactgaaatttctgttttcctttagaaagaaattcctgttcatggaattgaatcaacagcgacctc

SEQ ID NO: 31568 - DNA, 357 bp, Homo sapiens
  misc_feature 126: r=a or g
  misc_feature 128: r=a or g
  misc_feature 339: n=a, g, c or t
tatgactagacagaagataggagggatgacaagttttcggggtgcagtccgagtggatggggggtgactgaataaagcctgttgtaaagatagggtaaggaagaatagacctaataaaaatgaaargratgtattaggcttataaggattactgttatcctttaggaatgcaggtgagtttaagggaagtagggtgagtacttgtgacttccaggaggaagaggagagatcaggctggctgtccgacggacacggctttattctggaacggtgaacccaatggggagggtcctgcaggcggatggcagttggggtactatagatgactaagtagggtcnggtccatcgaggttgtag

SEQ ID NO: 31569 - DNA, 172 bp, Homo sapiens
tttcctctcttcttaaaaattatttttagaatagataatgcattcacatggctcaaaattctaaagcatatcaaagttccttaatttatgagggtgtgtcctaataaacccatcataaatttgaaaatatcttaagttgaaatgcatttaatccacctaacctactgaacaa

SEQ ID NO: 31570 - DNA, 322 bp, Homo sapiens
aaatctttgaaaaacacattggtggcaaggcatgtccttagaaaaagtctcttatctagcagagtcatcagggctgccctttggtaatgcaaattattaatgattttttatcttattaaaataattttacagtcacatctttcatagctttttaaaattttaaaatttaaaatttatttatttattttttagagacaaagtctcattctgtcactcaggccggagtgcagtggtgatcatagctcactgcagcctcaaactcctgggctcaggtgattttcccacctcagccaagtggctgggactacaagcatactccacc

SEQ ID NO: 31571 - DNA, 263 bp, Homo sapiens
tacaaagatacatgcatacgtatgttcactgcagcagtgttcacaatagcaaagatatggaatcaaccgaaatgtccatcaatgatagactagataaagaaaatatggtacttatatagcatggaatactgtgcaaccataaaaaggaatgagatcatgccctttgcagggacatggatggatctggaagccattatcctcagcaaagtaacacaggaacagaaaaccaaacaccacatgttcttacttataagcgggagctg

SEQ ID NO: 31572 - DNA, 311 bp, Homo sapiens
  misc_feature 115: y=c or t
  misc_feature 134: n=a, g, c or t
cataaggattaggccttctgttcagtgatgccttttgtacaggttgagtagctagaactacctgcatggtataatttgaagtttcataggaaggccctgaaatagtactgttctytccaccccaaaatgtgagncatatatgtaatttaaaatgttgtagaagccacattaaaaaatttttaaagaaacgggcgggaaattagtttcaatatatttgatttaacctaatatatttaaaatataatttcaacatgtaatcagcataaaaaatttttactcagtcctgtctatattttacacttagcacatag

SEQ ID NO: 31573 - DNA, 84 bp, Homo sapiens
gcagcaggtgaggggctgagggctcgctgggagggtggcggctcctgggactggctctgcaggttccgtgggactggagcccgc

SEQ ID NO: 31574 - DNA, 327 bp, Homo sapiens
tataatgttcacaggcaattgtgctgaaaagccattttcctgctgggcacagtggctcatgcctgtaatctcagcactttgggaggccaaggtgagtggatcacttgaggtcagttcgagaccagcctggccagcatggtgaaaccctgtctgtactaaaaatacaaaaattagctgggtgtggtggtgcgcacctgtaatcccagttactcaggaagctgagacaggagaattgcttgaacctggaaagtggaggttgcaatgagccaggattgtgccactgtactccaacctgggcaacagagtgacactctgtcacaaaaaaaa

SEQ ID NO: 31575 - DNA, 198 bp, Homo sapiens
  misc_feature 155: r=a or g
ctactcttccacatcagtgcgtttacctgcgttcatcagcaccttttattaccaatttctctccacatttcttgtcaggttgaatcctgggttttgggaatatgaataggatctttttttcttattattttctaaaggttagtgtttacatacarggaaagataggctgtgtgtgtgtgtgtgtgtgtgtgtgtgtgt

SEQ ID NO: 31576 - DNA, 434 bp, Homo sapiens
  misc_feature 145: s=g or c
  misc_feature 149: r=a or g
  misc_feature 153: r=a or g
  misc_feature 157: n=a, g, c or t
  misc_feature 185: n=a, g, c or t
aaacaggtattaaaggactaagaattgggaggacccaggacatccaattaagagagtgcccaagggggttcagcataattatttgcttggttggcaagtttttggactctatccttgagtttttttatgttgtcatataccaggscagratgrattnaggtaaaaacaacactcttcatttaaanatatacagagtcgtcctttttcagcaatgagtaaattgaggccttggcgattttggaggaaagagaattgcaaagccagcaattgtttctttttttatttatttatttacttattttttaaaattatactttaagttatagggtacatgtacacaatgtgcaggtttgttacatatgtatacatgtgccatgttggtgtactgcacccattaactcgtcatttacattaggtgtatctcctactgctat

SEQ ID NO: 31577 - DNA, 448 bp, Homo sapiens
  misc_feature 143: k=g or t
gtctagctttaatgtgttgttgaggttgatccattgtaacatgttatcactacttcattcctttttatagctaagtatactttttatagtaagtatgccattgtagatatataccacaagtttatcgattcatccagttgagktgtttctactgtttggctaatgttcatagtgctgttatgaatgttcgtgtacagtatttgagtccgtgttttcaattatttggggtatatgcctgggagtggagttgctgggtcatgttgaaatcgcacatttaactttttgaggaactgtcaaactttccctcagcagctgtaccgttttaccttccaccattgatgtatgagggttccaatttctccacaccttcaccaacacttattttgccattttaaaaattatagccatcctcatgggtgtggtctctcattgtggttttgatttgcat

SEQ ID NO: 31578 - DNA, 200 bp, Homo sapiens
  misc_feature 161: n=a, g, c or t
tcatcagtcacagtgccttgtgctgtcttcactacccagagtttaattctgttggagtttaccagccaccactgcaggtggaggtattaatttagccagtagttatataccagactgttaatgtctttgttttgacaaatgtactatggttgtgtcagttngttaacatagtagaaattgggtgaaaggtatataggagc

SEQ ID NO: 31579 - DNA, 246 bp, Homo sapiens
ttttaagactatcaccaaaaaactatatctgcccaatatacagatcagtaccatgagttcctaagtgccaagtggcccacagtatctggagtttcccctcctggtagatgggcttgagcaggcaatgatgagttctctgctctcctcttccagaccttgaagactgttgtcccatttgttagtatgttagtgtaagttagctgattgtattctttctaatttgtttggtattgaaaagatggccgc

SEQ ID NO: 31580 - DNA, 294 bp, Homo sapiens
  misc_feature 148: r=a or g
  misc_feature 167: r=a or g
  misc_feature 227: n=a, g, c or t
acatacacgtcaattaatctgattcatcccataaacaaaactaaagataaaaaccatgtgattatctcaatatatgcagaaaaggctttcaataaaattcaaggcctctccatattaaaaactctaaaaaatctgggtattgaggaarcatagctcaaaagtgatgrgctgtttttgtaccagtatcatgctgttttggttactgtagccctgtagtatagtttgangttgggtaacatgatgcctccagctttgttctttttgctgaggattgcttggctattagggctcttt

SEQ ID NO: 31581 - DNA, 471 bp, Homo sapiens
  misc_feature 147: k=g or t
  misc_feature 154: r=a or g
  misc_feature 156: m=a or c
  misc_feature 159: k=g or t
  misc_feature 178: k=g or t
  misc_feature 397: m=a or c
tgaagtattgaatacgcttgataccactttcttgaaattaagtccctccttagtttttgcccattgcatattttggcttgtcttctattgccctgattagccttcactctcctctctggtatttgcttcttccatggctttcttccktagttgramtcktaattttttccaataaagkatacagttattcagtatttctaagtatctccagagcataacagtgattttagtgttttttgtttgtttgtttgttttttaattgagtcagggtcttgctctgtcacccatgctggagagcagtggcgtgatctcggctcagtgcagcttcaacctccccggctcaagtgatcctcccacctcagcctctccaagtagctggaatatagacgtatgccamcacaccagctaaattttgtttcaagttttgtagagatggaatctccctaagttgcccaggctggtgtcgaactc

SEQ ID NO: 31582 - DNA, 286 bp, Homo sapiens
  misc_feature 144: s=g or c
  misc_feature 156: s=g or c
  misc_feature 163: s=g or c
  misc_feature 164: s=g or c
  misc_feature 166: k=g or t
  misc_feature 215: k=g or t
gttgccggtgcaaacagggaggaaacagccggcgttgctgtagcgcgtctgggaattacaccgggggactggccggcccgcttcgtgcctgcgggaagtcgggccgggggactcttcggaaactccgagcctcagagaaatatsgccgctccgaasgcttgcssgkcctactggtgcagccagcagcgcctgaatcagcagctagcacgacagckagagcaagaggcccggcttcggcagcagtgggagcagaacagccgttacttcaggatgtctgacatctgca

SEQ ID NO: 31583 - DNA, 296 bp, Homo sapiens
  misc_feature 146: s=g or c
  misc_feature 148: y=c or t
  misc_feature 149: m=a or c
  misc_feature 156: w=a or t
  misc_feature 163: k=g or t
  misc_feature 168: m=a or c
  misc_feature 190: b=c or g or t
  misc_feature 295: m=a or c
tgacactatgatcattcaacatttttttaaaataaattaattttttttagttttagggattaggcctcactctcttgcccaggctggagtgaagtggcgcagtggcacagtcatagctcactctaaccttgaactaactcctcaastymaactggwtcctcckgcctmagcctgccaagcagctgggatbatagacatgagccaccttgcccagctcagtatcatttttcacattcaagctaatgaaataattcaatagaattaaacaaatgcttttcaaaaatgaagttggaamc

SEQ ID NO: 31584 - DNA, 289 bp, Homo sapiens
  misc_feature 134: r=a or g
  misc_feature 146: k=g or t
  misc_feature 150: y=c or t
  misc_feature 151: w=a or t
  misc_feature 156: y=c or t
  misc_feature 162: s=g or c
  misc_feature 166: k=g or t
taccagataacaaacactgaactcctatttgaccagaactttttcctctcgagatagttttttctttttaatgaaaaaagcataggaattggagattggcttgtctcacgcagccagtgcacatttggaattgrcggaaacaacgktgcywatttyccaccsattkgttttcggcagccttaaggccctcattctcatttcgggtgaatctgtctatctgtgaacgtggcccgcatgtgcattcttttttttatatatataaagtcagtgacgaggaactcccgagact

SEQ ID NO: 31585 - DNA, 398 bp, Homo sapiens
  misc_feature 153: r=a or g
ccatcaaaagacctttatactagtttgcttttagacgagtttagatgctgaagaaattagaatcagaaatgagtttaatctgggtcaattctctcattttacataaggaagggaagtggcttgctcaaggccatcagcaagtagtcaacaagrccaggagccaaggtttattccactatggtaatgttgccagggttttctgtgtttgctagtgtataaaatgtattctccctctcatttcgtaacgaacatcccattcatccagactatacaaagcgcagtgccagagtgaattgatagatgatactgctccctagtggcagaacttggcaacacacaactttgcaataatgatgagattggttatcttctatcctttgcagaaaaaacacgccgca

SEQ ID NO: 31586 - DNA, 147 bp, Homo sapiens
ctatgaggggagtatacttgtagtagcattttgctagatgagctgcctttattccaaatcaataaatgagtggtctgagcacatgtttctttttttgaaatagtttctttgaagttttattgtggacttaaatctaatatccctggc

SEQ ID NO: 31587 - DNA, 69 bp, Homo sapiens
  misc_feature 15: s=g or c
  misc_feature 24: v=a or c or g
  misc_feature 25: s=g or c
acttatataacttasttaaaaatvstcaaatctcttcaatgcagcctacctccgctcacaattccacac

SEQ ID NO: 31588 - DNA, 330 bp, Homo sapiens
  misc_feature 149: r=a or g
agttgaagctgacaagcagtggtggcagcacccagtgggactgatcactggatcagtggtgaagtctgggcaccaccgtgtgaagacagggacagtggtgaagagggaagagcccgtgggagaggcagctttggcctttgactcagtgratttaggtttttataaaaggggtccccgtcgtgttgcagtgactttcttctcttatgaggtaatttgttcaaaactgtcttgcagattcaaaagtggtcaatacaacgtttattaaagaacaagggaaagagagaactaatgtgtattaagcccttcagtctcacctactaagcacctact

SEQ ID NO: 31589 - DNA, 69 bp, Homo sapiens
  misc_feature 54: w=a or t
taagggagttattgagcccgcttacaaaatccataacatgttagcaggacttawctagctgcctccaca

SEQ ID NO: 31590 - DNA, 120 bp, Homo sapiens
cacagaagaggatatagacttttttgtacaatgtgttgtacaatgtgtttgtgttttaagtgttattacaaaagagtcaaaaagttaagaaactttaaaagttcataaagtaaaaatggt

SEQ ID NO: 31591 - DNA, 105 bp, Homo sapiens
  misc_feature 71: w=a or t
  misc_feature 72: r=a or g
tttgatgaagaaccaattttggcgggggggaaatatgtcattgactgataaagtctgttgatattgaggcwrtatcaaattactataaacgtttctttttttttt

SEQ ID NO: 31592 - DNA, 354 bp, Homo sapiens
  misc_feature 71: n=a, g, c or t
  misc_feature 72: n=a, g, c or t
  misc_feature 107: n=a, g, c or t
  misc_feature 137: n=a, g, c or t
  misc_feature 138: n=a, g, c or t
  misc_feature 139: n=a, g, c or t
  misc_feature 179: n=a, g, c or t
  misc_feature 221: m=a or c
  misc_feature 229: b=c or g or t
  misc_feature 247: y=c or t
  misc_feature 336: h=a or c or t
ccatatttgcatgggtctatttatggaccttccattctactatctgttcctccttgcacaatactgcacanntggtagctttatattaaagtttgatatttataggncaaggcactccctcccaatttgttcttcannnaagtcttggctattgtttaatgactggacacaaattgttngaacagtatatacagattctttaagtaagtcttaaaaatggmaaagccabccaggtgtggtggcccaytcccgtaatcccagcactttgggagtccaaggtgggcagatcacctgagggcaggagttcgagatcagcctggccaacatggtgaaachcgtctctactaaaaatac

SEQ ID NO: 31593 - DNA, 228 bp, Homo sapiens
  misc_feature 112: k=g or t
  misc_feature 113: k=g or t
  misc_feature 115: k=g or t
  misc_feature 118: s=g or c
cttgctgctgacaccctgaggcttccacacgtggccctgtgcagcgtggcatgcctcttgtctccaggaccttgtaaaacctgttctgagccaaaaaagataaccagttcckkckgcsatctatgacaatccaaatctcatcaaaccaattccagtgaaacccagtgaaaaccagcaacagcgtatacctcagcccaaccagaccttagaccctgaaccccaacacag

SEQ ID NO: 31594 - DNA, 414 bp, Homo sapiens
  misc_feature 103: k=g or t
  misc_feature 105: k=g or t
  misc_feature 110: w=a or t
  misc_feature 114: k=g or t
  misc_feature 116: k=g or t
  misc_feature 119: k=g or t
  misc_feature 229: y=c or t
  misc_feature 230: k=g or t
  misc_feature 280: r=a or g
agattttttatctccttcagtttctctttacctttgggacaccaaaaacttgaatatttgattgctttatggtgtcccatatgtcacaagagttttgtttatktktttawtttkakttktttaatgttgtctgattgggttattacaaaagacctgtcttcaatttctgaaattcttccttctgcttgatctagtctattgttgcagcttttgaataaattttctgttykattcaagaagttcttcaattctagaatttctattttgattctttggtaarcttctcataatattctgagttgtttttctgatatctttgtattgtttttctggattctcttgtacctcactgaacttgtttaatgtcatgattctgagtactttttttagattgcataggtttatttttcatta

SEQ ID NO: 31595 - DNA, 415 bp, Homo sapiens
  misc_feature 394: k=g or t
  misc_feature 398: y=c or t
agtatcctcttgtatgattacaccacaattatccattttgctgttggtggacaattcaatttttttactttgtgacttattaatagtagtagtatatacgttcttatacacatcttctagtgtacatgtgcatgcagatgaagacattaacacctgtcttcagttttagtaagtattccctaattattcaacgtacttattccagtttacatccctactaacagtgtgtgacagttgtttcacatccttgccaacacttggcattaactaatcttgtgagcatataacagtatttcattgtcactttaataagagccctcccccttttcatatgtgttttggctgattcctacttttgtgaactttagtggttcattggaggtttttttttatktttyattttttgaggcagata

SEQ ID NO: 31596 - DNA, 340 bp, Homo sapiens
ctattactagtcattgcccctgtgctattctttgtgtagaaggatgatgccatgagttttggcttgatgtttatgatgtatttatgttaactcaaattctctttcattgacctatcctctttgtgactaatgaaacgcctttgcaaaagggccagttttggaggggtgggtgttctgtcagcagtaacatctcagatctgtttatgccttggagggaccatgtcctcaggctagatctcgggggctcagtattctagtaccataaatatttttagaactgtctttttgagttctactttcatgcacatttgtgactaaatttaatatttttaactggcct

SEQ ID NO: 31597 - DNA, 481 bp, Homo sapiens
  misc_feature 155: y=c or t
  misc_feature 156: y=c or t
  misc_feature 166: w=a or t
  misc_feature 332: r=a or g
  misc_feature 400: r=a or g
  misc_feature 411: d=a or g or t
  misc_feature 413: s=g or c
gacttgtatgggtttttaaaaaatctttagcatttttgaaaaaatatgggccaggcatggtggctcacaccagcactttgagaggcccaggccggcagatcacctgaggtcaggagttcaagaccagcctgatcaacatggtgaaactgcgtctyytacttaaaawtataaaaaatcagccgggcgtggtggcgggcgcctgtaatcccagctactctggaggctgaggcaggagaattgcttgaacccgagaggcagaggctgcagtgaaccaagatcgtgccattgcactccagcctggtcaacaagagtgaaactccgtctcaaaaagraaaaagaaaaaatatgaaatgtgtaaaaatattgactcttgatatagttaattcttcagagtttgaargagccggaatdgstgctctcaggtatgagggcctggtgggaacagacttctagttctgccataaaggtttgtgtttgacaa

SEQ ID NO: 31598 - DNA, 287 bp, Homo sapiens
  misc_feature 156: k=g or t
  misc_feature 157: r=a or g
  misc_feature 161: k=g or t
  misc_feature 163: y=c or t
  misc_feature 167: r=a or g
  misc_feature 170: w=a or t
  misc_feature 183: k=g or t
gtccttctcctgtgcttactcaaagatgggacattgtgcacaatgagaagagtattgggaccagtaaggaagaatgagtcagatattgtgggacctctttttttgttgtttttttttgctcccagaaatctttgaggtaagtaacatagttaattkraggkcytggrgtwatgtactccattkattcattttttcttaacatagtccctccttactatgtgatattctctgtcctagatcttgaaaatacaagttaaatatggcatattctttacctctatgagctc

SEQ ID NO: 31599 - DNA, 76 bp, Homo sapiens
tagaataaaatccaaacttttaatattaggttgtgaagttctgtagattctttgtctttgctcttatctggtacca

SEQ ID NO: 31600 - DNA, 215 bp, Homo sapiens
  misc_feature 145: n=a, g, c or t
  misc_feature 147: k=g or t
  misc_feature 155: k=g or t
  misc_feature 157: k=g or t
  misc_feature 160: k=g or t
  misc_feature 163: w=a or t
tgtgatcactttgtttcaaactcttttggaaaaagatctgcctgggatacttttgcattcctactttcccaacaaaaacagccataggcaaaccagaaataattaacgccgtcattgagtttggtccagaggcccacaagaaatnckactttcakcktakttwaggtcactaggccccattgagccagcatgacctgccggcaagcacccagagc

SEQ ID NO: 31601 - DNA, 278 bp, Homo sapiens
  misc_feature 152: k=g or t
tcaactttatttcacagaattttctcattctttttgtacctacatagaatttcactttataatatacaaaagatctttaagcaagcccttattgatactcatgtggattgttttctgtctttaggtattaaaatgctgtattcaataatttkggggacatatatgtcatttcacatatatacagatgtgtatcagggtgacattccaaaagtgcactgctgagttagaggtatatgtatttgtaattttgatggaagctttaccaatttacagtcccc

SEQ ID NO: 31602 - DNA, 353 bp, Homo sapiens
  misc_feature 128: s=g or c
  misc_feature 351: m=a or c
  misc_feature 352: h=a or c or t
  misc_feature 353: k=g or t
tgacagtttttaatgcagagatgcctagaaagaagctaccaccccacatgccaatcctccaagcaggccttgtacccagccatgggcgaaagggctgtactgagaaccaccaaatcctggcctagccsagaatggtggctggtgttttccaggtaccttggtattcaaaaaagccttagaacagcagattttggttttggaggacaggggtggagcatgaaaccatgctcatagtatttatctataaccaatacaatgtttaaaatgacccgtcccattcgggaagggccgcgcaggcctaatggcccctctgcacatttcctcttgggcaaggcccaacacaagtgcacmhk

SEQ ID NO: 31603 - DNA, 248 bp, Homo sapiens
aaaagtatatggcggacacacagataatatttattatatatttttatataccttatgtataacttatattcttttacagctacgcaaggtactcaaaaaagtgatttttaaaacccctcagtggctcgctattttctcgggttagggtcagattgtttatgtggcctgtgttgcccttcatgtcctggcccctgctcgcctcccctccctgagcaacccacggacccgtggctgcctctccccttcat

SEQ ID NO: 31604 - DNA, 137 bp, Homo sapiens
ctccctggtgagcagaggggcggccacggcgggcggtggcctagagacccaggacctgggcgcctgggaaaatggaatgcaacccacattgtaaagccactggcatctgattatctccatttgaacacacaacacaa

SEQ ID NO: 31605 - DNA, 267 bp, Homo sapiens
  misc_feature 124: k=g or t
  misc_feature 202: n=a, g, c or t
  misc_feature 203: n=a, g, c or t
  misc_feature 250: r=a or g
  misc_feature 257: r=a or g
ttaaaaataagaaaaaatgtaaatgtataatagaccaaaaattgttctatttttgtccttggggcagtgatgttaaatcatctcatatctatgagacattgctagttataaggaatattcatgktctccttttcttcttaggcacatagcagtcagttctgaataattgattgtgagctgaaatagtcatttttagggctcnnccattaagcctccatctgaatacagaggataacaaaggcttagaggrgaagggrgccacaatat

SEQ ID NO: 31606 - DNA, 313 bp, Homo sapiens
  misc_feature 128: k=g or t
tagaagcaagtataggtataacgtggactatcaactgatatctgcaaataatttggttaaaatgaaatttgattgtagtatttgttgctgtaggattataaatgtcaaatatcattgtaaacatttcktatatttttagaaatatcttgggtggcctgaaacagaagtgaggaaatcaattttttaaggtgagccatttggcttttttaaaaaattgagattcaacttacataccataaagttcactcttctaaagtgtacaattcattggtgttagtatatttacagagttgtacaactattaccactaaat

SEQ ID NO: 31607 - DNA, 192 bp, Homo sapiens
  misc_feature 37: v=a or c or g
  misc_feature 123: y=c or t
  misc_feature 127: w=a or t
  misc_feature 131: k=g or t
caaaccgaaatgctgaagaggatgtggagcaacaggvactctcatttgttgctggcaggaatgcaaagggatataaccactttggaagacagtttgatggcttcttacaaaactaaatgtacycctwacakgatccagcaatccttctccttggtatttacccaaagaaactgaaaacttatgtccacacaa

SEQ ID NO: 31608 - DNA, 226 bp, Homo sapiens
  misc_feature 87: n=a, g, c or t
  misc_feature 123: r=a or g
  misc_feature 126: m=a or c
  misc_feature 132: w=a or t
agttggatattcacatttatctttcagtgttaactgggtatcagttatgagtctactactgtataatggcatccaaaagaattttanagtacctcggtttatagggatttacaattcagtagraamcttgtwattcatgtgaaacagtgaacataatatctaatgatgtggagcaagtacattaaaaacaggaaggaagagatctgtgattaaactaaaggcccgt

SEQ ID NO: 31609 - DNA, 161 bp, Homo sapiens
  misc_feature 117: k=g or t
  misc_feature 119: k=g or t
  misc_feature 127: v=a or c or g
  misc_feature 131: k=g or t
  misc_feature 132: k=g or t
acatatgttcacacatttcttttaggaatctacattgcagtgaaattaatgagtcattggatatgcctataattaattttattggatatttcagttttccaaatctcagctcttatktktaaattgvctakkaaatatttaattgtattaataccccctac

SEQ ID NO: 31610 - DNA, 122 bp, Homo sapiens
  misc_feature 2: n=a, g, c or t
  misc_feature 55: w=a or t
  misc_feature 71: v=a or c or g
antcctcctttgctgatcctgggtcacacttcaccagccagggcttttgacggawacagcaaggaagagavagagaatgtaaggaagggaggaaggaaggaagggaggaaggtaggaaggga

SEQ ID NO: 31611 - DNA, 491 bp, Homo sapiens
  misc_feature 145: w=a or t
  misc_feature 350: y=c or t
taaaactgaaaatgatacttttgcaaataatactttgggcagatcccacgtaaggctgattttagatttttcactaatgtgtaagtctctttgctaagtacagtgtttaagactgcagtgagtaattaaatatttgaaaattgcwagaagccttcagatagtttatacattttggtgcttgcatagatgcttttgtaactctttacaggcttaatatatgttttagtgttttaagaaatactaacttctgggtactttggggatgaaatttttcattatgtcgtttgggattgagaacatttaccatcactaagtcatatttatatacctctgctaggtgtttgtaagtyatacttggtacttgaatttgtttatttttgtgtttaaagaacatggttggtgcgggagaggtggatgaagacttggaagttgaaaccaaggaagaatgtgaaaaatatggcaaagttggaaaatgtgtgatatttgaagta

SEQ ID NO: 31612 - DNA, 313 bp, Homo sapiens
  misc_feature 137: m=a or c
  misc_feature 141: y=c or t
  misc_feature 142: b=c or g or t
gtaaaagacaaataacttgtatggtttgcaaaatgatctgaatatgtgcttttataacattcagaatacacccaaaagtaaactttaggtttaatgtacagtatgttttctatgtaattgttttgaataagtaatamcatybtacatggcttaaaactgaaaaacgtattcctgttacttcttgatgcttttgagaaatgaataatgttttctcccttttaaatggtagtacagcatgcacacttttctgtgcttgcttttttatctcatagtatcttgtggagctgttttcttaacagtcccttctccccaa

SEQ ID NO: 31613 - DNA, 181 bp, Homo sapiens
ttttatgtggcacttgagaaaggtaccccggattgtcagtgaaaggactttccatctcaccagccccgcatttgaggcagatgctaagatgatggtaaatacagtgtgtggcatcgaatgccagaaagaactcccaaactcccagcctttctgaattggaggattatctttcctatgagtg

SEQ ID NO: 31614 - DNA, 492 bp, Homo sapiens
  misc_feature 16: w=a or t
  misc_feature 356: k=g or t
  misc_feature 365: k=g or t
  misc_feature 378: r=a or g
ctttacaaagagtgawatatgtttttatacctctcagtttcagttagaggcatattttgtgtaatatttatggcttaaaatggactaaaggtcctgttcttgccttgtctgaacttgccgcttttgcattctttgagttcagttttaaagacagttactttaagcccattttaaaccctcaggctagaaatcgtaccactgttaattagccacattatttggtctaacagtttatcattctgaaactgagcttacctaatacattgataaattatttcaaaggtatttttatagttcaaatcgcttcacttttaccctgacacgtataaatgactaggaatgaccttcagatagckttagcaackgtaaccaatctgrcaataatgtgttcatcaggtacctgtggattaaatcacatactggcatatttaagctgaatgtcagtctgaaaaataaatgtactatattaactcaaataccactctctgtgta

SEQ ID NO: 31615 - DNA, 257 bp, Homo sapiens
  misc_feature 143: w=a or t
  misc_feature 144: m=a or c
cagcatgaagaaagaatttgtatagtgagaaccttcctttggttctttttagactttctggttgtttcagaacttttgatctttcttttagtaataaaatttaaataatttccaaagggaaatgccgttattgggttttagtwmctcatttttaatcctagatttgtactttgaattttctagtaagattttcgaagtagcagtcaaaacaataagtctcatttatttgagagaataacgaaaaaaagagccacgtc

SEQ ID NO: 31616 - DNA, 184 bp, Homo sapiens
ttctgtgttactccagctgcctccctttattgctgtcatattacaatgaatgttttctgcatatttatgaagagcctattagcagcatagacttgatttaaagaacttctccagtttatgaatacagttcatctcttgtggaatgaatttagcactttaatgctatttatttactccacacttt

SEQ ID NO: 31617 - DNA, 415 bp, Homo sapiens
acaattttctctttgcagagaggttgggcagcggcgtttgaacgttgagcaaagcctttccattcacctgtaaaatagaatcaaaggctggacgccgtggcttacgcctgtaatcccaacactttgggaggccagggcgggaggatcgcttgagcctgggagttcggccttggcaacatagcaagactccttttctataatacaaaaaaataaaaaaattggccgtgtggactggctcgcacctgtggttccagctgctcgggaggccaaggtgggaggatcagctgagccctggaggtggaggctgcagtgagccgagatcccactaatgtactccagcctgggcgacagagctgaggtaggattagaggtggtggcggtgtcagaagctgttggatgatggtgatgggggcga

SEQ ID NO: 31618 - DNA, 393 bp, Homo sapiens
  misc_feature 350: r=a or g
taggacatcatctaaacccacagtacagacagctagttgtccctctataactctcatccccttctatcttaataagacaacccctcatttttagctatgctcatggccattcagaatgaagactgcatttctcaacttcccttggagctatgtgtggccacatcactaagtcctggccgataggatatatgcaaaagtgtcaactatccacttccatgaatctccttaaaagatagtgtagtcctttgcccttcctcttcatcctctctctagttgctgcctaaatatgggcatggtggggaaagcgaggccctgagaagtgatgagaatcagtggcaaagtcagatgtrccacttcagtcacacactcacatttttttgctttgttcttttt

SEQ ID NO: 31619 - DNA, 205 bp, Homo sapiens
  misc_feature 152: n=a, g, c or t
cctcccacctctgtcaccaccaaagacgggcggaggtggggctgggccctcctgcccccgcccatcccccttccatgagcccagacctccctgggtagtgctaggctctgagctgggggctcagaccagggatcgctcaggcccctgtcacntgtgggcccggggaccacttgggggaggtcagaggatgtatgtggccggaccc

SEQ ID NO: 31620 - DNA, 235 bp, Homo sapiens
gaggaggagccaagatggccgaataggaacagctccggtctacagctcccagcgtgagtaacgcagaagatgggtgatttctgcatttccatctgagagatgggtatcactatcttgcccagcctggccttcaactctggaattcaagtgattctcctgtctcagcctcccaagtagttgggactgcaggttgcacaagtacacctggctctgatttattattgaagactccagt

SEQ ID NO: 31621 - DNA, 478 bp, Homo sapiens
atggctttttaaattgattcctaaatattttaaatttactgttctgttgtttatcagtcttgtctcccattatgcttcctaaccattgttgcttgtgcaccccaagttctttgtcagggaatccagtgccctttgatagtggactttgtctcactcttcagtaatatctcctgcctctcccttgcatagacgcttcactccgaccaaacatcttgtgatttcatagatgttttcatttctcatttctgtgtgcctttaacctttagttgcctctgcctaagatttttcttctcattttttctggctttttctggtccttttgctctgaaagccctgcctcataccttcttaacttttttctcttaccactgtaataaaagatatttttttgtttgtatttccaaggttagcctttgtttggggttagcctttgtttggattttttccctgttactgttagcgcttctcttgctgtctt

SEQ ID NO: 31622 - DNA, 174 bp, Homo sapiens
aaatcatgtcttttgcagtaacacgggtggagctggaggccataatcctagcacaccaacacaggaacagaaaaccaaatactacatgctctcacttataagtgggagctaaacactgagcacacatggacataaatatgggattaatagacgctgtggactactagaggggga

SEQ ID NO: 31623 - DNA, 191 bp, Homo sapiens
atggagaaaggggctgcatgcagccaagagatgcaagtgcccactagaagctgcaataaaggtcagggagaaagattttcccatagagcctcctgaaaggaatgtagctcagatggcaccttgatttttagccctgtgagatcgatctcagatttctaacctacagaatgggggaacagagtttttttttt

SEQ ID NO: 31624 - DNA, 126 bp, Homo sapiens
gagagagatcgaaaagcaggggagggggacggcacggccgtttacctgtctgcctcctcattcgctctcccccctcgttctgctcactcctggtgtcagcctatccgccttcccaaaccctcccct

SEQ ID NO: 31625 - DNA, 232 bp, Homo sapiens
  misc_feature 39: n=a, g, c or t
  misc_feature 73: s=g or c
  misc_feature 129: r=a or g
  misc_feature 133: m=a or c
  misc_feature 142: k=g or t
  misc_feature 161: k=g or t
  misc_feature 162: h=a or c or t
cgttttcttataaaagaagctgcccctcgggcagctggnctcctgggaccgcagcacagtgagcaacgcgcastgctccctccctccgtgtccctcggccaccgcccttcactgctcccttccgtgtgrtgamagcccgttkgttctcctgtctatgtgakhctgggcatgcgaccacgcgtccctgcccaacctggctcagttcagctggagacagggccgacccgcttgc

SEQ ID NO: 31626 - DNA, 281 bp, Homo sapiens
  misc_feature 128: d=a or g or t
  misc_feature 141: b=c or g or t
  misc_feature 142: m=a or c
ccaaatgcaaacgggatctcaggaggaagctagcttagtattaaaaactccgataaggatatcccagtgtggataatgcagaatttgttatggttaaaaataggaaattccaaatagtatttaagtadtccttaaaaaaabmtatttttttctggatcaaattttagaatgcttcttttggatttaaaatttatggttagtagattatttttagtgtaattccttggctagtgcttttttccccacatacatagtctgtagtttaagtccttttttttttt

SEQ ID NO: 31627 - DNA, 102 bp, Homo sapiens
  misc_feature 2: h=a or c or t
thggtttcataatacttttagttacttttaaaagtgactaagagaaaatgagtacttttaaatgtagaattaaacagatacgtaattaattcctacacacac

SEQ ID NO: 31628 - DNA, 276 bp, Homo sapiens
  misc_feature 135: m=a or c
  misc_feature 137: w=a or t
  misc_feature 140: y=c or t
  misc_feature 144: r=a or g
tagaaagtttgatatttaaaaaacacatttaaaaaatatttcaggaaaaatgttatagtaaacatcatctagaattaatttgattttctttttagtataatggatacgaaagtcaccatatttttaaaagaggcmawttycacrttacatttttaaaaaatctacccagtctaccaattaaggtgaactattatagcagggaagtgtttagctagagaaaaagagaattttatttagtatcccaggagtaatgatttgaagaaatatatcgtgcga

SEQ ID NO: 31629 - DNA, 268 bp, Homo sapiens
ctccagtgcggcatcccttccttgccttctacctctgttccaccccctttccttcctttcctctctgtaccattcattctccctgaccggcctttcttgccgagggttctgtggctcttacccttgtgaagcttttccctttagcctgggacagaaggacctcccagcccccaaaggatctcccagtgaccaaaggatgcgaagagtgatagttacgtgctcctgactgatcacaccgcagacatttagatttttatacccaagccac

SEQ ID NO: 31630 - DNA, 331 bp, Homo sapiens
  misc_feature 146: w=a or t
  misc_feature 153: w=a or t
tgaatcagaatgtcaacttgtatgtacactatatctacacttactcattatttaaaaagaataatgaaaaatctagatcaattcttcaatttgattgaactgttcagccttttcaagatttctttatttacaaatgattacatttwaattgawtgtacattcttctcactgactttggtgattttgaaacctagaatgatgtgtttctatctgtaatatctttccatttgaaaaaaatctcaaaacacagattaaaaccaataggctgtagtattttttattttgggagccagagtatgatttgggggaagaatatgtatcagccctatgc

SEQ ID NO: 31631 - DNA, 235 bp, Homo sapiens
  misc_feature 27: k=g or t
  misc_feature 29: n=a, g, c or t
agagactctgggtgaacagcacgcagkcncccaaaagcattgctgctgaaggcaaccggctgctctgcttaaaaaatcatttgagcagccgacagtgctgacagtgccactatgtgggcagaagcacagcttgactcagaccctgacaactgttgatctgggagagggaaagagaagactgtttaaaacctgttgagaaggtactgatgacatggagattaatttgacaccagtc

SEQ ID NO: 31632 - DNA, 116 bp, Homo sapiens
taagaaggatagcttttctgagctgtatagcacccttgtgtttacattttctggaggaaaggaaagctgctttgttttattaggaacgacttgatgtcacatttggaaggcagtgc

SEQ ID NO: 31633 - DNA, 306 bp, Homo sapiens
tccaatttatccaaacagaactgtggtgtcaatgtgtaattaattgtgtaaaatagccttcccaagtttctttttccctggaaaataaaaaaggtaatagaacttgtagtttatttaaaccccatgtcatgaggaggtactagttccaagcaacaaactccttaatttgctctaatagataggtatggtttaatctttccattgtgtcttttcatttaattttcctgaagcttgcaggatagattgaaatgttataggtttgtttggagtaaccaaacagtatgcaaattaagaaaaagccagagt

SEQ ID NO: 31634 - DNA, 442 bp, Homo sapiens
  misc_feature 302: k=g or t
  misc_feature 303: w=a or t
gaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtckwtgtttacatgagttcaaatacttttgggatgttaccttcacatgtcctattactgatgtgtgcaaccttttatgtgttgatgactcactcataaaggtttttgtctactgtcatttgttctttccacttattctaagca

SEQ ID NO: 31635 - DNA, 148 bp, Homo sapiens
acacacttaaaagatggcattttggttgccaagggatcagggatggtttggacctggaggtttggtggaactggctgtccacagcctccaaagatgtcttgatgctacgaagagtggaatttgctcagatttccaaaaaaaaaaagtt

SEQ ID NO: 31636 - DNA, 450 bp, Homo sapiens
aaatgttttaataatctgtatttcttataattttaacactatgagctgcctatataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacact

SEQ ID NO: 31637 - DNA, 137 bp, Homo sapiens
agtggggcttgggaccatctcgaaccaccagcgtggagaagcagaagcaaaagcactcgccaggctgcagcctcaggcactggcaggggctggtgcggccccactcccctcccccgctcccatttgtgcccatccgt

SEQ ID NO: 31638 - DNA, 488 bp, Homo sapiens
  misc_feature 2: h=a or c or t
  misc_feature 42: m=a or c
  misc_feature 88: n=a, g, c or t
  misc_feature 291: n=a, g, c or t
  misc_feature 440: r=a or g
  misc_feature 441: d=a or g or t
  misc_feature 442: n=a, g, c or t
ghtaaaaaataaaataaaataaaataaaataaaataaaatamaagaagaagctacattaactccctcacaatttgcccataaggaaantccccgcttcaaattgtctttcccctgcccttctggccaatgtacatcttacatgtattgattgatatttcatgtctccctaaaatgtataaaaccaagctgtgccccaaccaccttaggcacatgtgtcaggacctcctaagtctgtgtcatgggcacacccttaaccttggcaaaaataagctttctaaattaattgaatnctgtttctgatatttggggttcacaatgggttgctacttacactgatttgattattatacaatgtataaatgaaagtacaattatgtatcaatttaaacattttttaaaacacttctaatgtgtagattaacttcttcatttatatttrdntatgaacttcagcaaaatagcaaaagtaaccatcttgatttaatgt

SEQ ID NO: 31639 - DNA, 322 bp, Homo sapiens
  misc_feature 132: w=a or t
cccttttttgttttcagggaggtagtatgtttgagctcctcctgtgcttacggagtcaagaagaaaatgaactattcttgaatacccttgaatacccttcacctgtaatactaaggatgaagaccagagaawcacattgaggcagatataatatacatacccattttctctcttactctataatgctgcctgatgtagtttgaaagtatcctcataatctaaaagaggggaagtagcctcatggagtgaaatcctggtactcctagaaaattatgacagcacttgtgtgtgtgtgtgtgtgtgtgtgtgtgtgtgtgtgtgt

SEQ ID NO: 31640 - DNA, 211 bp, Homo sapiens
ttaaaaaccaaaaatcaactacttgttcatgttcatagaagtagcttgctagtactgccaagcattgcattaaatatggaatatcttcttacggaatatcttcttccttaaattttaacaatgtggctaagtttagttgatgagcctcaaatattaataatctataatcattcatcttctatttaactagtaaaaatctttggccctccat

SEQ ID NO: 31641 - DNA, 113 bp, Homo sapiens
  misc_feature 48: s=g or c
  misc_feature 49: n=a, g, c or t
  misc_feature 50: s=g or c
  misc_feature 51: n=a, g, c or t
  misc_feature 72: d=a or g or t
  misc_feature 73: n=a, g, c or t
tcattttcaaaccactgtatctctgcgcacatctgctacttaccagcsnsntacatgatggagggtttttgdncctgatccagtggccacacctgtctttgaaatgtctcact

SEQ ID NO: 31642 - DNA, 277 bp, Homo sapiens
tatcccttcctttaccagttagaactaaagagtgtgatgtatgaacacactgggttgggattttctgttgaggatatgcagggcattttggcatgaggcaaatacagaagcaagatttcattctacttggtgattgaatcatgacagtcctcattccaatctctctttaattctctctggccctgcccacactctgtatttgaaaatcttgtttttgctctttccggagcttcacccctctacttacatattgtaaagttgtataaatctatcattt

SEQ ID NO: 31643 - DNA, 67 bp, Homo sapiens
  misc_feature 2: n=a, g, c or t
  misc_feature 3: n=a, g, c or t
  misc_feature 4: m=a or c
annmgcggggaacaccaatggcggggtacttgaagctggtgtgtgtttcctttcagcgtcaagggtt

SEQ ID NO: 31644 - DNA, 103 bp, Homo sapiens
catcggtaagtgatttggttctaaaaaatgcattcaggctgaggctgtgtgatacttacatacctcaaggctaaagagtttccattgtgcaaaaacctggtcc

SEQ ID NO: 31645 - DNA, 333 bp, Homo sapiens
  misc_feature 126: r=a or g
  misc_feature 129: k=g or t
ttactctctcattttgttgcatttcatctgatggtcgcttcctgaccaagggcgtgtgaaggggaaagtgttagaagcttcctaggtgtctttggtgccacagagtatgcaaagaagggataaggragktaagcctcatttgttgagcacctactatatgccaagtgctttctccatgacatttctaggaaatagaaataattttctcctctttgcagatgaagaggttgagagtggagtggcttagtaatttgcttaaggttaagcaggtggcagaactggaatccagatccatgtttatctgattcttgccattctccacacaccgcacat

SEQ ID NO: 31646 - DNA, 108 bp, Homo sapiens
  misc_feature 48: m=a or c
gagacaatcaggaaaaattgggtattagatattattaaagaattagtmatttacttaggatgatgatattgttgggtttgttgtaagtccttgtctcttagaaatcca

SEQ ID NO: 31647 - DNA, 250 bp, Homo sapiens
cttcatctttacctctctcgttgcacagaacaatgatttttcacctagatatactgcttcctaattgatctgccaggatatattattacccctatttttcacacagcagccatttttaaaaaatgtaaaatctgatcatgtcactccccatatttttattcttaaacaagtttgtgggaaagtttgtaagtttctgaaaaaaaaagaaaaaggaaggggaccatgttgattttgtcctttctagtccata

SEQ ID NO: 31648 - DNA, 444 bp, Homo sapiens
  misc_feature 283: n=a, g, c or t
  misc_feature 387: k=g or t
  misc_feature 415: k=g or t
aaggctccactgctggcctctggggactgaattccatccgggtggcattcattggctgcccgtggcgggagaggctgggggaggggattgctgagtttctaaggggctttagtctggacaatgaatcacaatatcccctcctggaaaggctgcagtgaggcagctctgtttcattctactgccaccgcctctggtcctagaaaacactgagtttctggtggggagaattgagggagtggggaggcaaaatcagagacaaatgcccatttctcttcccccctcnagagaaaaccagggcagagaggcctgggcctgtggagccagaactgggtggtgactttgtctttgtcatgctggggttggggagagggagtcctttccagcagkgagtgtgtgtgtgtgtgtacacacgtakgcatatgtgcctgtgtggtggggtctggc

SEQ ID NO: 31649 - DNA, 476 bp, Homo sapiens
  misc_feature 381: m=a or c
gttccagatttttgctgagaagtagttactgtgcacatgtgtagatttgcagtttaagcttgaagcgttcgtaaggttctcaaagactacagaagttggaaacttcgcggagagactgcaaggttaccctttccaaaatggcgggaagggctaaaaacaagaaagctcgcacccagacggcgggccttaaaccaaggcgaatccgtgacgcaacacatctgcttctgtggctcctgatggatctgagaagatggacgtggaggatgaaaatctgtctgattattttgaactgatgtttgttgctatggagatgctgcctatatgttgatgttgcagacgttaagtcactagcccacagccttgtattccatactcagagamcctgctacttacttgacatctcaacttgaaagtccaattaatatgcacttcaaactttaataggcttcaaacagaatttctttcattatctctgc

SEQ ID NO: 31650 - DNA, 324 bp, Homo sapiens
  misc_feature 65: s=g or c
  misc_feature 122: s=g or c
  misc_feature 125: k=g or t
tatcgaaaccatcgcctaagtagagactattatcctcattttgcaaattgaaaaccaaagctgasacaagtttaagtagctcactcaagatcacactactggctgggtgcagtggctcacgsctkgtaatcccagcactttgggaggccaaggcgggtggaccacctgaggtcaggagtttgagaccagcctggccaacacggtaaatctcgactctactaaaagtacaaaaattagccaggcatggtggcagatacctgtaatcttagctattcaggcagctgaggcaggagaatatcttgaacccgggaggtggagttgcag

SEQ ID NO: 31651 - DNA, 387 bp, Homo sapiens
  misc_feature 121: k=g or t
  misc_feature 291: n=a, g, c or t
  misc_feature 322: d=a or g or t
  misc_feature 323: n=a, g, c or t
  misc_feature 324: r=a or g
taaatacaggcactatgtcttcttcactgttaaatccagaaagttaggaaatgactacagcattacagtatattcattcattcctccaaaacattgtaaactgatgtaatgctattaaggktaaccagcatttgataaatgtatgaaatagcagtttccctaccccaaccaaccttccatctaaatgggtaaatacttttaagatgagaatttcatttacacctttcaaaattattactaaaaatttattagtatatgaaggaaaaaaattaatcgttttacctttaattnaactttgttaggaagtaaaaattacccatadnrgataattcttggccaggaatggtggcttatccctgtaaaaacagcactttgcgggggccaagc

SEQ ID NO: 31652 - DNA, 353 bp, Homo sapiens
  misc_feature 126: k=g or t
  misc_feature 130: w=a or t
  misc_feature 135: k=g or t
  misc_feature 204: r=a or g
taacaagacactaatgaaagagagacttgtatcatatcagtgtgaaatgtcctctacaatcactatttttatcataacatacatcatgtattaggttcactagctgttagctactgagctaaagtkgctwaatgkgcaatatcttatgtaatcttccatacgaccctgttagctccatttgcagttaagaaactaagttgagaracttaaagtaatttgaccaagctattactcagctatcctgcatcaaatacatacatttgtctggctctgaagcctacactattaccctttaagcagtgattgcgtaatagaaatgtccatcagaagaaattgtccctaatgcaggccct

SEQ ID NO: 31653 - DNA, 366 bp, Homo sapiens
  misc_feature 129: m=a or c
  misc_feature 134: r=a or g
tttcaattaatattaattttctacaaataattttagtgtcatttccatttggggatattgtcatatcagcacatattttctgtttggaaacacactgttgtttagttaagttttaaataggtgtaatamcccargaagtaaagatggaaacgttaaaagaagagaaatgtagtattttgggttacctgattagagtgaaaatttttacaatcatattattccttgtgtcttctgaatggtttccgattttataatggactgccctatatagtaacaagtatttcatgcttgagctatttcctgctttcagggtttcttttttctagttcttcatacacacacatacacacacacacacacacacct

SEQ ID NO: 31654 - DNA, 262 bp, Homo sapiens
tccagatcttagaagaaatgatttcagtttttcctcattcagtatgatactagttgcatgtctgccttatatggcttttattatgttgaagtatgttccttctgtacccagtttcttgagggttcttctcatgaagggagttgaattttatcaaatgctttttcagcatcaattgagatgatcatatggtttttgtcctcattctgttgatatgatgtatcacattgatttatttccatatgttaaactatccttgcacccc

SEQ ID NO: 31655 - DNA, 216 bp, Homo sapiens
attatctttgataaaaagacaaaaagaaatcaactggtaatctaagtccttcttagggtaaggactaggctgtcttttgtatttattcaactcaccttatttagcaaatatctgtaatactgtaatacaaagcttcccccaagaggcttaatcaaaatattagctgtatacacaaagatggatttttagaacccaagttcttaattctgctgtgct

SEQ ID NO: 31656 - DNA, 210 bp, Homo sapiens
  misc_feature 125: k=g or t
  misc_feature 128: r=a or g
catatgttaaaaatctggagaaatagataaagacatggaagtagagacatggaagttataaaaatgatccacattgaacttacagagaggaaagaccatgtcttaaatgaaaagcatactgtgtkggrattatcagcagattagactttgtacaagaaaagattcatgaacctgccaacacagcaatagaaactattcaaaataaaagag

SEQ ID NO: 31657 - DNA, 226 bp, Homo sapiens
gtctgttcctaaatcaacttaaaatggtaaatattggttttctgacttctccagataacatgaatagatgtactgcatttattcaatagctataaaagatattgctgaagataaaagcagaaaaaaaagcatttagttcagttgcagagtctggaagtgatgctatattccgtctatccaattactgccaaactagtcagggagaagtacatttctttgaagagcg

SEQ ID NO: 31658 - DNA, 228 bp, Homo sapiens
  misc_feature 144: m=a or c
tttttatgatatctttcaggtaatcatgtgtgcaagtcagaatttccattttctatcatgggaagttacttgaagaatgttgctgttccttattgtatactttagtgtgcacagtctaaagaaaaagtgagctactacaaggamctggtggagactgaattactagggaagaaaattgggataaaactgttgggcaaagaagtagaaagggcaacggaaggggttgct

SEQ ID NO: 31659 - DNA, 147 bp, Homo sapiens
tcctcaataagaaacaagcaaggcagagaaagagttaatattaaacatgaaattgtaattactttcatgctaaggagcatgcagtatatattgtatattttatctaacatacagataaaattccttttgaaagtatataccagcctt

SEQ ID NO: 31660 - DNA, 72 bp, Homo sapiens
tcactcagatcgttggtgatagactctctcttaaaacttatttatcctaatctttttttttttttttttttt

SEQ ID NO: 31661 - DNA, 357 bp, Homo sapiens
  misc_feature 344: w=a or t
agaaaaacaggcggcgtacaggtgggcagcacgttgccatgatgtgccgtggcccggccgtggctggcgtgatcccaccagagtgagctggagcagatctgcaccatgggccaagtttctcagaaaatacatggcttcctgcgggctgcagcctaatgcccacgttcctctcggggcagaccgaagttattcaaccagggcaaaggacagccttgcaaaccaactacgtcctccttctggagtttgtgtgacccctggcccctgagcccacaccctctcggagcggggttccaactccgtggaagctctgctgagatgcaggtccctccctcgacacctggggwtacaattagagat

SEQ ID NO: 31662 - DNA, 118 bp, Homo sapiens
caggtttgtgaaggttccagagaggacctgtctttgggaggagtgtgggagactgagatgggggaggggtcattggaatgatgcgggcgctacttggcattgtccattgtgaggcacc

SEQ ID NO: 31663 - DNA, 134 bp, Homo sapiens
aagattacaaccacaggctgggcgcggtggctcacgcctgtaatcccaacactttgggaggctgaggcggatggaacacgaggtcaggagttcaagaccagcctggccaagatggtgaaaccccatctctacta

SEQ ID NO: 31664 - DNA, 324 bp, Homo sapiens
  misc_feature 190: n=a, g, c or t
aaatagaaaattgaatgctaatcttagtcactattctacataattattccaaatacctgtattttctattttcaattttattttagtgatttaaaaatttaggaaagtttcacatctctacacagatggaatgcatagtgtaacaagcttttgtgtatctgcaaaagcttctgcagttaccaccacatgnccagtcttgacaacatgcacctctacgcaaattattctaaatacctgaattaattaatttaatcctcaaaacaatctacgaagcaggcactataataagccccgttttacagaaggagaaaatgagacacaaca

SEQ ID NO: 31665 - DNA, 112 bp, Homo sapiens
ggttaagttacactcacgaccctgtaaggagaaaacatataattctagtaattttattgggcttaggtttcaggcaaatggaaataaattgcctctaaaaagacagaccctc

SEQ ID NO: 31666 - DNA, 437 bp, Homo sapiens
  misc_feature 160: w=a or t
  misc_feature 166: k=g or t
  misc_feature 170: k=g or t
  misc_feature 318: n=a, g, c or t
  misc_feature 319: n=a, g, c or t
  misc_feature 320: n=a, g, c or t
  misc_feature 358: r=a or g
  misc_feature 433: k=g or t
tgggtttgggttgaacatggatttttaaacttcttaggacctttcctacacagatattctgggattttcaaataaggtaattcagatgcaaaatagcagtttggaaacaaattgcttttttagggtacattttttaaaagacttccctacatacttttawttctckttaktaatatagtagatagcaagaatagaaatgtgggtttatgaattgacatgttcttaatcatataaaaatcaaattccttgcccaaatcatctctattagaagggacattttgaggaataaagttttaatatatgaaaacttatgaacannntacaataattactaatattcatttacttggatcactgraaatacctctaaagtacaatatagagagattttaatttaaataatattccagaaaagcttactttagattatttkaatt

SEQ ID NO: 31667 - DNA, 244 bp, Homo sapiens
aataagggcgagggagccgggccgggggtgtttcgggtgtccgaaggcgagtccgatcggaccaggaagtagctcaggggagcctgacctcgacccgcctttctcctcacacgagctgaggaggcagggaagtaccgagggcagtcaagcctcccctggggttggttcctgggactagatggagctcagtctctggattctccctctttctcggccctatgcttcctgacagacctgcccgcca

SEQ ID NO: 31668 - DNA, 357 bp, Homo sapiens
  misc_feature 155: s=g or c
tcctgttagcttttcagaacaggtgcaacaatggcaaaatctcaggtactacaaccaactacaagcgactatgagaaagggtttgttgagagagcaagcacatgtgtcactaatgttattcctctgttctccctgctaactctattattataaascaccagggggatagaaaattgacgagaattgaaatgctcagcaggattccttggcccattcaattctttgctggctcaaaacagtgctagcaagaattgctgtggagagtgactagcagtcatacactcacaccatgctgaatttctcactgatggtcagttaatctatatgtttggaatatagttctggaatggatgatag

SEQ ID NO: 31669 - DNA, 275 bp, Homo sapiens
  misc_feature 173: r=a or g
  misc_feature 174: n=a, g, c or t
  misc_feature 229: n=a, g, c or t
ctctttgtttcagttattttattgccttttgttttcagtaaaatagaggtcctcagtggagagtgaggatggaggaggatatgttgggggtttgaagagagaggagaaggtgtgaaatactagcaagaagcgtaatggacttggggcattgagtatgacagcctggcagatgrnggattcacttgaggttcatggtcatgaatttaaggtgagagaccagtcagcatgnttgcatgttttgcttccacaaagttccactgtaatcttgtagagga

SEQ ID NO: 31670 - DNA, 346 bp, Homo sapiens
tttttttatttaactcatccagattgaaataaattgaggatgatagttgaactatgtaatttaaagagatgacagagtgaatattacattttctcttcagttgttattctagttatacatacaaaaatgggataaaggccaggcatggtggctcacgcctgtaacccaatgctttgggaggctgaggcgggcggatagtgaggtcaggagattgagaccatcgtgggcaacatggtgaaactggtttctactgaaaatagaaaaattagctgggcgtggtggtgcatgcctgtagtcccagctactcaggaggctgaggcaggagaattgcttgaacctgggaggc

SEQ ID NO: 31671 - DNA, 91 bp, Homo sapiens
  misc_feature 71: m=a or c
aatcttatgtatgtaaaaccccgttacgatgtcggcgacggggcccatcagtaactattacgtggactcgmtcatctcacacaacatacga

SEQ ID NO: 31672 - DNA, 98 bp, Homo sapiens
agggctgagttttggagaaactgcagagacagtactctaaagttagaatctcctgatctttcacgagatgctggactggagattggcaagtgcaccaa

SEQ ID NO: 31673 - DNA, 383 bp, Homo sapiens
aattttattaataattgtgtaaaaataatatccctgcccatagcaaaaatttagtacaaaaggggtataaagtgaaagatttcatttcttccattccaagtttttagaagtaaccactgctgatagttttttgtatcctagaaatttcctaatcataaacgaattgaattatatgtattgcattgtaacttgctcttttcactttattatagtaccttatattttacaatatcagcatattttaaagcagcatatacattgtatttataaatctaatcatccccatggcttttagaaatgcaaaaattttatttaaaactcatatatgtatatgtatgtgacttagtgttttttcttccaggaaaagtggtattatataatta

SEQ ID NO: 31674 - DNA, 429 bp, Homo sapiens
  misc_feature 355: r=a or g
  misc_feature 360: d=a or g or t
  misc_feature 373: r=a or g
tggtattaaattatttaaggaattttaccttttatatctcctagcattgttatgagacttaattaaaataatgtgtgcaagctcaatataggaaaccattgttaccatatatcattatgatgtgtttttttttctgtgtatatctgtgtgagaattaccaccttgatcacattgttttaaacatttttgtttacttgtctttgatccttgaaggcagagatgatctttataggccttattgatctctatatcctcaacatttaacacaccaaatagcatataatgggtaattggtgaatgcttggtgaatgcttagtgaatgaatgcagggagaaatgtctaataggaaataggracacdttactctttaggrccagtcaaagctggtgataaaagagttgaaacctgagctgctagagtatagaaaaa

SEQ ID NO: 31675 - DNA, 245 bp, Homo sapiens
cctaggttgtttccatatcttggctcctgtgaatagtgctgcaatgcacataggaatgcaggcatctctttgatacactgatttcatttgctttgagtctgtgcctagcagtggaattgctgaattatgtggtgcttttatttttaatgatttgaggaacttctgtactgtttttcatagtgactgtactaattgacattcccaccagtggtgtacaagggcccccttttctctacaccctcccc

SEQ ID NO: 31676 - DNA, 242 bp, Homo sapiens
ttaagagctgtgagataaaagataacctataaagcaaaacctatcagattaacagcagatttctcagcagaagctttacaagtcagaagggattggagtcttacctttcacctcctgaaacaaaataatgtcaccctaaaattttctatctagcaaaactaagcttcataaatgaaaggaagataaagtcttcttcaaaaacaaatcctgacagaatttgccacccccaaacaagcactaca

SEQ ID NO: 31677 - DNA, 196 bp, Homo sapiens
tatcctcagtaagagctagcctgactgaccacacttaccgttttccacatagggatgaaaggggaggacaagggcaaggatgaccctgcctctagttggctccaagacacttctgatatcttttaacaaagtcaggggctgatcacagcggtccagcaagttcaggcagctgatgacatcatactggaaccccgcc

SEQ ID NO: 31678 - DNA, 468 bp, Homo sapiens
atatttcgggtcagtggacacaggagtgggttgggaggctgggcaggggatcttcctggatctgaagatgaggttggaaatggggggacttcaaaggaagagggagctccaaggagaaagctcttaagatttgagaggaacctttctggttggaaatccaggagaggggacgctgggctgggggggttctcggatttgggcttctgggtttgggggctgtgagagggctggtccgaggaaggacctcagagaggggtgagctgagaagggggctctaaagaaggaagacttaagatcctgggggagctctcgggctcgtggtgggtgggtgtctatgacagggagattcctagacttcgagaagtggagttgaagagtgacgcctcctgggtttgggggtgctcccgggatcttaagtggggatgggtaatgaggtctcgaggagatgcttttgattgtagctggggc

SEQ ID NO: 31679 - DNA, 403 bp, Homo sapiens
tatcttaagtcttttccggtgtaatcaagaactctttgtaaacattctgtcatatagatattctcctaattgaggacatttaaattgttttcatttctttctcttattactgtgtgcatagctctctgtctacattttagattctatccttagaatggatttctaggaggaaaatcaatgattattttcttgtagactcttgagttattttatttttctaataattagctggtctgtaattttatgtaattaaaaaaataagggtgcatggatgatacattttctgagtccttggctctctgagaatttttgcctttatacaaaaaataccactttacagataatgcaattaatcctgatctttcccactcaaaattctgtggattctacccctgttgtccac

SEQ ID NO: 31680 - DNA, 109 bp, Homo sapiens
ttactggaccataggcatttcccatcctgcttcttttaagttattcatgaaaaaattaaaaactatgttctttgatactttaccctaactaaccttttttttttttccc

SEQ ID NO: 31681 - DNA, 266 bp, Homo sapiens
  misc_feature 30: n=a, g, c or t
  misc_feature 136: y=c or t
  misc_feature 141: w=a or t
  misc_feature 146: k=g or t
  misc_feature 149: r=a or g
cttttaacattttgatgttcttatattaangtatgtcttctgtaagtagcacataattgactttgttgtttgtttttttatccagtattctactttttttcttttagttggtgttttcggaccatttatacttacyaatawtaacktgrtatatttaggtttgttttcaatttatcccatctgttttatgttcctttttctgttttattttgtttttttgtaggattaattaagtattttaaattattttaattttccagcccgga

SEQ ID NO: 31682 - DNA, 477 bp, Homo sapiens
  misc_feature 22: m=a or c
  misc_feature 45: w=a or t
  misc_feature 132: y=c or t
  misc_feature 360: w=a or t
  misc_feature 361: m=a or c
atttcaagaacagctttggctmattgtggccgcagaatctggcawcacaccacaggctttgttgccttcagtgccaaaagccaagaaaaccagcccttgctggccttggagcgagcagggagaagaaaaatycggaggaatacattgtctgactgtcgccgtggacaagtgttcccgtgcaagcagatgacctctttcccggaacaaagctccatgttttaatagcagaaatctcccagaaggaaatgtcaaggtgagaaaacaggctgagagaagttggaagaaacacaggagcagggatcccacattagacagtctgattccagagatcaggaccttggctgcaacactatatgggcwmtgggaaatccaagaggcctgttttcacctgcacagcatttctacctgcccatgaaaggcagacttatgcactttgatgtcaaagaccaaccagaaaggtaactttagagatgctca

SEQ ID NO: 31683 - DNA, 462 bp, Homo sapiens
  misc_feature 130: w=a or t
  misc_feature 133: r=a or g
  misc_feature 139: d=a or g or t
  misc_feature 143: k=g or t
  misc_feature 357: h=a or c or t
  misc_feature 417: v=a or c or g
  misc_feature 418: w=a or t
aaaattgaggccaatggagattaaggcgcttgttcaaagttacatagctagtaagtagcagtgtctcatcctaactgaagtcttactcccaaactataggtacattaatgtatatattaatataaatcawtartggtgdattkgttaacataatttagaatttacatacactatgtgtatttgccttcccaggatttttccctgccttttatattccctgttctttccctttttgcttacgcacacttaagacatagcagtgcccctaatcactacctacctgacagaggcagaagtaatcaacacaactgtgtaagtgaagttactaatatattctgattatggattggaaactchcacctatgttaatagagttaaaaataaagtaaaataatcatagctaccattggtgggtavwgggaggattacactagaatgcattttttaatctaaatagaaaac

SEQ ID NO: 31684 - DNA, 368 bp, Homo sapiens
  misc_feature 119: r=a or g
  misc_feature 127: r=a or g
  misc_feature 129: r=a or g
  misc_feature 133: r=a or g
  misc_feature 135: m=a or c
  misc_feature 139: n=a, g, c or t
  misc_feature 142: r=a or g
  misc_feature 145: r=a or g
  misc_feature 167: r=a or g
  misc_feature 310: r=a or g
  misc_feature 358: r=a or g
cactaaatcccacatcaaaaagttaggaagaactcaaattaataacctaacatcacaactgaaagaactagagaagcaagacaaaaccccaaagctagaggaagacaagaaataactgraaatctgrarctgramctgnaargaracccgagacatgaaaaaaagarattcaaaagatctatgaattccgggtaggtttcttgaaaatattaataagaaagtctgctagcagactaatacagaggatgattgaaagaaacacaattagaaatgacaaagggaatgttaccactgaccccacagaaatagraacagccatcagaaactactgcaaacacttctatgcatacaaactagraaacttcaaa

SEQ ID NO: 31685 - DNA, 291 bp, Homo sapiens
  misc_feature 127: w=a or t
  misc_feature 129: s=g or c
  misc_feature 133: w=a or t
  misc_feature 136: m=a or c
  misc_feature 141: k=g or t
  misc_feature 145: y=c or t
  misc_feature 161: k=g or t
  misc_feature 163: k=g or t
  misc_feature 168: k=g or t
  misc_feature 170: k=g or t
  misc_feature 177: k=g or t
  misc_feature 205: y=c or t
  misc_feature 206: n=a, g, c or t
ccctactctattcttccctgttcaatagtctgcatatttgagcttcctgctaaatatgttatagaggttaaataactgcctttgtcttgcatcccacttcctctttagctgtagagtagaaccccawgsacawtamccatkgggyctcaacaaatcttttktkttgtktktgttttkgttttgagaaggagtcttactctgtcgynaggctggagtgcaatgacatgatcttggctcattgcaacctccgcctcccgggttcaagtgattctcctgcctcagcccccccaa

SEQ ID NO: 31686 - DNA, 167 bp, Homo sapiens
  misc_feature 122: r=a or g
  misc_feature 139: m=a or c
  misc_feature 142: m=a or c
  misc_feature 144: y=c or t
ccttttctgggaacgtgagtatcaaccaaggctggagtgcagtggcaccatctcggctcactgcaacctctggctcccaggttcgagcgattctcctgcctcagccccctgagtagctgggrttacagggacggcggcmacmaytcccagtttacaccccgcctact

SEQ ID NO: 31687 - DNA, 122 bp, Homo sapiens
  misc_feature 107: k=g or t
atttttagtactcctgacgtcaggtaatccacctgcctcggcctcccaaactgttgggattacaggcttgagccaccacgcccagcctctattattgtttctaattktcttgatgtgaatgt

SEQ ID NO: 31688 - DNA, 421 bp, Homo sapiens
  misc_feature 93: n=a, g, c or t
  misc_feature 97: n=a, g, c or t
  misc_feature 98: b=c or g or t
  misc_feature 123: v=a or c or g
  misc_feature 129: k=g or t
  misc_feature 138: y=c or t
  misc_feature 139: k=g or t
  misc_feature 153: s=g or c
  misc_feature 154: v=a or c or g
  misc_feature 313: w=a or t
  misc_feature 314: n=a, g, c or t
  misc_feature 319: k=g or t
  misc_feature 367: s=g or c
  misc_feature 385: d=a or g or t
  misc_feature 393: s=g or c
aactcaagacacctgcagcagggcgtgagaaaaagtaaaagaccagtattttcacattgccaggtaccagaaacacagaagactgacacccgncacnbaagtggggccagggctggtgtctgvccatgktgccaatcykgatgggctgcttgsvacaatgagggatcttcttcaatacatcgcttgcttctttgcctttttctctgctgggtttttgattgtggccacctggactgactgttggatggtgaatgctgatgactctctggaggtgagcacaaaatgccgaggcctctggtgggaatgcgtcacwnatgcktttgatgggattcgcacctgtgatgagtacgattccatacttgcggasatcccttgaagctggtgdactcgagsgttgatgattactgcagatattctagct

SEQ ID NO: 31689 - DNA, 235 bp, Homo sapiens
tatgactccccagagtatgacacagtgaagttcagatcccagactccatttgagtcttacgaactaaggtcagctctacctaatcttttagtgctcagactggtttctgtcataacttgttagtgccaattaaaaagccgtaacggaaatagggcaaaaaaatttttttaatgaatgttcattaccataaacgtagtggcaacacaaaatttattgtcatacagttgtggagcat

SEQ ID NO: 31690 - DNA, 180 bp, Homo sapiens
  misc_feature 129: r=a or g
  misc_feature 130: m=a or c
  misc_feature 135: y=c or t
  misc_feature 140: k=g or t
  misc_feature 144: r=a or g
  misc_feature 145: r=a or g
  misc_feature 157: r=a or g
cattcctaagacatggttactttattttccccttgttaagacataggaagacttaatttttaaacggtcagtgtccagttgaaggcagaacactaatcagatttcaaggcccacaacttggggactagrmcaacyttaakgttrragggaactctgrccacctgcgtgcaacccacaggc

SEQ ID NO: 31691 - DNA, 75 bp, Homo sapiens
gaggcgcgatggcaggtgtcggggctgggcctctgcgggcgatggggcggcaggccctgctgcttctcgcgctgt

SEQ ID NO: 31692 - DNA, 413 bp, Homo sapiens
  misc_feature 120: k=g or t
  misc_feature 131: r=a or g
  misc_feature 188: k=g or t
gacacaaccttgagcacagttgattttggacagctgctgtttattaggaaagggctccaggtggcaaaggtgcatacttcctcagacacaggtgagaagatgcagcaccttccacaggtkgattgggacgrattcgaagtgagcaaagggattcacaaattatgtatttatttgttttcatagttaaktagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccaga

SEQ ID NO: 31693 - DNA, 305 bp, Homo sapiens
  misc_feature 117: r=a or g
  misc_feature 120: m=a or c
  misc_feature 127: w=a or t
  misc_feature 130: y=c or t
catttgatcataggaacagtaatagtttgacccttaaataaaaacatcactaatgcagttctgtgccagggcacacgtggtagctagaccagtttctattagccctaaaagtcagcrtamtccaaawacyttggaatctgtactagtgccagataaacagggagacaatggagccttcccttctggataggatgatccaaatttgttttcacattcacagacagctcttaatgtatctggtgataaatgcaaagccaatacaggcaaatgcttgaatacctcatgatatgctattctcaactctg

SEQ ID NO: 31694 - DNA, 326 bp, Homo sapiens
  misc_feature 118: w=a or t
  misc_feature 119: k=g or t
  misc_feature 122: s=g or c
tctgatcccggcagcagtgcaggataattgtgaaaacattgtccagcgggcaccgtggcttacaaagcacttttctgaataggatcctattccacgttcaaacagccctgtcaagcawkgcsggccccatttttacagatgaggtcttagctctgagtcccattcattctcagaacaggagctttcttattccacaacccgagctcctgccactgactcctcaggtcctgtttctgcaccagaaactcccagctcaacgaaaaaggtgttagcctcttcctgtagggctcttaatattatggagaaaatcctatttctgcccccca

SEQ ID NO: 31695 - DNA, 214 bp, Homo sapiens
  misc_feature 125: w=a or t
taaaaaattatggtattcttatttatttagaaatgcctattctttgcagttttcacattcataactgctcccatagtaattcaaaatgtccttagccatgtggtcagtgatccctcctaataatwagatttagcaaatttcttcttttgatccattttcaatttggtactatggcctcttgttcggcagtttgtacgctttgttatccaggtat

SEQ ID NO: 31696 - DNA, 253 bp, Homo sapiens
  misc_feature 121: r=a or g
  misc_feature 127: s=g or c
  misc_feature 156: r=a or g
  misc_feature 157: r=a or g
  misc_feature 175: r=a or g
ccctttctaaatagaacacatttttaaaaaataagttatgtttgctactaaaacatttacactgttagactattatgtgcatgttgccaagactcttaagtaacttggatatcaactgtgraagggsctacctctaaaaaagtaacaggtcatacrratacaaatgtaactgtaraaattccactggattcttgcatatttgcaagattagattattcaaaagaaatttcagtgctaaaattaaccagcaacg

SEQ ID NO: 31697 - DNA, 268 bp, Homo sapiens
  misc_feature 124: r=a or g
  misc_feature 134: w=a or t
gagacaagagtggtttccccagaatttccaaaccccctcctagcacaaacacaggtatataatctccactctctctgcctcatgaacaagacccctctagcggctctagggtttgccattacargtaattggtwataatgagtgtcagctcatttgtgtggactccacccttccccaggcttccttgttcctttctttctgacacaagagatgagagctagacctgttggaaacttttacaaatctctctatcccgcctccaccctta

SEQ ID NO: 31698 - DNA, 407 bp, Homo sapiens
  misc_feature 118: s=g or c
  misc_feature 121: y=c or t
  misc_feature 124: k=g or t
  misc_feature 127: r=a or g
caaactttagtagtacctagaaaaatagataatataatttttataaaatattgaaggagttagttttattaagaagaagggcaggtcgggtgctgtggcttatacctataatcccagstcyttkggraagccaagggcggggtggaacacttgagcttagaagtttgaggccagttttgacaacatggcaaaacctcctgtctaccaaaaaaagaaatcataaccaaaattagccgggcatggtgatacgtgcctttggtctcagctactcaggaggcttgaggtgggaggatcacttgagcctaggaggttgaggctgtagtgagctgagatcacaccactgccctccatcctgggcgacagagcgagaccctgtctcaacaaaaacctaaacaaaacagaggatg

SEQ ID NO: 31699 - DNA, 187 bp, Homo sapiens
  misc_feature 115: k=g or t
attgtcaaaaagacatcaaactcaacttctgggaagacagatttttaatacacatacttggctaatactcacaaacatatctaaagttttggcaaaattatgagggtgatgggtkggtactaacctggcatggagcaggtgtgtcttttggtttcttatgcagttgactctgctgcagggagattcg

SEQ ID NO: 31700 - DNA, 230 bp, Homo sapiens
  misc_feature 210: v=a or c or g
  misc_feature 211: n=a, g, c or t
caagtgattctcctgcctcagcctcccaagtagctgggattacaggtgcatgccaccaagcccagctaatttttgtatttttagtagagatggggttttgccatgttggccaggctggtctcgaacctcttggcctcaagtgatctgcctgcctcggcctcttaaagtgctgggattacaggcgtgcgccaccttgcctagccagaatgvnttgaaattttaagtggggt

SEQ ID NO: 31701 - DNA, 262 bp, Homo sapiens
  misc_feature 123: w=a or t
  misc_feature 124: b=c or g or t
tgatatatattttcagatgtagagggccacacttctaagatgtccaggttcaactgcaccattactttgattcctaccccgcaaaacatcagctactgtgttcctcaaacttgtttacaaaawbcaactataaatattacataatgccttttagttaaagaaaattaaaacaacggaaggaggaaattttctgcagggactttcttgtaaccccttggaagaaaacattctctcttccctttctgtcttgctcatggccaga

SEQ ID NO: 31702 - DNA, 212 bp, Homo sapiens
  misc_feature 124: k=g or t
  misc_feature 126: k=g or t
ttggctgcttcttctttttatcccttggtaaatctcaagttttatcagacgttcatcagagtaatttgagaaagatggaatcttacaggctgtactgtctgttcatgaaatatctttttgaagktkgaactctgataggagtattttttaaaaataatttagttcctttgtacttgttttttctatttaattagaatctgagtgagctgcca

SEQ ID NO: 31703 - DNA, 189 bp, Homo sapiens
atcgagcttcctgcagcggtggccacccgagcaagtgccgtggcgggggcgcctccccaagtagcccgttgcgtccgaccccgcgtgaaagatggagtctcgctctgttgcccaggctgaagtgcagtggtgtgatctcggctcactgcaaccaccacctcccaggttcaagcaattcttctgcctcct

SEQ ID NO: 31704 - DNA, 352 bp, Homo sapiens
  misc_feature 120: s=g or c
  misc_feature 126: k=g or t
  misc_feature 129: k=g or t
cgacttagtcaggtatttggtcttttgagttaaacagaccctggtgatgagctctttgccttggacagattactttacccctctgattctcagctttctcactgggaaaagcagacctgsctcagktckgattcaaggattagtcagccttagcatactttaagtacttcattattattattactactgctagtactgcccaaaggccagaatccgtggagccttaaagacgcgaactcaaactgtttttggttaaatcatctttgtctcagtcatgggagtggtgtacaaatactccaatcagtttagattcatgcagcctttttatctgttgatgcttcttagccctcct

SEQ ID NO: 31705 - DNA, 274 bp, Homo sapiens
gagcattggaaaaaccaattctaaaatggctaaaactaggactttcaagttcaccacaactaccaccaattaggagataattgtaaaagaataaacaaaacctaattttgttcctagccaatatttataaaccatgttccagcatactagataatagtagcatactatatttatttccataatttgtcttctttagagcctatgaactcctaggagcagaagctatattctcttcattttgtcatctcagggtcatggcatataccaacagatc

SEQ ID NO: 31706 - DNA, 326 bp, Homo sapiens
catctttttttatattattgaaacctgaatttaatatgactattaaactttctttttataaagagtttggattctgacaagcccatggaaccagtaaaaagatctcctcttcgccagggaacaaacatggccaacttttcttaccgcttctccatatacaacttgaatggtaagatgtaattggaaataaaatgtaaaatagtatgctaagtcacacaatgtaggagcagtacaactgcaattcccaatataaaaactcgatataaaagctacatgcataacttgaccaagttcttaaatttcttttttcttttcttttttctttt

SEQ ID NO: 31707 - DNA, 177 bp, Homo sapiens
cttcagagggcaaaggggagactgctgagtcactgtggccatttttagataaaccttttcctgtttataataacacatgctgattgtaggaaactagaaaatacatgaaagtgcagagaaaagactaaaagtcatctatacttcaggtcgtagaataaccactctgaacagcaccgt

SEQ ID NO: 31708 - DNA, 421 bp, Homo sapiens
  misc_feature 272: v=a or c or g
  misc_feature 343: r=a or g
  misc_feature 344: n=a, g, c or t
tcaggatacagaaatttatagagacaaagtaaattagtcattgcttagggctagaggggaaagaaggaaatggaggttgactgctaaacgttacatgtttttttaaaaaagtggaggccggggcgaggtggctcacacctgtaatcccaacactttggaggccgatgcaggtggatcacctgaggtcaggagtttgagactagcctagccaacatggtgaaaccccttctctactaaaaatacaaaaattagctggcatggtggcgggtgcvtgtagtcgtagctacttgggaggctgaggcaggagaatgacttgaacccaggaggtggaggttgcagtgarncaagattgcgctgctgcactccagcctgagcaacagagtgagactccatctcaacaacaacaaaaaaaaggagtagg

SEQ ID NO: 31709 - DNA, 229 bp, Homo sapiens
  misc_feature 202: d=a or g or t
tgtctcttgtagttcatgtttatccctaggctgaaaaactttaaaccatttttagccccttccttcgaggatattgcctagctttttgatttatgtaacttagattatgtaggtcaattcgttgactagaaactcatctaaataaggtttacttctaatcttggtgtttaaatagctttgggggaaaatgtgcttaactaadtgtttttttcttaaagtaaggcagtga

SEQ ID NO: 31710 - DNA, 146 bp, Homo sapiens
  misc_feature 122: k=g or t
caaataccacagggagtcaactcacgtgctgtgaattcctgatatctagaaaacaagtagtaggcaaaacttagtagtagtgaaatctgttgcttgacccatcatctgggtgtctaaatggktttttggtatctctgacctagcgt

SEQ ID NO: 31711 - DNA, 252 bp, Homo sapiens
atcagagtctggggcggcggcggtggctgcaacggtggctgtgacggtggctgccgctgggtttggctttctggatttttgttcagagtcgctaatgtatcccccacaatggcagttgatgacagcaatttatattccagaacgaagaacaaactaaattcatctcaaaatgattataaatcatcaagaaggagtagcctgccacctgaactactcataggaaatgacattagaggaagacttcaaagaaac

SEQ ID NO: 31712 - DNA, 239 bp, Homo sapiens
aattcctctcttctccctgaagctagagtgaggtccctcttggcagcctttgtatctagagagagccgtccaatagaaacataaggacatctgagtttggatgttacctttttattggaaatatgggatctgcacttagatttcactgaatttacattgaaaagagacaaagtctcactatgttgctcaggctggtcttgaactcctggcctcaagcgatcctcccacctcagcctctc

SEQ ID NO: 31713 - DNA, 248 bp, Homo sapiens
ctgaagtctggagtttgagaccagcctgaccaacatggagaaaccctgtgtctactaaaattacaaaattagccaggtgtggtggcacgtgcctgtaatctcagcctcccaggtagctggtattacaagtgcatgccaccacacccagctaatttttgtattttggtagagacagagtttccctatgttggccaggctggtgacgaactcctgacctcaagtgatctacctgcttcagcctccccact

SEQ ID NO: 31714 - DNA, 462 bp, Homo sapiens
  misc_feature 161: d=a or g or t
  misc_feature 162: w=a or t
  misc_feature 332: w=a or t
  misc_feature 333: k=g or t
  misc_feature 412: y=c or t
taccaggttttgagtgtggattttttgctttttgtttttggagtgtttattcatgccatgtcagactataacacatggaaaagataattgcatttttctttttttattattaaaaagaatcttttgtattactcaattcctagaaagaatcaggaaagtadwagtctaaaaagcagtggtttgaagaaaaacaggaagcctgcaacagaacgttttgtataggtgaatgaagattattagttaagctgcggatgcctgctttttctgccctagtagtcacaggcagagtggacatgcctctgcataatcctatttttttaaaaaatattttwkattatactttaacttcggggatacatgtgcagaacgtgcaggtttgttacgtaggtatacacatgccatagtggtttgytgcacccaacaacccatcatctacattaggtatttctcctaatgctatcc

SEQ ID NO: 31715 - DNA, 443 bp, Homo sapiens
ttgttctaatagagattataatttcaaaagggaagatgctttttaagacaatacatgagagctaaaataagttttaggttttcgtgtggctcagtttggtgaattttctccagttttcatgtaagaataagccagacctactgatagctacctgctaatttatggaaattaacatgttccaaataaacctgtctgttctattttgctgctgtacctacatttgaacacttaaagtcattctaaatggagccgtgcctttctcagtagtcagtgacagattcacacatgtgtgggaaccccgatcctgtggtaaataagagagccccttctaaaatctaaaatctctctgtacagacactttctagtttataggttgtgatataaaatttcatgtttcatttatttggaactctacatcttccaatagaaatgatattataaat

SEQ ID NO: 31716 - DNA, 231 bp, Homo sapiens
ctttcgcggggggtgggggaggtcaacagggactgagtgggggcagaggcccagaagtgccagcctggggagccgtttgggggcagccccttctgcccaccccatccttcttcctctccagagatgcccaggggggcgtgtatgctctgccccttccctcagacaggggctgggtggggaggctctttaggctcaggagaagcattttaaagaaacccccaccctgcgccc

SEQ ID NO: 31717 - DNA, 419 bp, Homo sapiens
aatatatttccaaactattgttggggctcagaaacggataccctaacatatagtgatttgacaggtggaactaaagaagactcgaggtctctctgacctcctcctcaacctctgtttcttaatcctctgttttcccagagcacaggaggaagttctctgaagttcctttatctgctttaagttcagactcaccaaataagaaaacagttaattctggtgccttccatgggttttcattaactgaagtcatattgtaggaaaaagaatgaagtctcttaacccacctggatagatttttctcacaaaccattgtcttctctgcaagcccagtagactttgtcccaggccatttatgtgatcttcaccccattaagttctccccaaattatttactcttcccccaaaatcacccacactca

SEQ ID NO: 31718 - DNA, 264 bp, Homo sapiens
  misc_feature 128: k=g or t
ccattgtaaagattttagggaaaatattaaaaggtggctactgtgcacagaagagtttagaatacctatttattggatttttataataaaaaaacttttttttaatagacacggggtcttgctatgtkacctaggcttgtcttgaactcctaggttcaagtgatcctcccaccttggcctcccaaaatgccgatattactggcgtgagcccctgcactcagccttatttattgtatctttatcacatagttttgtagagaccca

SEQ ID NO: 31719 - DNA, 359 bp, Homo sapiens
  misc_feature 167: v=a or c or g
  misc_feature 235: n=a, g, c or t
tctcagctatgatgactatctcaccaatgtcttagccaaccaaatgagatttactaacacctctgtgtcagtaaatccacagttgtaataattttcactgtagagacattgcaatgaagacaattaatagataaattcagttaatcatgagtaccaaaaatttgtcvtgaaagttttccataactggtcattaattatgaaatattttctaattcaattaaatataaaaagaatntgtaattttaaattataataatttacatatacgttaaaatcattttccaagttcttttttctattatacctcattttaccctgatgaaactcctgatttagattagttcaatatcactgtcccc

SEQ ID NO: 31720 - DNA, 459 bp, Homo sapiens
caagcaacacccctctggagccagcacagtgctcctccatatcaccagtcatacacagcctcattattaaggtcttatttaatttcagagtgtaaattttttcaagtgctcattaggttttataaacaagaagctacatttttgcccttaagatactacttacagtgttatgacttgtatacacatatattggtatcaaaggggataaaagccaatttgtctgttacatttcctttcacgtatttcttttagcagcacttctgctactaaagttaatgtgtttactctctttccttcccacattctcaattaaaaggtgagctaagcctcctcggtgtttctgattaacagtaaatcctaaattcaaactgttaaatgacatttttatttttatgtctctccttaactatgagacacatcttgttttactgaatttctttcaatattccaggtgataga

SEQ ID NO: 31721 - DNA, 294 bp, Homo sapiens
gcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggagatt

SEQ ID NO: 31722 - DNA, 128 bp, Homo sapiens
  misc_feature 35: s=g or c
  misc_feature 123: k=g or t
gaccagtcagtcgcctttgattatcagttgccagsagcccttctcttggctccttgacacgagctccatataaggcagcgatctccatagaaacgtgtcagtttcaatagtagtgtcaaagtkcacta

SEQ ID NO: 31723 - DNA, 354 bp, Homo sapiens
  misc_feature 137: m=a or c
  misc_feature 145: m=a or c
  misc_feature 150: d=a or g or t
  misc_feature 154: m=a or c
  misc_feature 156: k=g or t
  misc_feature 162: d=a or g or t
  misc_feature 163: w=a or t
  misc_feature 171: r=a or g
  misc_feature 300: r=a or g
  misc_feature 352: k=g or t
  misc_feature 353: r=a or g
ccacatccacaaaaagactcctgcaagtattttcgtaacagctttattcctaataactccaaactggaaacaaccccaaatgcccattaacaggtaaatgaataaacaatgtggggtgctgccacacaatggaatamtcctcagmaattdgaamckgcctgdwacatgcarcaaaatggggtcagcacaaagttacgatgctggtcaaaggaatcgagtcataaaagaaacatactgtgtgactccatgtgtacacctttctagaacaggaaaacctgttttatgatgaaagaaatctarccagtggttgactctgggttaaggtaacgtggggcaggaattgactggctakrg

SEQ ID NO: 31724 - DNA, 326 bp, Homo sapiens
  misc_feature 129: m=a or c
  misc_feature 133: s=g or c
tagatagatttattacagggaattggcttacacccattgggggctgattaagtgtctccatgtctgttgctagatcttgacgtccccaaggcagcagtcaggaagggaagaccacgagcaggctggaamcccsaagagcatgatggactagaaccctacaggatggactgaaacctgggtccattcttgttacctctgaccttggtgacaagggaacctggcagaagctgggggccttcatctaacacacgctcatgtgacccagctgctgcttcacaccagtgaggcaagtcagcagatcagcactctgtgtgctacacagcagt

SEQ ID NO: 31725 - DNA, 412 bp, Homo sapiens
  misc_feature 132: m=a or c
  misc_feature 150: n=a, g, c or t
  misc_feature 151: w=a or t
acaaatcattttgacttagctgtcaaaacgttggccaaaaaaaggtctggtaaatattaattgactgcttataaagtggaaatcaccttctagatcagccccatccaatagaatacactcagaggtaccaamcacaaatcacagatgtanwttaaaatttctagtagccacattaaagaagtaaaaagaaactggtgaaattaattttaacaatataatttattaacctaatattttcaaatgatcatttctgtatgtaatttttactttttttttgatattttacttttttggcattaagtatttgcctaagaaaatctttatttctcctttgctcttgaaggataattttgcagggtacagaaatctaggttggccagttttttctcttaacactgtaaatattttgttt

SEQ ID NO: 31726 - DNA, 292 bp, Homo sapiens
  misc_feature 125: y=c or t
  misc_feature 133: w=a or t
  misc_feature 146: n=a, g, c or t
gcaaatggcatttatggatttaagtcattagattttcaactgacattaattaatccctcttgattgattatatcatcaagtatttatatcttaaataggaggtaggatttctgtgttaagactcytaatttgwaccctataattanagtaaaatgttttttatgagtatcccttgttttcccttcttaaattgttatcaaacaatttttataatgaaatctatcttggaaaattagaaagaaaaatggcaaggtatttattgttctgtttgccataatttagaactcacact

SEQ ID NO: 31727 - DNA, 51 bp, Homo sapiens
  misc_feature 2: v=a or c or g
avtgacgaactgggtggagcccgccgccgctcacaattccacacaacatac

SEQ ID NO: 31728 - DNA, 125 bp, Homo sapiens
cctagaatgttcttaagcagttaatgacaatttggaatacacaaataacttgtagcttaagatactattttcatttaattctcctgtggagaatattgctttattttttactagtttcaggtcag

SEQ ID NO: 31729 - DNA, 347 bp, Homo sapiens
  misc_feature 128: r=a or g
  misc_feature 129: w=a or t
attggacacagttcatacccccagaggaatctggtaaagaagacaaacagggccaggcgcggtggctcacttctttaatcccagcactttgggaggacgagactggtcttgaactcctgagctcatgrwccttcccgccttggcctcccaaagtgctgggattacaggcatgagccaccacgcccagccagctttagggtttttaaggtatagaatcatatcatccatgaagacagatagtttcacttcttctttgcctatttggatgccttttatttctttctcttgcctgattgctctggctagcacttctagtactatggtgaatatgagtggtaagagaaggc

SEQ ID NO: 31730 - DNA, 460 bp, Homo sapiens
  misc_feature 127: m=a or c
  misc_feature 135: w=a or t
  misc_feature 394: s=g or c
  misc_feature 414: m=a or c
  misc_feature 419: s=g or c
aatcataatctgcgccactgaacaaagagggcgacatgaatccaggaacgacagtgcggcagtctgaggtcgccaggaaagagatgacaacagagtgggtaccccaccgaaggaaaggggcaaagamcttttgtwgagatggcctgcgcagatacaaacaaaaccacgaaaagggacctcaaagaatgggagacagcgttcacgaagcaggggtgggggaggggccctattctagttctcttcctcaatttgagtcatcttcccatcgccactaaaccttacggccagtgatcagttcttcgcaagacccaaagctctgaagctgagtctgagtgacgagaggagacgggaagaaaacggggacagagagggcactccctgttgggtggggcascacattcccgccgggctcamccagscccggctcggatcgccttctctttggtctctcacactagca

SEQ ID NO: 31731 - DNA, 309 bp, Homo sapiens
  misc_feature 130: y=c or t
  misc_feature 135: k=g or t
  misc_feature 141: y=c or t
  misc_feature 266: s=g or c
agatgggggtgccgggaggagcggatgcagctggagcggctcccttggggtgccgagtggcaggtggggggcggtgagggtccttgagggcgggccttagagtcttcagaagggcaggactctgagggcyttttkggagcycgctatgcttaacctggagatgattaaggccccgcttcctggcctcccagcctctaatgccaaaagataagggagaggctggcgtgtgaccccgttttgagtcaggtggacagagggctggccascttcggaaccatgggtgcaatacggagtcagacctcaatacaa

SEQ ID NO: 31732 - DNA, 193 bp, Homo sapiens
  misc_feature 129: s=g or c
  misc_feature 132: m=a or c
  misc_feature 136: r=a or g
  misc_feature 147: w=a or t
aaaagtcaagatggacgcgtccatttgaacgtctcgcacgccttcctgccattagcactcgagcccgctgctgttgcccgttcttcctccagaataggggagggagagggaatgagaagctgctgcggsccmagargtcactgtgawggaccccgccgctgccctcgggcctcctcggcccctgcgccctccc

SEQ ID NO: 31733 - DNA, 213 bp, Homo sapiens
  misc_feature 124: r=a or g
  misc_feature 126: w=a or t
  misc_feature 130: r=a or g
  misc_feature 138: k=g or t
  misc_feature 143: w=a or t
  misc_feature 146: w=a or t
tatcatttttggcttttttctttactgaccctcctgccaccatccagttagctctcacatcttgtggattctatctcctaaatccctatttttttttcctaatttctttggtatatatttaagrtwtacrggattaakgtttwaawatacacagtgagatgattactacagtcaaacaaaaaaacatatccattgccttccttagttacccat

SEQ ID NO: 31734 - DNA, 117 bp, Homo sapiens
  misc_feature 3: n=a, g, c or t
  misc_feature 4: h=a or c or t
aanhaaagtagtgaaacttcttgtacgtctcagtgactcagttgggtacttattctgggacagtgcaactacgggttacgccacctgctttgtttttaaaggattgttcattttaac

SEQ ID NO: 31735 - DNA, 56 bp, Homo sapiens
  misc_feature 2: r=a or g
artctggcgtcatctaggtcgctgctcagggaaatgcggagccagtaggcttacgt

SEQ ID NO: 31736 - DNA, 201 bp, Homo sapiens
  misc_feature 131: m=a or c
attcagcaccagattaaaaggattctacaccgtaacctactatgattatccaaggagtacaagggtggctcaacatacaaatatcaatcaatgtaatataccacattaagagaatgaaaggaaaaaaaaamccagtcatcttaattggtgtgcaaaagcatttggtgaaataagcagcctttcttgaaaaagcaaagcgga

SEQ ID NO: 31737 - DNA, 270 bp, Homo sapiens
  misc_feature 147: y=c or t
  misc_feature 160: k=g or t
  misc_feature 166: r=a or g
  misc_feature 175: k=g or t
tgaatgagtctggttgggtccagtgaaaccttctattgctaatgtgcaattaggtatcttcagtgagggagagactgtcctctaagcaaagcagctaaagctccaggggcaaagggcagagcgaataagcaggggcctgggtcatcyaatttggtcccckggcctraaagcattkgactgctcatctcacatcccttctttgccctcagtcgttagatattaggtctactgtggttgaatgagactgtctacaaaagggttccagtgcca

SEQ ID NO: 31738 - DNA, 398 bp, Homo sapiens
  misc_feature 149: w=a or t
  misc_feature 157: s=g or c
  misc_feature 160: m=a or c
  misc_feature 164: y=c or t
  misc_feature 166: k=g or t
  misc_feature 175: m=a or c
  misc_feature 270: v=a or c or g
catcacaccaatcaaacaacaacctgtgtgccacttaagggagctgacagtctgaaatactccaaggttatcattatattgcaaactcaagttttattttgacctttctggatgctcaccaactttgtttaatcttcctaaatttagawtaaggagsccmattyckgatcttggmcttggcatcagtatattttgtaaggcaggatgaacacccttactatgtaacaggggttttcagaagaaactgcagtgtgaatgttattatttaavtttttgctgtgaggtaactcacctgcaggcaggctcagagagcttgtgtgatgctacacatttatggttgatgggagtgagatgtgaaacccaccatccttctatcacacttgggtgcttgttggcca

SEQ ID NO: 31739 - DNA, 254 bp, Homo sapiens
  misc_feature 149: k=g or t
  misc_feature 152: s=g or c
  misc_feature 154: m=a or c
  misc_feature 159: r=a or g
  misc_feature 160: m=a or c
  misc_feature 214: s=g or c
  misc_feature 249: w=a or t
tacgttttgaggtagagcaacctttagaaaaaatattcaaagtcaaaattctgggagggattttttcctccataccaggaggacttttaaaagcaattcaagtcgaccagataattctgatacaaacatttatggagcacctgccgtgktgscmaaggrmctggaccaattactcagcatacttgatgcctgatccgttcctcattcctgcgasggttggtgtgattatctcagttttacaaatcaggwgacag

SEQ ID NO: 31740 - DNA, 417 bp, Homo sapiens
  misc_feature 144: r=a or g
  misc_feature 145: w=a or t
  misc_feature 166: k=g or t
  misc_feature 215: k=g or t
  misc_feature 368: k=g or t
gagtcatttagaaacttgtttctttatttcagaggagttcttccagttttctttgtcataggttcctagcttaattccatggtggttagagaacatatcttgattaatttaaatgttaaaaatatttattacctctgcagatgrwtaatttttgggaattaagtakgcacttgagaagaatgtctcttctcattagatgcagtatcctatatgtkagtttgtttgttcattatattgtttgaatgtgttagatgtacttaatgattactttggttttattcattaccaataaagctatgtcaaaatggtaggtttgtcttcttgtagttatttcagcttttcaattacatatacttagggtgtatttkcatgtgttttatattcatggttattcaaactttctatcttgctgcacat

SEQ ID NO: 31741 - DNA, 409 bp, Homo sapiens
  misc_feature 19: s=g or c
  misc_feature 34: w=a or t
  misc_feature 128: n=a, g, c or t
  misc_feature 343: r=a or g
ttttttttttttgctaccsctgaagcttactgtwagtggtcgagtttttctggaagtgggcttccgcgatcgcggggaccaacgccctgagctcttgtgcccaaaggggatcgccaggttttttgatngcggatcgaaagggactggccccggagcctacaacctgacgcaggtgggacttggggaaatgtcgagaaacctaggtctgggacttgagttggcttccagggcacacattcttgttcagaagaaacacattgcaaaaatcgggaggtgacgggcagatgaagtgtcggcgcttcgcctcgggactccagtgcacctatggggcttttggaaatgrggaagtcgatgactctgcagggactcctctgacccaggagcagatggcgctcgtctgggcactccc

SEQ ID NO: 31742 - DNA, 403 bp, Homo sapiens
  misc_feature 71: s=g or c
  misc_feature 72: v=a or c or g
  misc_feature 317: s=g or c
ttccgcctcctagggctcgagtgtttaagatcctgattgagagaggagggtgtccgagcctctttgggctsvgacaacgttttcccgggcgctctgtgcctcagcctgaggtaccggggcccgagccgcacgggcgctgctgttcactggtggcgctgcctggcgcccggttacgcgcactcagagaccttatgttagctccagtgagtcctgctgtgtcacatccctctttcctgtaggagcacgagtgtggcttttttttggattgtttttaacctctgacattctgattcagattattgcatttctctctccastgtctctgatcttcctggccaaatttctcaagaaggcagacacaagagacagcagacaagcctgcctgggtgagcgctagcctttc

SEQ ID NO: 31743 - DNA, 393 bp, Homo sapiens
aattaataataataatatataggatatcagtggaatgaaggatgaaaactacacaaccatctcagtagaaaccaggaaaattttttcacaaaattcaaaatgttttcaagattaaaaacaaaaagtccaacaagaaacaagtagaaaggaagttccccaatttgataaagtacatctgtgacaaactcacggctaacatcatacttaatggaaagagactaaatgctagcctgggcaacatggcaaaactctgtctctacaaaaaaatacaaaaattagtcagacatggtgatatgcactgtagtcccagttatttgggagaattgcttgagcctgggaggtggaggttgcagtgagccaaaattgtgccactgcaccccagcctggcagaca

SEQ ID NO: 31744 - DNA, 296 bp, Homo sapiens
tattgtaacactctgacataattgtcgacagatttgtagacttaccttactttgataaatgtttacaagttagaacaaacgtttctgattgtcagaacctgcacatataaaccactcagaattcctgtttgatagattttaaatgattaactaaagcaactgatttaagcaacataattcactttttactaggaaggtagtcttaagaaagctgctagtttcttggcatcatttcagatgactaaattgaaattcatttgctgtaggaattttttatttatttctctttttttttt

SEQ ID NO: 31745 - DNA, 268 bp, Homo sapiens
ttcataggataagccccatctctagtactgtttatttccattgtgcctatttttcagggaactctgtgcatttccacatttccatcaccagctctaagaaggtacacctgcagtttgttgtgaccccgtttcagaacggacagaaccaagtgcaggcttactctatttggtagagactgagtcccagcaagtagaagtgtcttgccaaggggatgcaattatgaataggaaatggaactaaaaatagaacctaggtatgaccccatgt

SEQ ID NO: 31746 - DNA, 114 bp, Homo sapiens
ttccgacagttgtgttgtgccaatggtggagaagaaaacttcgggctggaatgcaatggcgcgatctcagctcgctgcaacctccacctcccgggttcaagcgattcttgtgcc

SEQ ID NO: 31747 - DNA, 382 bp, Homo sapiens
cataaagagggcacactctgagcaggaaggctggccgagggccaggaggatattgttcacaaaagacctgcaacagagaatctgaaatttggataatcttaccaaggtgttgaaatcagcttcttagtgttaccgaaaaggaagaaagatttccagacagagactaaataagtctcctaatcaatgtgaaagaatatgtgccttgggaacaaactggagtggatattatgttcatctctttctcaaccctgtctttcaataacacacgtcagttttttttgatatttttaaatttatttttatttttatttgtgtgtgtgtgtgtgtgtgtgtacctctaagttctagggtacatgtgcacaacatgcaggtttgatacaca

SEQ ID NO: 31748 - DNA, 219 bp, Homo sapiens
aaaagaaaacaaattaggaaagtttaaatgtgtttcctataggaggctgtgatagataccaactgagagatgtgttgtttcttctggatgcttatatataatcttaaatttatggtttaaagcaggggtgtccaagggagagaatacagtcatgagttcttagtttctgtttctggttgggcccataaagccccttcctcacccctcttttccgcttat

SEQ ID NO: 31749 - DNA, 174 bp, Homo sapiens
  misc_feature 155: s=g or c
tgtaggcgtgaggagacattctgctcgatggctttttaaaatgtttgctccagatcatctgcctcattaacaacatttttgtgtcttaacaacctctctgattttgtaaactgacatgattccttgttctgttatgaacgcatgctgttctagtscttctataagcccatcaca

SEQ ID NO: 31750 - DNA, 354 bp, Homo sapiens
  misc_feature 298: v=a or c or g
  misc_feature 299: n=a, g, c or t
  misc_feature 300: n=a, g, c or t
tgattatctacaaatgtgtagcttgctacctgacagcattagatattggataattggttgtcattgctattaataaacacggacttagagagttcttgaagttttagttttatgctgagaatccatgtaacactggcaatctgtgtctatacctgtatctatagcaaaagccagaatttaccacaaattttgctgttgtatcaggaaatacatcttgacaactgatacttattcttaatattattattctgttatttcttattctaggccccaaaaacttttattaaaatgcttcaavnnttaggttagcatttttgttgatgtttggacatcttaaattcattatactcatgc

SEQ ID NO: 31751 - DNA, 405 bp, Homo sapiens
  misc_feature 130: m=a or c
  misc_feature 284: v=a or c or g
  misc_feature 313: m=a or c
  misc_feature 347: n=a, g, c or t
actttctcttccgccgaagccgctccccttgcgaagaactggggcctcccgggaggagagagggctttgccttgaaacccgggacgccaggggcgctcccgcaagtgaggggtcctccgggacttggaamgccccggctgggtggtgtccgggcgtcctttccccgcttcttcccacctcggctggtcccgtttcctcctgcgcccagtgcggacctgtctcggctggcacgagaccaggagaccctgcactcccatggggtgcggcagaatggggacagtgcvtacctctatctgctgtcagcccgcaacamctccctcaaccctcaggagctgcagcgggagcgncagctgcggatgctggaaggatctgggcttcaaggacctcacgctgcagccgcggggc

SEQ ID NO: 31752 - DNA, 358 bp, Homo sapiens
cagtgaaaacaccatgtcatggagtgtaggaaagagcagaccaaaatcagccctagagccaaccagtcagtcccaaagctgtgacctctgtgccactgttgtccatagaagagcatcgactgtgtcacttaaaatattagtaaaccatgatgcagcaactgctaagagctaaactaacaaaattgtgtcatcatagctgctggcttggtgtgaactcgcttaaaagcaatggtgaaaggataacctcgatgatgtaaatccacccaaagatactgttctacaaaaagtagggtgtggacgcaaacctgtgacagcagagggggacgacttcacactcactgcctcatgtggcccccca

SEQ ID NO: 31753 - DNA, 373 bp, Homo sapiens
ccacattcccatgctttcttataatcttttaccaaaaacacatttcactttccttacatacctgtaatgtaaaactgtttcttcagtagtcttcaattacatgttacaatgttaactcttagcaacttttacttatggtggaaaaccttggtaagtaaggaattctaattatgtactaggtatggagcctaggacacagaacagaagtgtaggtaaggtctgactctttctagcatagctagggggcatggctaacaccacatgtccccaggccttacctagaatctgctccaaagttaaacagttttcaaaagtcaaagaagcagtttatgaccttaaagcatttagcaaacctaatatctaacctgccttc

SEQ ID NO: 31754 - DNA, 309 bp, Homo sapiens
tcatttcatatgaacatggaatgtttactaaaagtggcaataacttgggccataaagcaagcctcaatgtatttgaaaaaattgacataatacagagtacgttctttgagcagaggggaattaacctaataatattttaaaaactagaaaaatttcaaatatgtgaaaattaagcagtctgcttctaaataatccataggtcaaagaagaaatcacaatgaaaataagaaaatattttaaactaaatcataatgaaagtatgacataaaaaattttaagatgtagctaaaactgtgtattgggggtaag

SEQ ID NO: 31755 - DNA, 95 bp, Homo sapiens
aattagataacctagaaaaaatgggcaaattcatagacatgtacacctgtcaagactgaaccataaagaaagaaaaagcctgaacagaccaatag

SEQ ID NO: 31756 - DNA, 258 bp, Homo sapiens
agcttttaaaatgtagactaggtggctgcaccctgcctctgtttctgagacccggaagcatggtctatctggtgtctggcaaagccttcctgcaggaatccccattattgggtcaaaataaagcagctcctttgcagtttcctgaagcgtgttcgtggtggcatacaccacttaatttttgtcccaaattcttcatcatctctctgatcactgccctataggaaatgcattatttgtaagactcgtgtccacagcaga

SEQ ID NO: 31757 - DNA, 292 bp, Homo sapiens
gaaaaaaccctgctaggtagtgttataattgctagattaaaaatagactagaacaggttcattttaagatttacttggaagagcaaagaaggaaaaattatatttttaaagatagagaatattcaggctttatttctggtatgaagtttatattttttaaaaaaatcctatattatcacaccagagattttagattcttttctggttagaaacattgctggtagttggattatatttttattgtattcatttatcttagggggaacattgtaaagaaacaaaaaggtcccac

SEQ ID NO: 31758 - DNA, 52 bp, Homo sapiens
  misc_feature 21: r=a or g
  misc_feature 46: r=a or g
cctcatgaactccttgcctgrtctaaactcatattatgggttctgrctgttt

SEQ ID NO: 31759 - DNA, 213 bp, Homo sapiens
  misc_feature 129: s=g or c
  misc_feature 140: k=g or t
  misc_feature 194: m=a or c
atctctaaacttcctcccttgggtgccccagctttcctactcctgtctctcccgcagtacctaggcttctctctctgactctccgtctttctccagttatctacatctgcagctcccctgatggccttsagaaacctcakgctccttggccctggaagcctggcttgtgtggggaggactacgttttcttccamctggatatctttgggcaaa

SEQ ID NO: 31760 - DNA, 311 bp, Homo sapiens
  misc_feature 125: k=g or t
  misc_feature 134: y=c or t
  misc_feature 137: y=c or t
  misc_feature 138: d=a or g or t
  misc_feature 305: k=g or t
tttaaaaatggatttgctgatggcttaaaatgtagctttggtcaatagaaaggttaatattaaatgtgaaaaacatgataatgtgtatgaagaacgtgcctttcatccacagaaagtgaaagtgkttatctccyggydaaaattaagaaaggcaaggcaggttccctgctgtttcttttgaaaatgatcccataattatatagccaaattcaggaaaaagaacaaaaagcctttctttttttgaactcttcctttacaaaatagtgtttcatgttgatttggagtatacattaaccatatatcckgaatta

SEQ ID NO: 31761 - DNA, 103 bp, Homo sapiens
tggtcttacataagctgtgatagcattttaaatttgctttgtttctatggggaacaatttataaatcttaattgatatattttcctctcatgcatgtctctga

SEQ ID NO: 31762 - DNA, 74 bp, Homo sapiens
tatcaatagaagaagtgccaaagtatgtatcgtatgttttaaaacttgcatactctctctctcttttttttttt

SEQ ID NO: 31763 - DNA, 185 bp, Homo sapiens
gagatgagggctgagggcgtttggagggaagcgctctgcctactgccgggaggtgacacccgcgaggccgaccgtcccccgaagcccccgcaagtccagactgggggacctcggagatccacgagattgccagagaaggaaattgaggcccaagaagctgcatgacttagccaagttcacaggag

SEQ ID NO: 31764 - DNA, 291 bp, Homo sapiens
tttgtatttttagtagagacggggtttcactgtgttggccaggctggtcttgaactcctgaccttgtaatccgttcgcctcagcttcccaagtagctaggaccacaggtgcacaccaccatacctatctaatttttctctgtgtgtgttgtgtgtgtgtagggactacaaggcatgagccaccaggcccggcctatttctccttctttgtctgccctttccaccttgccctttctccctcttctccactttttcccttctctcatctctctctgcatcaccaccacgtcaa

SEQ ID NO: 31765 - DNA, 197 bp, Homo sapiens
ctgttatgtaacaggatttttggaaaagaagacctaatttgaacatttacttttccacttgcttgttgtgaggtctttgaacctccgacttcttcaggtgtaatgatgaactaatgcctcccttgaaggattgttgaaagtcaaagtcatgaagcaagcaaagcacctgcagagtaaagaaatattagttgcccctc

SEQ ID NO: 31766 - DNA, 152 bp, Homo sapiens
  misc_feature 135: k=g or t
  misc_feature 141: k=g or t
tagtggagacagggtttcgccatgttggccaggctgctctcgaactcctgacctcaggtggtctgcccatcttggcttcccaaagtgctgggattacaggcatgagccactgtgcccagccctacattggttatktttgtkttgaatcctaa

SEQ ID NO: 31767 - DNA, 203 bp, Homo sapiens
caggcgtctcttgaagacatttaccccagtggttaggtacatggattctcaagccaggcttcctgagttcagtcctggttctgttatttcccttctctgttcctcagcattcccaaatgtaaatagggtaattagcagcagcaaactccatggggttgtagtagggattaaatgagtgaataagttaaagatgattagaagcc

SEQ ID NO: 31768 - DNA, 273 bp, Homo sapiens
  misc_feature 129: y=c or t
  misc_feature 133: m=a or c
  misc_feature 134: m=a or c
  misc_feature 141: r=a or g
aacagaaggagcgattcacagcattaataagcagacttggaaagacagattttattggctatggaggaagttgtatctttcttctcaatctaattttcattccaattttggttttgagaatctatctcyaatmmagagggratcttaatttctgactactgagtacttccaatttataaaagagctgacttttaaaaaattctaacatctttcccaaactgtttagaaatatgccatatttgaaagacggaatactgtttgttcccaagccca

SEQ ID NO: 31769 - DNA, 282 bp, Homo sapiens
  misc_feature 71: s=g or c
  misc_feature 72: m=a or c
  misc_feature 129: r=a or g
  misc_feature 130: r=a or g
  misc_feature 140: r=a or g
aaacggaggcctccggcagacgctgtgaagagaggagccgcggcggtcagtaccttcgaggaaatgaaggsmccagatgatcaggatactgatggggagaaatcagttacatcaaagagtgatgggaarraagtcctctraggtcttctaaatcagaatcaagatgtaagtaaagataatatgtatacttttaaaagtattaaacttaggtaaacatttaaataattaatttttatagtagaatggaaagagcaggatgttataaaatagatcttttttttt

SEQ ID NO: 31770 - DNA, 94 bp, Homo sapiens
cttgaaaaaaatttaactgcaactttagtattagaaaaatgtctacaagaggatgtcaagaaagcagagttgcatctgtctacagaaagggccc

SEQ ID NO: 31771 - DNA, 210 bp, Homo sapiens
  misc_feature 138: y=c or t
  misc_feature 166: n=a, g, c or t
  misc_feature 167: n=a, g, c or t
aatgttagcattgtttgcagtctaaagagactgcaaattttctaaaccatcaagtccttgctcttcaagaggtcttgatttaatttatatcttctcattttttgctgtatatagcagaaacagcaaggcagcaacttyctagttgaaactctcctttgctaaatcnntcagttcattacataaaatttccaggtttttgtgggggatcct

SEQ ID NO: 31772 - DNA, 451 bp, Homo sapiens
  misc_feature 126: b=c or g or t
  misc_feature 138: h=a or c or t
  misc_feature 295: m=a or c
  misc_feature 358: v=a or c or g
ttaaggaaaaaaactgtctccataacctaaaagtgcaaggtgaagcagcaagtgctgatggagaagctgcagcaaattacccagaaacttagctaagataattgaaggtcactacactaaacaagbttctaatgccthctattgggagagcttgccatctaggatttagctagagaggagcaatgtctggcttcaaagcttcgaaggacaagttgactgtcttggtagaggcttatgcagctgctgacttttaagttgaagccagtgctcatttacccttctgaaaatcctaggmactttgagaatgataaatctgttctcacttataggtagaggctaaacagtgggtacttatggvcataaaagtggctataatagacactggagactactagagggaagacgggggtggtcaaggttgaaaaactattgggtactgtactcagtacct

SEQ ID NO: 31773 - DNA, 70 bp, Homo sapiens
  misc_feature 21: w=a or t
  misc_feature 39: r=a or g
  misc_feature 56: w=a or t
ctttttttttttggaggcggwagctttttcggcgtcgaractggaggctgagtgcwaaactgtgtggggc

SEQ ID NO: 31774 - DNA, 189 bp, Homo sapiens
  misc_feature 128: s=g or c
  misc_feature 130: y=c or t
agcatgctcgttaagagtcatcaccactccctaatcttaagtacccagggacacaaacactgcggaaggccgcagggtcctctgcctaggaaaaccagagacctttgttcacttgtttatctgctgascyttccctccactattgtcctatgaccctgccaaatccccctctgcgagaaacaccccaac

SEQ ID NO: 31775 - DNA, 438 bp, Homo sapiens
tgctttgtccctgaagtcaggaagtaccttgccagtaagagactaccttttaaagttcttttgatgttggacaatactctggccacccagagccccatgagttcagcaccaaaggcaaattaaaaagtctatttgcggctgggcccagtggctcatgcctgtaatcccagcacttgggaggccgaggtcgggggatcacctgaagttgggagttccaaaccagcctgaccaacacggagaaacccagtctctactaaaaatacaaaattcgccgggcgtggtggcacatgcctgtaatcccagctaatcaggaggctgaggcaggagaattgcttgaacctgggaggtggaggttgcagtgagctgagatcgtgccattgcattccagcctaggcaacaagagtgaaattctgtctcaaaaaaaaaaaaaaaaaaaaa

SEQ ID NO: 31776 - DNA, 59 bp, Homo sapiens
ctcctgcctcagcctcccgagtagttgggattacaaggcgcccgccaccacgcccggca

SEQ ID NO: 31777 - DNA, 265 bp, Homo sapiens
  misc_feature 82: n=a, g, c or t
  misc_feature 127: k=g or t
  misc_feature 133: k=g or t
  misc_feature 135: k=g or t
  misc_feature 138: w=a or t
  misc_feature 160: m=a or c
  misc_feature 174: k=g or t
  misc_feature 179: w=a or t
  misc_feature 235: n=a, g, c or t
  misc_feature 253: m=a or c
  misc_feature 263: k=g or t
cattaggcttctcaacttttggcttcatgtatatgcttagttctgggctgggccaagccacccaccaaatgcagaattaagntgaacctacttagcccggcttccatggccaggtatgtgttgcagktctaakgkttwaaggcaatggcagatgggaaamatgctatcactttkgtgtwacaaactgtgttcctaaatccatgcgtataaccccttctggaatgctgggatgtcnatctagtgacaggatcgmatcagatctkaa

SEQ ID NO: 31778 - DNA, 431 bp, Homo sapiens
  misc_feature 97: s=g or c
  misc_feature 128: m=a or c
  misc_feature 389: s=g or c
tctttatgagaattcctgagggaatgaattacacagtctgatattgtccttggcagatctcgctttcaggacaagaatttgggacccgccgaatggsgaggctaaaagagctgtaacacagaccagamctgagacctgctccttgcttgccacattgcgagtgaagagaaggagagaagagctgcagcctttcagggatcccagacctgggagctccccaagccagggctgtgactccttctttggggtgctgcagttcctggtgtctccgagcttctggatgccactgtgttccctggtgtcagctgtggaagctacttgcggtgtgcctgtcccagctgcagcctggcagagagctggcacctgtgctggcacctggagctgcccasccttctgcagcagccggcatatctgactgtgcattggccaga

SEQ ID NO: 31779 - DNA, 335 bp, Homo sapiens
  misc_feature 125: s=g or c
  misc_feature 133: m=a or c
catctcaagtgcgttttcccaactacgcttctttccaggataaaatactctaagtgacaaatgttgagtacattatcaggtatgttcactattgtgagaactgaagccatctacactcacatagstttgccamctacattaacctgacttcttattccattattttcatcaacatacatttactatttcaagaaacttttgccagggaccggaaagttgcaaatatctttattgcttaatccagtatcttcttcaaagatccaaccactcttcaatggaaaacatcaaagaacagtttacattctaagactttgaacctttacctcaaaatccta

SEQ ID NO: 31780 - DNA, 55 bp, Homo sapiens
  misc_feature 2: d=a or g or t
adtatttcaattgttgattaaacagaatgatatgtttatgtttgtcttgatcagt

SEQ ID NO: 31781 - DNA, 283 bp, Homo sapiens
  misc_feature 141: k=g or t
ccaggttccaggacactgcttggccaagacctttcactggagtctccaaagaagggtgtaatttgggatatatattataattagctctgatgtctagtatagcaagtaaacagccctctagcttgggtggaaatgtgccckggtcaggcgcaacactccagaagggcagcagccaccagaccagacgacagggaagcccagctcccaagcaaaaccaaaaactggtgggagtcttgtggtgaggggaaagtatttgttgttttctgtttagtctagggatacg

SEQ ID NO: 31782 - DNA, 226 bp, Homo sapiens
  misc_feature 132: r=a or g
  misc_feature 142: s=g or c
tatttctacacctatgcccaggaatgctcataagtacacagctgaacacaatttcactcactcattcaacaagcatttatggcacacctattgtgtgccaggccatcctgacacagcaggggacgaaacagrcacaaacccstgctctcctagagctgacattctagtgggagaaactgacaatgggcaaggtacttgggtaacaggtaaagtatgttgggtgaca

SEQ ID NO: 31783 - DNA, 393 bp, Homo sapiens
  misc_feature 328: n=a, g, c or t
aggagtccaggcaagagcttaaactcctaacatttggaaggttgagaaaatatgtgtgcaaagtgcctattggatgcctttataaagttctttcagaacccagactgtgggttcttaaaattcagaagataagactacttgtttccataaaagaataggtgaaaggagtgagggttgaaacaggtggttatacttttttccttttgttcttccaggccacacgtgtctacacttagcctctatccatggctacctgggcatcgtggagcttttggtgtccttgggtgctgatgtcaatgctcaggagccctgtaatggccggactgcncttcacctcgcagtggacctgcaaaatcctgacctggtgtcactcctgttgaagtgtggggcttc

SEQ ID NO: 31784 - DNA, 192 bp, Homo sapiens
ccttgttgataagcacttaagatgttttcaaattttccaaaactaaaaacatcatttgtttgtttttgaagacagggtctcactctgtcacccaggctggggtggcgtgtaatctcggctcactgcagccttcaactttccgtacccaagccatctttccaccccagctggggccccacaggcatgcaccgc

SEQ ID NO: 31785 - DNA, 315 bp, Homo sapiens
  misc_feature 141: w=a or t
gctttagaaagacttggacccagcttctctgaggttcgtttcactcttttccctcatggcaagatgatgcaatggtttgacctgtgagcgaagttgtcttcaaggaaacagtctggtgaagtctgtttgccattagtagawgcttgttttcatttggagggttagaggagttaggcaattggaaaagtctatagaatcaggccctaccattcaacaaaggccagagagactcccccaggactgctcccatggaggccaccacagccctgtgaggggtccctgtggacagcatcattcttcaagtttgtcgaccca

SEQ ID NO: 31786 - DNA, 387 bp, Homo sapiens
  misc_feature 137: w=a or t
  misc_feature 139: n=a, g, c or t
  misc_feature 145: s=g or c
  misc_feature 153: k=g or t
  misc_feature 156: s=g or c
  misc_feature 256: w=a or t
  misc_feature 257: k=g or t
  misc_feature 270: b=c or g or t
  misc_feature 276: d=a or g or t
tatgcagacaaggtgagtgagcctgtgtgcctggtgacccggggttagggttgctgcccctgctctgccctgccagctgctgatatggcgggggcagggggcatcagttgctgtgtccttctttggccatggtgggwanggtggscagggggktgsctgacactgagggagtccctgggtgatgtctttgactgggccaggcatacaaaggttaacttgagccaaacacaagctgcctcagccagggctgagacawkcccagacatgccbattgtdgtggggcagaccttggactggggaggaggtggattctggaaggctgagtcagggcaattggagacaccattgatggaaagctaggccaagaattggcactggaaagggccc

SEQ ID NO: 31787 - DNA, 435 bp, Homo sapiens
  misc_feature 131: s=g or c
  misc_feature 146: r=a or g
  misc_feature 148: k=g or t
  misc_feature 202: d=a or g or t
  misc_feature 341: n=a, g, c or t
  misc_feature 415: k=g or t
ccacaaatcattaaaatataagatgacagagaggtactgagcctcctgtagtcctgatatctttatttttaagcacttcgcctatttctggtcattttactcctaattttcctggggaaagtgtgaaatgscccttctcattcggrakgttccagtctgcataaaggcaggagcatgctgccccagattgcaaagctctggdaatgagtagatggaagtactgagcattagcagcttcttggagattgggagtttgggtgtggtgggtgtgaaaggggaagtagggaagtagaaaagtagatctactggataatctgatcaagatggctttttgtttattntgaggggaggaagggacttgagtacattttcagacagaggagaaggagtcaatagagagggaaaggtgtaggakaagggataatcaatagagca

SEQ ID NO: 31788 - DNA, 271 bp, Homo sapiens
  misc_feature 136: m=a or c
attttttgtagtttaaaggagcaaagggctaccagtcttactcataacttgatttttaaaaagtgttcagtgcctacaatttgctatgctttttttctaatctctcagaaacttgaaaaaaagctatcgagattamcctttacagtgtgtgcatataactttaaaacgactattttaacgtcttttatttaaattttattttaacttagtgcataaacattacagccagtttaacttgtccgtggaaaggcagtagaattttaccccggac

SEQ ID NO: 31789 - DNA, 238 bp, Homo sapiens
tgaaaaaattagaatatattttaaaaaatcaggaaaacaattatttctaatttactgccctaagattactggtcttaacatttttatacagattgcacccatacgtaattcaacaaaagtcagaattactttttacgcagttttgcatcatgctctttttatatcctatttcccacgtcacttaatattctttataaacttatcttacaatatctgtgtgatatcagcattatcccta

SEQ ID NO: 31790 - DNA, 149 bp, Homo sapiens
  misc_feature 21: s=g or c
  misc_feature 24: n=a, g, c or t
agaagcgaggcagccgtgagsggnaggacaggctggggaatcccaaagggtgcgctccagcccccaacccaggcactgggactctggtggcaccctgggtggcaggcaagccttgaaatcaagtgcacgagccttggaaaggagggccc

SEQ ID NO: 31791 - DNA, 231 bp, Homo sapiens
tgactttaagaaggaaacaatttctgttcaacagaaagaagcaggaagattctagtgatatgatggaaaaggcatgtttcttcttgaaacaagagaaagaatagtccattaagactccaggaaaaacaaaaccactcaagaaaagcatgctccaactacgagcaaactaaagcatgacatgagaatgtatttgaccttcacactgggaagcttccccttctaggagaacat

SEQ ID NO: 31792 - DNA, 386 bp, Homo sapiens
  misc_feature 322: r=a or g
  misc_feature 323: w=a or t
  misc_feature 325: r=a or g
  misc_feature 333: m=a or c
  misc_feature 335: w=a or t
  misc_feature 371: w=a or t
tcaaccacactgaaaatgtggagggatttatgggggagggggttgaaatgtgggtgtttgaaacaaaagtgtataaacaaatgaattgttgataacttagttattgacctggagactggtagcttattaaagaaactccgtgttactcattcctggagttgggggtttctgtaggcactttatttctccactttcaagagcttgggcttggcccaaatcttagactgtccaattctgcctctattaccaatttaaatctatggcttgaacctgtgcactgaaaatcaaatcctttaaaaagaaagaggagaagaagaagcarwaragatagamawaacacttattagaagccctagtcattttttggcttwctgttttgttgctgt

SEQ ID NO: 31793 - DNA, 422 bp, Homo sapiens
  misc_feature 18: s=g or c
  misc_feature 19: m=a or c
  misc_feature 96: y=c or t
  misc_feature 97: h=a or c or t
  misc_feature 98: n=a, g, c or t
  misc_feature 152: m=a or c
  misc_feature 160: r=a or g
  misc_feature 223: v=a or c or g
  misc_feature 232: w=a or t
  misc_feature 234: d=a or g or t
  misc_feature 237: m=a or c
  misc_feature 238: m=a or c
  misc_feature 259: m=a or c
  misc_feature 268: m=a or c
  misc_feature 292: k=g or t
  misc_feature 306: m=a or c
  misc_feature 340: k=g or t
  misc_feature 353: h=a or c or t
  misc_feature 354: w=a or t
  misc_feature 368: m=a or c
  misc_feature 401: w=a or t
atttatagataaattgtsmagacagtagaaagaatttctatgaactccatactccatgcttgtatttttaataaacagctgtgtatggttgtcagyhnagctaattaagcttttaggtgcatctgttgaaattgtttccaaaataaaggggmtaatagarccattctatattgttccagacagatggagcacagggaaatgtgtcttggcattctaaaaaagvatgaatggwgdacmmtggacactgttcccataaggmgtacatgamgggacttgggatatttaattggakaatagaagattgamgggtatgtggcaactgtcttcatatattgcagakggtgtaatgtgghwgcgacagactcggmggggtcaatggatggcaagataattactcagawtatggaagtctatgtattgat

SEQ ID NO: 31794 - DNA, 234 bp, Homo sapiens
tgcattaaatgctgcagataagaatcttgctatttttcaagtagacaacattagaaagttgaatcatgaactcattcaattcatcaagtcaaaagcactgagtgttttgctagtctagtgacatgggttattgtatttccgagaagtgcctctcatttctggggagttgtttacatataccctgcatttaaaccaattaaaacaatccaagtttctttaaaaaaaaaaaaaaaa

SEQ ID NO: 31795 - DNA, 313 bp, Homo sapiens
aaaattaaattaattttggcttgtggtttgctcaagaaaaatacttctgaaacattgctgtgctgtctcagcttcagccaccaatcagctgatgtttgccaagctgtcactccttaaatgtgttttttaaaggcctgatgatttagctgccctgtccctaagcaaaatttgtatttgttttttacatgtatttgtgctgtagaacggacatatatttgtgccttgttaaatgcaacagttaggccgggtgcggtggctcatgcctataatcctagcactttgggaggccaaggcgggcagatcacaaggtcaa

SEQ ID NO: 31796 - DNA, 174 bp, Homo sapiens
tactgagccttgtgctgcaaagaaagtaatagaaattcattttctaaatctggtgttggctaccactgccgattcccattagaaagttctgcttggttaatccaatcataatttattttattgccaacgattataatctagagctaatctgattagtgctaatatcccgagcca

SEQ ID NO: 31797 - DNA, 462 bp, Homo sapiens
caatggcttaggggaatttttggttgcaagtgacagaatacctcctaagagatatattggctcatgtaactgaaaaattacaggactaagtctagcttttaggtttggctagaaataggggcttaaatgatgtcaatcagaactcagtctcacgctccttgtctctcaatcctgatttctttgggttaactctgctcaggcaaaacactgaccctggattctctgaaaagtacaacattggtagaattggatggtgatatggtttggctgtatccccacctaaatctcatcttgaattatagctcccataattcccacgtgttgtgggacagaccccgtgggagataactgaatcatgggggcggtttcccccatactgttctcctggtagtgattaagtctcacaagatctgatgtttttataaagggtttccctttcacttggttctcattttctctctt

SEQ ID NO: 31798 - DNA, 245 bp, Homo sapiens
agttgtgaaaattgtcgtagggtaatagatgtgcttctttatcaatacattaaataatatttagtggcgggtcaccataattttgaggtggagatgaataaacaatattttgagtttttgacagcaactgtaatgtgaaggcatccgatttctattggtgtcaaagtcacaggtactgccaatactgtgatgtgttgcctacattcgtaattggaaaaaatgctgaattttaatgagcggctcaa

SEQ ID NO: 31799 - DNA, 265 bp, Homo sapiens
tttagtagagacagcatttcaccatgttggccaggctggtctcaaactcctgacctcaggtgatccacctgcctcagcctcccaaagtgctgggattacaggcattgagcctaacggttcctagctattccttttaaactgatagtttcccaacttgcataccacagtctatcagattgtgttagatgtctttaaaatgtttgaatctgtgtaaaacctgagtggtatacttctattatttcattctttcttcctacctcccgaa

SEQ ID NO: 31800 - DNA, 276 bp, Homo sapiens
cggggtttcaccatgttggccaagctggtctcgaacttctgatctcaagtaatccaccctcctcatcctcctaaagtgctgggattacaggcatgagccaccgcgcctggccccatttgatttttttaagagacagggtatcacttcatcgcccagactggagtacagtggtgtgaccatagctcactgcagcaaaaactcctgggctcaagtgatcctcccacctcagcctcctgagtagctgagactccaggtacacaccaccacacccgtgtg

SEQ ID NO: 31801 - DNA, 258 bp, Homo sapiens
ctactataatttttacaattactgtacttggagtaattcctttcggaattgctacagttctaagacaaacaaatgaaaattaatttaaaagaaaaactggctagcttaataccataaataaaaagatgttcagcttttcctgtttccttagtgtattatgcctatactgtgttgttaaacttttatcttgaatagctctggaatttaaaatgttaattgagtaagtaagttaatgacattcaacctaaaaaaaaaaaa

SEQ ID NO: 31802 - DNA, 235 bp, Homo sapiens
taaagatagctagttcaatgttttgagtataccctatatttagaagggtggactgacttgggaaagcatataatttgtaagtaaattagcagtgatagaaaaattctttcccatttctcaaaaaaggtgtttaaaagcatcaatttattatgtttaccctaacttttgcattacaaatggactccctgaaccccaaccatgctaaatttaactttcatagtagttgccagagata

SEQ ID NO: 31803 - DNA, 430 bp, Homo sapiens
  misc_feature 74: s=g or c
caaaaaatggaatctaagaatctttttgtatggaatattacttctatcagaagatgatcaagcatgtttcagtscagtgcacatcagcattgctgacattttatggattctaaacttgtgttgtttcttttttaaatcaactttttaaaaaaataagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaa

SEQ ID NO: 31804 - DNA, 193 bp, Homo sapiens
accgagaagaactggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcagcagca

SEQ ID NO: 31805 - DNA, 425 bp, Homo sapiens
  misc_feature 97: r=a or g
  misc_feature 98: b=c or g or t
  misc_feature 108: b=c or g or t
  misc_feature 127: h=a or c or t
  misc_feature 128: m=a or c
  misc_feature 129: w=a or t
  misc_feature 130: v=a or c or g
  misc_feature 202: b=c or g or t
  misc_feature 216: v=a or c or g
taatcaaattagaaaatccaagtcattttaagaagataaaaatagaaattcaggcaagtttgggtgatgggcggtattcatcacaaccttcattttrbtcttacaatbgagctttgactcaggggghmwvgaagtaaatgattgtcaaggttccctctgccttgattgatagtttctgatgggagtgggaaggaaggaattbgagtaatgggtagvtgggaatgagagattacgggagagagagatgagatgggttgaacagaagaggatgggaactgatggtagctaggaaggaaagcgtcaagaaggacctgaatgtaccccgcttttctcgccaaacttcagtaccacctcaggaaaaggccactgtgtccaggggcgtcagtccagctcaatagtgtctagcttttcagaatcttctgatt

SEQ ID NO: 31806 - DNA, 270 bp, Homo sapiens
attccagaaagctatgactaattaattggtattatctcagataaaaactgttactaattatctttcaaatctccttccagaacttaattccaagtaataaatttttcttattcattactttaagtagccattttggcttttagtacctcacttttgtaataaaatgtatcagtatgtatattttaatatacaagtaaaaaagagactttcacttcctttaatatgtttttaatttgtttcttttttttctttttcttttttttttttttt

SEQ ID NO: 31807 - DNA, 223 bp, Homo sapiens
agttttggattcggcggattaggaagaggagggaggggggagagagcgcgaagagggaggggaccgaagctggagggtcccgagtccagcgccgtgttggcgtagagaaactttccctctcggcctcggagacggcgccccggccgtgccggagtggagatcgccaggctcggaggaaccggcagctctccacgcccctgcccgaagcctgacccgactgcca

SEQ ID NO: 31808 - DNA, 193 bp, Homo sapiens
gtgaaaagaatcatgaatgcaacaagggaggctggtcctgttgctgtcgccgattaagttttaaacttttatttattatttatgtctgccgtattttaaataaacattctcgttccttccagttccagtcatagtgtgtctgtggcattccagtccaaccatgtgacttatttattctaatttgagggccgct

SEQ ID NO: 31809 - DNA, 212 bp, Homo sapiens
ctacagatacacagtgtgggccagatttgacccatgggccatagtttaccaatttgtggtctagaacaacagtttttaatgtttgttccatatctctcatcctgtactgattatcagtagatggtggccatgttttatttgcatatattttaccatattcaggtgttgtcccatgttgggataaaggttttcatatattaatcagaatgggt

SEQ ID NO: 31810 - DNA, 244 bp, Homo sapiens
ttaaagttgacccctggattctataaccctctctgtcacaaatctgctttgtaactttgagcgaattatttatcttaaacacttaactttccatacaactattcattgagcataaaacctaaataatgatactacctctggaaaaaaggattcatgactcagtgggtctgtttccctacttaaatctggaagggaaaatgccttcttactcttccttctgaattttcccatttagtcccggcac

SEQ ID NO: 31811 - DNA, 371 bp, Homo sapiens
  misc_feature 94: m=a or c
  misc_feature 95: m=a or c
  misc_feature 97: s=g or c
  misc_feature 98: y=c or t
  misc_feature 117: m=a or c
  misc_feature 130: s=g or c
  misc_feature 137: w=a or t
  misc_feature 138: k=g or t
  misc_feature 139: n=a, g, c or t
  misc_feature 201: w=a or t
  misc_feature 202: s=g or c
  misc_feature 350: n=a, g, c or t
cagttaaattgtgtcttagtaaaaggggattcaaccaacaggcataactgatgaattcatccagatattaagaaaggtctgtaagtaacagtgmmasyttagcaagttataaaaatmatggcaatggagsgtgggawknaagaatttcatcctggtgtggaaatcacccagatgaatctagcatggcaatgacttgaaaawsggagtaggaggcaatgacatggacttgaactggttagttgcaaatcaggtgggtatcttatcttgaagtaagtaagctgtggaatcaaagacaagatcagcccgctcttcactttaattccctaagatttgaggcatagaaatcttgnagagtgtgagattttgtaaga

SEQ ID NO: 31812 - DNA, 309 bp, Homo sapiens
agttggaacatgtacagaactaaattttttaaactttatttgctgttaaattctgtgaagtttcagttatctaaaataaatatacacaaatatgaaatataatgtttcagattgcaaggtaatatgtaatagtagtgtttgtaagatactcttgtctaatattaactagtagtattttgatttgtacagtcataatttgttaaaatgacttcatttaacattcactgatgtagattaataatgtaagttctgatttaaagaatggtggcaaaatggtgcatgtaatacttttgcaagtgttggggagcc

SEQ ID NO: 31813 - DNA, 344 bp, Homo sapiens
  misc_feature 139: m=a or c
  misc_feature 201: n=a, g, c or t
  misc_feature 202: h=a or c or t
tgatgaacttcaaaaaaaagcttgcaaaaaaaactcataatgttttaagaaagcttacgaatttgtgttgggcctcattaaaagctgtcctgggccacatgcagccagtgggttgcgggttggacaagcttggtttaamtgcttatccttggactggtacaggcctgaatgcatccagattgctgagggagcttccaaaanhtaaccatgccagggctcatccccagagattctgagaactctactgcatatacagccttcagaagtctgaccaggtggttctgttaggtagtcaatttcaggaaccgctgatctaacctaatctctttttcacgtcaggacag

SEQ ID NO: 31814 - DNA, 394 bp, Homo sapiens
caaaagtggttacaaaagtctgaagtaacatagaagtaatgatcaatgactacatgaacttagagaatcaagtagatcacacacaccaacaataaaattacacagaatgataaaagaatttgaatggagagtgaaaccatgaggcaggtgttcaaatcttcagttaaagcaagggaatggccacaagcttagaaatagcatcagataggagaggtatagattagttagttaagtatcataggaatagaataggggtctttttttaattatacttcaagttttagggtacatgtgcacaatgtgcaggtttgttacatatgtatacatgtgccatgttggtatcctgcacccattaacttgtcatttacattaggtatatcttctaatgctgtcc

SEQ ID NO: 31815 - DNA, 158 bp, Homo sapiens
  misc_feature 40: s=g or c
tttgttttttttgagaggaatctcactctgttgcccaggstggagtgcagtggcgcaatctccactcactcccagctccgcctcccggattcacaccattctcctgtctcagcctcccgagtggctgggaccataggcgtccgccaccgtgcccgcac

SEQ ID NO: 31816 - DNA, 172 bp, Homo sapiens
gtataacgacttcttttcctctgggtggatacccggtagtggcactgttggatcacatggtagttctttcagttctttaaaaaactccccacaccgtttctctagtggctgtgtgagtttgcattcccaccggcagtgtagaagtgttcctgttccccgtatccacaccatt

SEQ ID NO: 31817 - DNA, 218 bp, Homo sapiens
tgtgacactccatctcaaaaaataataataataacaatataagaactagctgggcatggtggcgcatgcatgtagtcccagctactcctgaggctcagtcaggagaatcgcttgaacttgggaggcggaggttgcagtgagctgagctcataccactgcactccagcctgaacagagtgagatcctgtcaaaaaagaaaagaaaaagaaagcagcaca

SEQ ID NO: 31818 - DNA, 347 bp, Homo sapiens
  misc_feature 77: m=a or c
  misc_feature 188: m=a or c
  misc_feature 245: m=a or c
  misc_feature 292: r=a or g
cgacattgtttcaaattgcttgtgcatggtgataatataaagcagataaaatcttagtgattctattagtgtttaamaatgtcctactgacaatgtactctatgcctgcactaggagcagactctacaatcatcttgatctcgatacactactgctaccatttattgagtgtccactaggtgtaagamactttgttagaatctggtcatacacggattgctgcacaacagcacagtggttaagamgtgggtagtagcaccagactgcctgggtctattactgccaagtgtaractaagctacttaacctgtctgggtctcagttttctcacttgtgaaatagggaca

SEQ ID NO: 31819 - DNA, 191 bp, Homo sapiens
  misc_feature 108: r=a or g
  misc_feature 113: m=a or c
  misc_feature 119: s=g or c
  misc_feature 128: m=a or c
agttccctgaaagaaaaggatccgagtttgttcactgatggagaggggcacttagagcaagatacccgaccttgactggggaccaagcacgaaatccctaagaggtgrcaggmagagasaagtctgamacgttaagtgagttaaccagatggtgtcagaagtggaatccaaagaagagctaacaaccccac

SEQ ID NO: 31820 - DNA, 300 bp, Homo sapiens
aagagcaaaacctatctatggactgcctgcaagaggtgcattttaaatacagatatgtatattggctgaaggaaaaagaatggaaaagatatcatgtgagtaaacattagaaaagctgaagtgaaaaatgtatgaatatcagagaagatagatgttaagacaaagaatattactagaaatgactatgttttataatgcaaaatagttcagtacaggagaaagatacaataatttgagtgcatatgaacttaaaagagaatttcaaaatatatgaagcaaaaattgacagaacccaaaagt

SEQ ID NO: 31821 - DNA, 385 bp, Homo sapiens
  misc_feature 346: n=a, g, c or t
  misc_feature 347: n=a, g, c or t
ttcgggcaacccctttggtaatatcagaagtagtatctaaaatagataaattggatttgtgtcttaaactcttggttgttcaggtgggagtggttcaataaatgatgcagacttcctgtagtaactctatttgaggagtcttattaacttatcctattagaaatatttctttttattaatatatgtaatctcgaagttttcttaacctttatagccagcatttggagactgaggagaaatcactatttgaagttctaagaaccgatggaactcctgtattttgagagtttatttagaacatgttaacctaagtaatgctgtacttgttttagttattcctttatanntttaaaatgattttcttagtatcaaattaatatgtttc

SEQ ID NO: 31822 - DNA, 454 bp, Homo sapiens
  misc_feature 101: r=a or g
  misc_feature 274: s=g or c
  misc_feature 276: s=g or c
  misc_feature 439: s=g or c
tcaagaatttctagtgggttctctaatcttttcatttttcaaggaagcctgttttgtagttggtttgtttttaaggaatataccccttaaaacctttaacrtagtaattggggtgtttgtgtggatgtctggtttgatctgttgttcctgtttgttttccctaaagtcatataatctgtatttttctctttcctggtacttgctttttctcaaataacgcagtgacccttggttgtccagagatttgaatggtggtttgtattggttagtattsgsagctatcttgcatttttttgcagttaagttcgcttacctacaagggtcctctcctggatggaagatctcactgtggattcgtgtgtctgtgtgtgtgcttgtacatgtgtacacacgtgcatgtttgtgtgtgtttaatgaagtgagtggagaagcacaggcsactgcacatttatca

SEQ ID NO: 31823 - DNA, 95 bp, Homo sapiens
cctgattattctacagagtttggcatatagtaaatacttaatgaatgtgtttttattattaaaagctatatggtacttttttttttttttttttt

SEQ ID NO: 31824 - DNA, 288 bp, Homo sapiens
cagaatctaccaccccctttgccaccaaagaaatatgctataaccagtgtgccacagtcagagaaaagcgaatctacacctgatgtcaaacttacagaggtgtttaaagctacctctcatcttccgaagcacaggttaagtacagcttcagaaccaagtttagaagtgagtacacatatgaatgatgaaagacataaagaaacatttcaagtgagagaatgttttggcaacacaccaaactgtccatccagctcctcaactaacgattttcaggcaaactcaggtgcc

SEQ ID NO: 31825 - DNA, 363 bp, Homo sapiens
  misc_feature 79: k=g or t
caatacttcccatctcccaaaattctctgattgctcgtttgtttattcatttattcatctatttgttcaccaaatattkatttagcacataccaagtgccagggattgtgtggtcgtttcattgtatggtgatgagccaggcagatatggtttctggttttaacaaagagatgtttaacaagagtataacaggtagacctggtatctgtggagtcagggaaagtttccatgaggaagggacatttaaactgagataagaagtagctggatgaagtggggaggagggcatgtaggtgtgaggaccatgggtgctggaattttgaaaatggtaatcaaccacagcatgtgcaaaagtcctgcagt

SEQ ID NO: 31826 - DNA, 357 bp, Homo sapiens
ttccattttcatttgtttcaagaaattttaaaatttccttcttaatttctttattgacgctttcattgttcaggataatgtttaatttctttctagtgtaattgcattgtggtcagaaaagatactttataccatttcaacttttttgaatttagtgagacttgttttgtggcccaatatgtggtctcttttggagaatgttcctcgtgctgatgagaacagtgtgtattctatggcagttggatgaagtattctgtaagtgtcaattatgtatatttggtttggattgtagtttaactttgatgtttctttgttgattttctctctagttgatgatctgttcattactgaaagtta

SEQ ID NO: 31827 - DNA, 326 bp, Homo sapiens
  misc_feature 103: k=g or t
  misc_feature 279: k=g or t
  misc_feature 285: k=g or t
caaaattgtaattggggtcttttattctaggaagtagaatctaatcttggaatttatcctcttttgtcagtctttcagtgtcttgtgtgaatatatttattgktaatacttcaatataaatgtgtttatatttaatgtattagttttccatgttgaagagtttactaggattgcacatatagtatcctgagatcttgattctataaagaattattaagtttattaaaagatacagaactctttcctcattcctttctttttcacagttgtttgtgtgtktatttkttatttccaaatttatagtgatgttatataaatctgccaac

SEQ ID NO: 31828 - DNA, 217 bp, Homo sapiens
taatgtggagtgcactaaggaagagtcgttaacttgtttacagagaaagggacagggaaggctttgtcgaggaagctagagatctgaatgttgagtagaagtagctggaggggtaagagggtaaccaggacatggtgaaggtcgattggaggaagggaagacggttcaggctggtgggctgctagccacaggagcaagtggtaggataatggcaatg

SEQ ID NO: 31829 - DNA, 392 bp, Homo sapiens
  misc_feature 201: w=a or t
ctggtttaaagaatgagaagtgtgagccaccgtacccggccatagagcagcctcttccttttcctgttgggtctctgctcaaatgtcatgtcagagaggcagacctctggggcggtctatctgagggaatgcacccatctcccttcctctgaccagttagttaccttgcttattctttcaaagctcttaccaccacctgawgtcatctatctggtttggttattttattgtttagtagcagtctttattttattatcattattattttttgatggagtctcactctgttgcccaggctggagtgcagtagcatgatctcggctcaccagaacctctgcctcccaggttcaagcgattctcctgccttagcttcctgagtagctgggactaca

SEQ ID NO: 31830 - DNA, 264 bp, Homo sapiens
tattttgaggttctagaccatttgtgcaaaatcaaaacaaaggtcaaagaatggatgagtgtaattttttcatgcccctctttttaatatctttaaatgattacttttcattttctcattaataaaattactttggtaaaaaaaatgagtattttaatatgacatttcaataatgctatttattcaacatctagctgttaagtctaaggtgctgaatgaggttttgttagataatacaataatataagataggatggcggcccc

SEQ ID NO: 31831 - DNA, 302 bp, Homo sapiens
  misc_feature 202: b=c or g or t
catcataagaatagggctcctggccaggcacggtggctcacgcctgtaatcccagcactttgggaggccgaggcaggcagatcacctgaagtcaggagttccagacaagcctgaccaacataaagaaaccccatctctactaaaaatacaaaaaataagccaggcgtcttggggcatacctgtaatcccagctactcaggabgctgaggcaggagaatcacttgaacccaggaggcggaggttgcagtgagccaagatggcaccattgcactccagccagcctgggcaacaacaccgatagt

SEQ ID NO: 31832 - DNA, 412 bp, Homo sapiens
  misc_feature 97: n=a, g, c or t
  misc_feature 98: k=g or t
  misc_feature 138: y=c or t
  misc_feature 199: b=c or g or t
  misc_feature 200: n=a, g, c or t
  misc_feature 201: y=c or t
  misc_feature 215: w=a or t
  misc_feature 319: r=a or g
  misc_feature 320: k=g or t
  misc_feature 412: n=a, g, c or t
aatgtctctaacttttcaaacatacagaaaacagtaataagaagtgtcagcgtccttttctggtcattctaatatctttgttgattctgggtttgtnktgatttattattctcattatggattgtactctcctgcctytttgtatacttcatgatcttattggatgccagacattgtgactgttaccttgttgggtatbnytgtattcatatcawtcctcttgtgctttatgatgggatgcaactaagttccttggagatagtttgatccttggggtattgctttgtgatttgttaggcaggttcacagcagtgctaarkctagggataattatcccccactactgaggcaagatttttctgagtattctccttaatcctctatgaattacgagtttttctagtctagctgn

SEQ ID NO: 31833 - DNA, 444 bp, Homo sapiens
  misc_feature 139: k=g or t
  misc_feature 164: b=c or g or t
  misc_feature 166: w=a or t
  misc_feature 201: n=a, g, c or t
  misc_feature 202: n=a, g, c or t
  misc_feature 343: n=a, g, c or t
  misc_feature 344: n=a, g, c or t
  misc_feature 345: b=c or g or t
  misc_feature 347: b=c or g or t
tacagaggctcagcttttggaaaccacacaggggctgagtgccccagtagagggtcagatagttctgcaaggaagccagggtagcccaaagcagaggtaatgaacctggagaccaagtagcagaggagctgaaagagaktttgacttgtacctagatttgaaabcwgagtaagctaacaagaagacagaatgattcctagnntcagggctggcaaaatgcaaagtgaaattgatcgagtcatgtaagattttgtgtccaaactccactgggctgtggataattttaccctcaaggtcctccacactgtagtatggacacccaggtgtgtcccatagaggacannbcbaaaaatgtatcttaactgggaaaaaaagattaacaaaaagaatgaagatgtgcctcagctgcatgaatatagaaggagaaagatcctctatgtcatt

SEQ ID NO: 31834 - DNA, 373 bp, Homo sapiens
  misc_feature 98: k=g or t
  misc_feature 199: s=g or c
  misc_feature 316: k=g or t
  misc_feature 326: k=g or t
caaatcttgaatgtcacaagccttatatgagtagagaaagggaaaattagtgaatagtgaaaaacgttgacattgactctcctgtttttgctgattckcactgcttggggttgaaacatagaaacagtggaaaagactcattctggctgggcacagtggcaagcacaggtaatcctatcactttggaggccgaggtggstggcttgtctgagcccacgagttagaggctgcagtgagtcgtgatcatgccactgcactccagcctgggtgatagagtgaaaccctgtccctctcttctctctgtctctctctgtckctctctgtckttctctgtctctgacacacacacacacacacacacacacacacacac

SEQ ID NO: 31835 - DNA, 414 bp, Homo sapiens
  misc_feature 97: d=a or g or t
  misc_feature 98: b=c or g or t
  misc_feature 138: k=g or t
  misc_feature 201: n=a, g, c or t
caaagtgctggggttacaggtgtgagccactgcacccagcctaaaatgatggttttctgattctagcatttcttttataagattgctatgtaaagcdbagcttttctttttttagggaaaaatgtcttttaacagctkcaaaataaatattctttcaatggaatgacaattattatttttgccatatatttattttaaaantttatgtataatggtaacctgagcctgcatgttattcatgtgtggtgccatactgatctttaattttaatgtgaagcaagtactaatatagtaaagcataaattatataaaatttgctttatattttggattgcaaattaattgctgtactttatagaaagtttcccaaatccgttttacttttttgtatttgaaatttaatcacaggtgagg

SEQ ID NO: 31836 - DNA, 342 bp, Homo sapiens
  misc_feature 96: y=c or t
tggcaggcacttaggttggttccatatcttacagttgtgcattgtgctgtgattaacatatacgtgcaggtccttttcatacagtgacttaatttycctttaggtagatacccagtggtgggcttgctggattgaattggcagacctacatttagttctttgagaaatcttcatactattttccacagaggttgtgctaatttacttcaccaccagcagtgtataagcattccctattcaaatgaacaaataactaaatgaagcattccctttcactatgtacacatcagcatctattgttcttttgattttttaaataatggccactctggctgaggtagg

SEQ ID NO: 31837 - DNA, 186 bp, Homo sapiens
  misc_feature 96: s=g or c
  misc_feature 97: b=c or g or t
ttacttcataaggagttgtatcttcccacctgcatttcaatactgccggttaggacctaagtagaagagcagtaaaggctgattgacacacagggsbatggagttggtccttgtccattctctcacccttgctgtgcatgtatcaatccttatcccagaaggtactatttagactgtatagactga

SEQ ID NO: 31838 - DNA, 260 bp, Homo sapiens
  misc_feature 91: k=g or t
ttgcttgttgagtttcttataggcttatcgctgattttttcatgctcttccacagagccgataaagcttctggaaacgtggtcacagatgkttaaggtcactggggtgttccctccctccagatccctctggcctgcgcatctgtctgagtcgctgccttccaggcctgctgcacagcctggctttcctgcctctttcccgtgttagagtttgctaagtctatgcaagttttccgttgccacctaacaaatcgccacaca

SEQ ID NO: 31839 - DNA, 300 bp, Homo sapiens
catggatggcagcacgcaaacaagagaggttgttcagggaaactcccatttttaaaaccatcagatctcttgagacgcattcactattacaagaacagcacaggaaagaactgctcccataagtcaatcacctcccactgggttcctctcatgacatggaattgtgggagttacaattcaagatgagatttgggtggagacacagccaaactatatcattccacccctggtctcttctaaatctcatgtcctcacatttcaaaaccaattatgccttcccaacaatccccacaagtcgtt

SEQ ID NO: 31840 - DNA, 145 bp, Homo sapiens
  misc_feature 138: w=a or t
cacttctggccaggcacggtggctcatgcctgtaatcctagctctttgggaggtcaaggcaggtggatcatgagatcaggagatcgagactatcctggctaacacagtaaaaccccatctctactaaaaaaaaaaaawtaaaaaa

SEQ ID NO: 31841 - DNA, 348 bp, Homo sapiens
  misc_feature 134: r=a or g
  misc_feature 170: w=a or t
ttgaattcttatgtctatagacttccaatcagaagtctcactggtggggctgggggtgggggcaggcaggaggcatggatgggaacctgagtaggtagtgtggccaagagatcagcacaacctttgcaggctgrctttgcttaagtctgacagtgacaaacttgtgagcwtactgcagtcagtcacagaggctgttctttttcacacaccccttcatgcccggctttccccatatccacatgcagagggcgagctcataaaactacagggaagcgtgaaatgatggctttggtagctgtttactgggtaaccccactgtgacactgtccttttcatgtgatgtggaaa

SEQ ID NO: 31842 - DNA, 399 bp, Homo sapiens
  misc_feature 135: s=g or c
  misc_feature 139: m=a or c
  misc_feature 140: r=a or g
attcgggccggacctcaagccatgggcctctgcgaaggcgccggcgtgcccacggctaagaaacttcctctttctgctcccgggaacgaaggctgtagcagagaaggccttcaagtttcgagacccagttccagscggmrgctgagcactggtgaccttgaattaagtctaatgttgggattggaagacgcttcagacatccgctgccgccctgggcaagcgaccagctcaaggttaccccacagggacgtgctctggtcccacggtccagtgctcttttgtcggttagttttgtcatttgtaaaataggaacagtagatagtggtaggaaagtggttgtgaaaacttaatagaaagctaagcgccttggtcgggcgcagtggcatgtcacccctgcaa

SEQ ID NO: 31843 - DNA, 256 bp, Homo sapiens
  misc_feature 133: r=a or g
  misc_feature 136: r=a or g
  misc_feature 142: r=a or g
ggatcttttagaccccaaagggagtagacagtctcttaaagttcgagaacataaagttttgggaccatatgtagatggtttatctcaactagctgtcactagttttgaggatattgagtcattgatgtctgarggraaatargtctcgaacggtagctgctaccaacatgaacgaagaaagcagccgctcccatgctgtgttcaacatcataatcacacagacactttatgacctgcagtctgggaattccggcaa

SEQ ID NO: 31844 - DNA, 169 bp, Homo sapiens
  misc_feature 127: r=a or g
  misc_feature 134: r=a or g
  misc_feature 143: y=c or t
tttacttagatcctgactgtttttcaatgaaaagtctcatttaaccacacacacacacacaaacaaaataactaaattgtataagctatgtgaatagctgggctgtattgaaatgccatggacctgrtttgcarctggagttyctatcttatatgaggttaccacgttg

SEQ ID NO: 31845 - DNA, 273 bp, Homo sapiens
agtgtattagtttcctattgttcctataacaaattaccacaaatttagtgacttaaaacaatgcaaacgtattatcttacagttctggaggccagaatttctaaaatcgaaatgttggcagggctgtattccttcctggaaggctctaaagaagaatctatttcctttccttttccaatgtctaatgcctgcccagattccttggcttatggtcccttcctcaatctttaaagccagcagcatagcatcttcaaatctctttctctgacctca

SEQ ID NO: 31846 - DNA, 277 bp, Homo sapiens
  misc_feature 78: r=a or g
  misc_feature 132: r=a or g
  misc_feature 144: m=a or c
  misc_feature 145: v=a or c or g
  misc_feature 147: r=a or g
  misc_feature 151: d=a or g or t
  misc_feature 171: m=a or c
tgatttttcacaatgtctcctgagccctgaggctcagccagcccttactgctatgtctcaacatttaaaggccattgragtcccactccattccatatactttggacaacgtttctcatttatgcctggggrcagctctgtaamvarttgdaataatcagttccatttcamagatgactaagctcaggctcacagagtctaagtcacctccctaggtaagtggcaggattggaatgaggttccatccctcaccctccctagaggatcctgagcacca

SEQ ID NO: 31847 - DNA, 171 bp, Homo sapiens
  misc_feature 17: b=c or g or t
  misc_feature 141: r=a or g
  misc_feature 146: r=a or g
  misc_feature 151: s=g or c
ttctaattaagtggaabaaagggagaacagatattgagggtggggtaggacagaaaaccatcagtctctgatacagactcattaatgataaacaaaaggaaaaccaaagagcagctaccattctctagcttcctctagagragggrgcctsctgtttctcgtagccgataa

SEQ ID NO: 31848 - DNA, 139 bp, Homo sapiens
  misc_feature 61: s=g or c
  misc_feature 62: r=a or g
actacaggaaaaactgttctcttctgtggcacagagaaccctgcttcaaagcagaagtagsrgttccggagtccagctggctaaaactcatcccagaggataatggcaacccatgccttagaaatcgctgggctgtttc

SEQ ID NO: 31849 - DNA, 105 bp, Homo sapiens
  misc_feature 18: m=a or c
  misc_feature 22: s=g or c
acagtgctttctggtggmggasaagcttggagacaagtagctttggagaatagctgagggtccatttccactgcagactaatccctgccaatgggtgctgcacac

SEQ ID NO: 31850 - DNA, 429 bp, Homo sapiens
tcttaattatacaggattgcagccagttttcctttttgcactcccatctaccctggcattcagaggtgcctctagttcctaagtcttcacagcgttgtttagcttgaatcatcttgcttgatttttggcttcttctactgcaggattagattcagctttctctaagctgctaagtcgtttaccactcagccagctgattttcatctcccaaaattttgttgacacccctcaattcctattgccatctcccatcttctttgttcttaaatatttatgtcatttttattcctgtattgtgattgtactggagcatcggaggaagccaagattaatgtgggctcattctaccagaggctccttcagtgattttcaacacttttctgttgaatatcgaatattgtccaaattgaaatttataattttacagca

SEQ ID NO: 31851 - DNA, 320 bp, Homo sapiens
  misc_feature 129: s=g or c
  misc_feature 130: y=c or t
  misc_feature 280: r=a or g
  misc_feature 293: s=g or c
  misc_feature 303: r=a or g
  misc_feature 308: y=c or t
aaactccgaactctttaaaaggtcccgtaaatgggctacggggctgcatgatgccttgtgtttaaaagagatccaaggggcagcccagcactttccgtccagctgcacttcatactgtaactgtgtccsytgaaaagtgaagctcaaaggattttttagaatctgctgccccagcagacctttcttctctaatgcagcttctaagctgccatcagccaggcgggaagctgggtggggtgtggtggttagtgcttgaagtcccactacttgggaggctgargcgggaggatcgsttgagcctgrgaggyggaggttgcagt

SEQ ID NO: 31852 - DNA, 427 bp, Homo sapiens
  misc_feature 152: r=a or g
  misc_feature 264: d=a or g or t
  misc_feature 265: v=a or c or g
tagattttttgaagtcttcatttgttactttcattctacgttctcttaaggccatcagaccagcttctgtacagattgcctgtaagaaagaagagtgtgttcagaaagtgacatactcatttttattctaacaaggaattccaaaaaacctrttctgaggccaggcgcggtggctcacacctgtaatcccagcactctgggaggccgaggcaggtggatcgcctaaggtcaggagttcaagaccagcctggccaacacggtgadvccccatctctactaaaaatacaaaaagttagccagggacggtggcaggcacctgtggtcctagctactcgggaggctgaggcaggagaattgcttgaacccgggaggcggaggttgcagtgagccgagatcgcgccactgcactctagcctgagcaacgagc

SEQ ID NO: 31853 - DNA, 111 bp, Homo sapiens
tactatccctagcattaatcaaagtgtcatgtaaaggtttgatttttgagcctaagcagaatttgaaattcttctaagagaatttagcacctagggcaaactacagggaat

SEQ ID NO: 31854 - DNA, 127 bp, Homo sapiens
caattggaggttacaacaggtgtacttcatattaatctaattattactacttttatagcttatttgattttcaagtgtcaggataccatattttgtgtccaaatatgaaaaggagatgagggcccca

SEQ ID NO: 31855 - DNA, 440 bp, Homo sapiens
  misc_feature 152: k=g or t
  misc_feature 159: m=a or c
  misc_feature 194: r=a or g
  misc_feature 412: n=a, g, c or t
  misc_feature 414: w=a or t
  misc_feature 421: w=a or t
tgttggaagacttttcacaatatttcttctgtagcttatctaatttcatgctgtttgataaaattgttttcttaattctcttcacgtctgactcatttccatgactagtggttggtttttcttttttgtgttttacacagataaacatagtktatatamctaatttcacatttgcaatattgtcaagtatagartaccaaagcttagttgaaatgcatcaagttcctgattgcttgacttacttgctaattgatttcttttccacataccagcatcacattgcataggattcagatttgtatcctcaaaaaaaaattatcaaatacatcttataatcctttgcaaatgattctaaatataaaaactcaatgtttaacatgtgagtctacttgcactactatgtaaataaatnawgtttgawgttgtcacaatagctttaa

SEQ ID NO: 31856 - DNA, 457 bp, Homo sapiens
  misc_feature 438: s=g or c
cttttgcaacatagacataatgcttttagttgttttatataataatttgttaaactataataagaaattgtgatctgttacccaatagtaacaacaatagatgaaagccagagattaccattaaaattatgcttaccacaaatcaagctcattttatttatttacgaagcattggctcttcctgaaaagagtgccctggagtacaaaattattcccacttagtttctgggataatattttccatttatgcaccagtattgtgataaaggagacaatggtttttcattaacactaatatgctttagacagaaaaatggcctataagtacttctgaccatgagataatctttggacaaactgcaaatcatgagtaattactccttctactttgaaggagtaacgcctcagcacctgatgctaaacaacagtcagcctagstctttgttgtggtcaaagt

SEQ ID NO: 31857 - DNA, 228 bp, Homo sapiens
cactcaaaaccacacaactacatggaaactgaacaacctgctcctgattcactactgggtaaacaacaaaattaaggcagaaataaagatgttctttgaaaccaataagaacaaagactcaatgtaccagaatctctgggacacatttaaagcagtgtgtagagagaaatttatagcactaaatgcccacaaaagaaagcaggaaagatctaaaattgacaccctaat

SEQ ID NO: 31858 - DNA, 323 bp, Homo sapiens
  misc_feature 146: w=a or t
  misc_feature 147: k=g or t
  misc_feature 148: r=a or g
  misc_feature 168: n=a, g, c or t
tatcagaatgcatcttcagaattacacactgaagatacaaaaggtccagttggtaagctcatcagtaaataacaaggctttgaaatctgacaaattagctatttttgtaggaagataatagaacagcaagatggaagacaagtggwkragtaatcatctgttttgagnttgacaaggtgtgacataaccctgttaatagacacaagtaaaagaaaatcatactaggattggatattagtgagcgagcaccgaccagtagaaacaacaacagcataaatctgttatttaagtatcccaataatgaggttaaaaaaaaaaaaaaa

SEQ ID NO: 31859 - DNA, 447 bp, Homo sapiens
  misc_feature 29: s=g or c
  misc_feature 73: w=a or t
aagagcgaggagagcaaaaatctctagtsatcttttatttgtaactggtttttagttaggaatttggatcctwggaagagcctcaagaaactggatagactcctctaggacatctcacaggaatgaataaccttgaaaacttgaaagtggattcgactacctggtgacacagaccacatggtaatacacgagcaattttctctaacccctaaacaggtctcacaagcaatctttggtttctcaacacttttttcccaattaaattgaccagaaaatatccttctttccttctccagcatctaactttttaagttgcaaactcataaatgaagtcaggctattgatattatgcttacattctacacagtaatattataaatttaaatgaagcaatatctactctgtgttctagttcctcaaatgaatagtttattccacataaaaaga

SEQ ID NO: 31860 - DNA, 397 bp, Homo sapiens
  misc_feature 153: y=c or t
  misc_feature 336: w=a or t
  misc_feature 393: w=a or t
ctcaaccccataatttgagccattgccttgcttaattttggtttccaccatttccttttagtggagaagagaggaagtcagagggtagggacctttgcctgcccctgggcgagtgcgggcagggatctgagaccagattgttctcgcaacccytgccagaactcactctcccctgaagtttagggtcccatctcccagatgtaagttgttttgcaaactcagtttgccaggatttctttctttcctaatcttaaattcacagataaagcaatgaaaagagtcagatcccatttccgtctgccccctcgtcaccaggtgtgatagccccagccaggwcacacctggcctcacactttgagctgagacttgaaaacgatgctgtggcggaagatwatgg

SEQ ID NO: 31861 - DNA, 516 bp, Homo sapiens
  misc_feature 83: s=g or c
  misc_feature 151: h=a or c or t
  misc_feature 458: r=a or g
  misc_feature 488: r=a or g
attaatatctggctcttgggagccagtataagcagactctagcagacctcccctccaaaagtataaattagagattcctagtscatgatctgtgaatgagttccttgggaagtgcataaagcctaaaagatttctgaggagaagtattgghttgagtacctaatgtttgtctgccactgtagtttaaggatttggcaaacagacaaagaccagctcatgcagggcctagtaggtcatagtaagaattttagtcttgaaagcattgaaaagacattgaaactagggagtggtccagtaaagtgctatttttttttaagaaaaattattactctacctgcagagtagtgcaattactattagtaattcactactactagtaatatctgaggggatcatcagcagtgcatggaagagatgtgcaagtgataatggtgattggaaaagagtggaggtaatgraaatacaacctttcaccaaataccagctgrgcatttattatgtgtcatgtgctactat

SEQ ID NO: 31862 - DNA, 124 bp, Homo sapiens
caatcatttattcatcaaatgaacaaattcatcacttcagagcacacaggaccatgcctgatttgtctgtcattaacaaatgactccttgctataaatctggccaagctatctattatcccccc

SEQ ID NO: 31863 - DNA, 407 bp, Homo sapiens
  misc_feature 125: d=a or g or t
  misc_feature 132: r=a or g
  misc_feature 133: w=a or t
  misc_feature 141: w=a or t
  misc_feature 143: m=a or c
  misc_feature 241: n=a, g, c or t
ctaagtgattctgatgcagatggtttagggaccgcaacttaggaaacagtgatctaggtcagagatcagcaaaccatggctcttgccaaattcagtccaccatctgcttttgtatggctcttgadctaaggrwgggttttwamatttttaaatgtcttaaaatgttaaaagaagaatactcttttgtaacaggtaggagttgtacaaaattcaaatttcaatgtccataaaatgttattgnaacacagccacactcattggtttgagcattctcaatggctgcttttgcattgtgagggcagagttgagtagttgcaacagagatcatgtagcctgcaaagcctaacatatttactgtctggctctttacagaaaaattttgccagtctgttgtctaggcattcaca

SEQ ID NO: 31864 - DNA, 361 bp, Homo sapiens
  misc_feature 125: w=a or t
  misc_feature 136: s=g or c
actttactaagttttctttactttaacagtacaattgtcccactgagcatgcagacctgcagggaagaactgcacttcacgatgccgcaatggcagattgtccttctagcatacagctgctttgwgaccatggggsctctgttgaatgccaaagatgtagacgggcggacaccacttgttctggctactcagatgagtaggccaacaatatgtcaactgctgatagatagaggagcggatgttaattccagagacaaacaaaacagggagagaactttggaagaaagggccatctttgcaacagcgaaatttgacacacatgcaagatgaagtaaatgtgaagtcacatcagagggagcgc

SEQ ID NO: 31865 - DNA, 316 bp, Homo sapiens
  misc_feature 139: r=a or g
  misc_feature 141: s=g or c
  misc_feature 290: s=g or c
  misc_feature 291: h=a or c or t
ttggggaggaacaggcagtgggtagggccttggaactcccaagggtatatgccctttgtcttcagttaccaggatggcttgggaaggaccattagctttcccagtgcctccagcagccctcctcaaggacccctgtgargscaggcagaaatggcgtggcaggggacccagcgagcccagagggattttgccgctgcttcctctacccctgtatttcacgcagctctctaaattgactcagctccaggtaaggtcagaatcttctcggataatctagaccttcaggttcshcagtggggctgtgtgtttgggggcg

SEQ ID NO: 31866 - DNA, 283 bp, Homo sapiens
  misc_feature 281: h=a or c or t
acgaccctttcatgtgaaatctttagtgttgtgagcccttaaaagggacagaaattgtgcatttggggagcttggattttaaggcagtagcttgctgatgctcccagctgaataagtcccttctttctacaactcggtgtcttgagttttgtctgcagctcctcctgttacatttcttggctccctgactgggaagcaacgtgactgacagacagctgaggcagccccttaggcaacttaagcctgccttgtggagtgcccctgtgggggactcagccaghcc

SEQ ID NO: 31867 - DNA, 448 bp, Homo sapiens
  misc_feature 36: y=c or t
  misc_feature 40: k=g or t
  misc_feature 46: k=g or t
  misc_feature 47: n=a, g, c or t
  misc_feature 48: n=a, g, c or t
  misc_feature 127: r=a or g
  misc_feature 149: d=a or g or t
  misc_feature 300: h=a or c or t
  misc_feature 302: d=a or g or t
  misc_feature 366: r=a or g
  misc_feature 368: r=a or g
  misc_feature 382: r=a or g
  misc_feature 397: r=a or g
  misc_feature 403: r=a or g
ccttattcgtagactaaattattcacacaaaaatgytatkaaagcknnacaagaagaaaatcttctattcacacagctgaaacacaggtcaaagaatctccctattttatcgagataacttgttgarttattttttacctcaataaggdataaatgtatatccatctatcatctatctatcatccaaatatatatcaagaaagtcattaaactaataacgaaaaatgttttgtgtatgtgcaggaagaatcagactaaatactcatatagaaaaaattgtcagcctttgaagaccatcthadattatcttcttgatacattttgttttcaaaacagattttgaagaaacctgaaatagcaaaatgrcrtttcctttaacagrcttaaaaagcactgraatcaracacttgatcttagttttgaagcagttatgttctatgactatagt

SEQ ID NO: 31868 - DNA, 275 bp, Homo sapiens
  misc_feature 159: s=g or c
acgcggcccggccacacgtgtggagggtctatcacgcatgcgtgcgcccgccaagattccttccgccgtcttctggaccggcctcctgcaagtcctaatctcagcccaaattcagcgctggcttccatctggagatctttgatgggtacaaatggtagstgactttcttcgatcatctctcgaacgggagttcggtgagcagcaactcggctcgtccgggaatccagactttccggaagacggaccctccccccagtccagcttagcccgcctgc

SEQ ID NO: 31869 - DNA, 75 bp, Homo sapiens
tccaacagtataggaaaatacctgtttacatgaatgcttataaacctgtattcattcactgtttaattaagagta

SEQ ID NO: 31870 - DNA, 245 bp, Homo sapiens
  misc_feature 125: k=g or t
  misc_feature 164: s=g or c
  misc_feature 175: k=g or t
ttttaggtagaatgttggcacctggaagaatggaggctgtaagttcttttgctggcaaagtataaaaagaaatgtttagtggacaggtgtgtgagttaaactctagagtataactaagcagtgtkgcttgccattttttactgatttgcttgtgcttctaccascttcttaatgkgtccctggaatgcctacatgtaaaaggattctgatggagaagaaacttctagaccttaagtgactgtcct

SEQ ID NO: 31871 - DNA, 280 bp, Homo sapiens
  misc_feature 135: w=a or t
  misc_feature 139: m=a or c
cttggttttacgtatataaatcttgcaacactaaagttctgcttacctcccgtctatcctttggtgctatagttgccatatacattacatctatattttttaaaacacaaaatgcagtgctacaagtttgtcttwacgmaactaagaacagtatgaaaaggatgttaaaatatctgggtagttattaaaataaattatctctaaaatgaattttgtaatctattattataattttactagttagaattttcaattgttattttttatatctttaagaggt

SEQ ID NO: 31872 - DNA, 388 bp, Homo sapiens
  misc_feature 123: r=a or g
  misc_feature 129: y=c or t
  misc_feature 131: y=c or t
  misc_feature 136: w=a or t
  misc_feature 141: m=a or c
caagtctataaaaattgtttgttttggccaggctggtctcgaactcccgacctcaggtgatccgcccgcctcggcctcccaaagtgctgggactataagcgtgagccaccgcgcctggcgagrtcatcycyttttwatggmctagatagagatgtacccaagcagcaatttcaatttcattgaaaagacacctctgcctccccttgctgtcataaccatccttctcccttgctccctttcctccctcaccaaataacagatgtatgccagaagaggtgtgtgagtgacaaatgaaagttatactaaaacactgtttttgtttgtttataaattttttatttttaaaaaattaatttccacctgaatcatagattcaagttgccctgaa

SEQ ID NO: 31873 - DNA, 450 bp, Homo sapiens
  misc_feature 261: n=a, g, c or t
taaaaggcaccaacgtggctgaatctcagaaatacaatgttgagcaaaataaatcacgaaaattgtgaaagaatgtgtacattgtgatttcatttttgtaacattctaaaatggtaaaactaaggaattggtaaaaaaatatgaagaaaagaaagaaagttattatcacaaattaattgtaccagttacttccaggaaatttaactgaccaggttcttacaggaggcttcagcaatattgccattagttctgttcttaagntggggatgaggtagatacatggaatttcattttgtataactattaccattctggaagaaaacattcaaactgtttttcatctgctgtcacactaacacaacaacagtcaatacagaagacttctgtgaccccaaaatatgtggaggtttttccccatcagcaagcaagcaatcagttctgcagcagata

SEQ ID NO: 31874 - DNA, 147 bp, Homo sapiens
gactagactagaagcaccatgttggcagggacctggctatttcattcacagctctatccccagtgcctggcatgtggtgggttttcttgttgaatgattggattcaaataacattatccaaagaattttggtctcttggcccaagcc

SEQ ID NO: 31875 - DNA, 336 bp, Homo sapiens
  misc_feature 130: w=a or t
  misc_feature 137: k=g or t
  misc_feature 139: k=g or t
taatgttacctgttcttgtctctcagcattttgaatgagcatcataatcagagtagaaggcaagttaaactataaaagtgtcaagtggcttgttaacttcttaatttaatggacctttacttagaatatwataatgktkggagcctcttgggaccaaccgatgagcgacagtttcatgtttagatttgtattgtttctctgtccaagtccttattctctatcttgtggggaggggtgacaggggagggttttactttttttgcaaaaatgtttgaaaatatctgtcagattttatattcgttagttataataaacttatttttaaagtaaaaaaaa

SEQ ID NO: 31876 - DNA, 400 bp, Homo sapiens
  misc_feature 208: n=a, g, c or t
  misc_feature 326: k=g or t
  misc_feature 386: w=a or t
tttgcatgatatgcccagtagtggtatagatcattaccagtggatcatatggtagttgtatttttaacttttgtttatttttcattttttaaaatggggtcttgctgtgttattcaggctggtctcagactcctgggctcaagcagtcctgcacctcagcctcctgagtagctgggactacaggcacacaccaccgtgcctggctatngttttagatttttgaggaacatccatactgttttccatatggctatactaattagcattcctaccagccatatataagagttcccccttttccatgttctcagcagcattttttattktttatctttggtaatagccatcctaactgaggtgaaattatatctcattgtggttttgawttgcatttccctga

SEQ ID NO: 31877 - DNA, 395 bp, Homo sapiens
  misc_feature 387: n=a, g, c or t
tcatgaagtctttgctcatgcctatgtcttgaatggtattgcctagattttcttctagagtttttatggttttaggtcttatgtttaaatctttaatccatcttgagttaatttttgtgtaaggtgtaaggaagggatccagtttcagctttctgcataggctacccagtttttccaacaccatttattaaatagggaatcctttccccattgcctgtttttgtcaggttcatcaaagatcaaatggttgtggacggtgtggtgttatttctgaggcctctgttctgttccaatacatgctgttttggttactgtagccttgtagtatagtttgaagtcaggtagcatgatgcctccagctttgttctttttgcttaggattgtctnggctatgt

SEQ ID NO: 31878 - DNA, 202 bp, Homo sapiens
taacatttttgcaacatttgtggttgattttaatgatttggagaaaccatctgaaacattaacatttaaaccctttcttaaaggtgacatttttttttcagagatggagtctcacagtgtttcctaggtacaattcctgggctcaagcaatacttctgcctcagcctcccaagcagctgggactacaggcatacaccaccgc

SEQ ID NO: 31879 - DNA, 307 bp, Homo sapiens
  misc_feature 165: w=a or t
  misc_feature 166: d=a or g or t
  misc_feature 206: k=g or t
  misc_feature 249: r=a or g
  misc_feature 253: r=a or g
ttttattgcgttgtgatcagataacatactatctctgatttcagtcctttgaatgtattgaaacttgctttttggctcagaataaggcaaatgtttgtaaatgttacagaggtacttgagaagaatatgcattctgcaatcattgggcactgttaatcctattawdcaaatctacattttttactcaattttgaagtctttttgtkatatcagtaatttataaagtgatgttaaaatctcccactatgrcagrcctccactctgtcacccaggctggggcacagtggcacgaatcatgagtcactgc

SEQ ID NO: 31880 - DNA, 342 bp, Homo sapiens
  misc_feature 154: n=a, g, c or t
catatttgactcgaaaccaacacactttgagtcagccattaacagatgagcatctccaagccctgtttcgggttgccacaactgaaatggagcccggttgggatgaccttgtgagagaaagaaatgaatctaatccataaggctttgtagtacnagattgaaaaactcaacaagaatttaattctaaaagcaaaaattggtttgagttttcaagtttactaatttggattgtgagaaagtaccaagtaccagccgtccaaactgatcacaattaaaattctgacagttgccttttttttcatctcaaatggcagcttgggactgaaacatgagaatgccacc

SEQ ID NO: 31881 - DNA, 373 bp, Homo sapiens
cctgtgctttatatttgcatttcctcagatgtagaatgggtatcaataccagaacaactttgcacatgaattttatgaagatataattagaatgtggtggctgggcatggtgtctcatgcctgtaatcccggcactttgggaggctgaggtgggatgattgcttgaggccgggggttcgggaccggcctgggcagtatagtaagacccccccccatctcaaaaaaaatttttattactaagtcaggcatagtggcatgattctgtggtcccaccttcttgggaggtggaggcaggaggattgcttgagtccgggaggttgaagctgcggtgagctgtgattgtgccgcttcataccagcctgggtgacagagt

SEQ ID NO: 31882 - DNA, 267 bp, Homo sapiens
  misc_feature 128: s=g or c
  misc_feature 185: h=a or c or t
ttgctctgtcgtccaggctggagtgcagtggtgcaatctcggctcactgcaagctccacctcctggcttcatgccattcagctgcctcagcctctcaagtagctgggactacaggcgcccgccaccascccagctaattttttgtatttttcgtagagacggggtttcgccgtgttatccaggahggtctcgatctcctgacctcatgatctgcccgcctcggcctcccaaagtgctgagattacaggcatgagccaccgcgcccac

SEQ ID NO: 31883 - DNA, 226 bp, Homo sapiens
  misc_feature 206: r=a or g
tacttagtgacttaatgggtaggttgcatgtgcagcctggatatgctggacaaaaggatgattcacatcctagacgggacggcacaagatttcatcatgccactcggaatggcaatttaaaacttatgaattgtttatttctggaattttccatttaatatttttggaccatagtgactgtggttaactatggaaagcaaaaccaragataataagggagactgtc

SEQ ID NO: 31884 - DNA, 177 bp, Homo sapiens
taggatattttggaatttgaagagaatgggaatgtctggatagtgcatgtatagaattgggaagtaaacactggaggacctgggagtgtggtgcttattgatggatcgttgggtttatccaggattggggtttttgccagatgggtgtgatgagaatcttaagagttaagggtaaag

SEQ ID NO: 31885 - DNA, 193 bp, Homo sapiens
cgtccacaatgttaatacaagcccaacattctttaatttgtgttttgttttttggaggcacagtcttgctctgtcacccaggctggtatgaagtggcacgatttcagctcactgcagcctcgacctcctgagctctagcaattctcccatctcggccttccaagtagctaggactgcaggtgtgtgccacccc

SEQ ID NO: 31886 - DNA, 398 bp, Homo sapiens
tccaggtactaattggccaattaagttttaaatccaagcaacctgacttgtcagtgtaaacagtttctagttaatcactgtgatgctgaataagtatagtgggtagcacatctgattcaactgagatctaccttcttaagaaaaaacaaatctaggaagcttacagtggctaagatgggtcatttaaatgtaggtgatttataactgcacgtaagtctatttcgtgttgctttgttatcttacctctcgataagaatggcaaataactactcttactcattgtgcatgattttctggttttatgtgactgtgttcaaattgaggaaaccagaatccagttattcaacaacaataattttctctatactatgatttatttacattttttcatatagttc

SEQ ID NO: 31887 - DNA, 227 bp, Homo sapiens
ccattagcagccactccacattgtcccagctccccagcccctggcagccacaatctactatctactttctatctctggatttgcatattcaagacatttcacgtaagtggaattacacagtatgtggtcttttgtgactgacttatttcacttagcataatgttgtcaaggttcatccatgctggagcatgaagcagtgcttcattcctttgtatggcagaacgact

SEQ ID NO: 31888 - DNA, 319 bp, Homo sapiens
tcattatcacctggatatctcagaagcagtttacacttggcacctaacacattgcctggcacatactgggtattcaataaagatgtgtaaatgaaagaatgaattcaaacatgttcaaatctgaatttatcacttcttccaaatctgttcttcctctttttgtctgccctaattcaaattataatttactcaggcacctaagtagaacctgttatttgtccttgactctttcttatgtaattacttaccaagtctaatagatactactaacttaattatctggaagacatccctttaccttcactgcactgccactact

SEQ ID NO: 31889 - DNA, 268 bp, Homo sapiens
tgtaagtccctttcccccgcctgctattagtacatataccatatttctgcacttttattatctgaattggaaagtatgtaattaaaaacagttacgaatttagtacttgtcaatttagtagtagtaaaatgggttgatatatttagagacattattcattctacaggcagagcttgatgcacaaatggattcctggtctccttggtccacaggatgggaactgttggtattgcatttgaaccaaggaatatttgtcttaagagtagac

SEQ ID NO: 31890 - DNA, 64 bp, Homo sapiens
gatcgcgccattgcactccagcctgggcaacgagagcaaaactccatctcaaaaaaaaaaaaaa

SEQ ID NO: 31891 - DNA, 473 bp, Homo sapiens
  misc_feature 311: k=g or t
  misc_feature 312: n=a, g, c or t
  misc_feature 313: b=c or g or t
taattgctgtttttaaattcctagtgttttctattgttgaaatgagtaggtcagcaactgaattaatcagaatgacacccttaaaagggagtatgaactgttttccaaaatgggtgattgtactaaatgtgaatggattctcaggtagagcatagtccttctgaaattcactctttgctcaaacatttattggcatctattaacaggcactgtatttgttatggggttcaccaaaatgaatgagacataaggcttattctcaaggagattatcttgttgggattataaatcatttcctaagcaactaaaaknbaagatagtgcagctcagcaactttaaagagcacatgccatgtgccaggcactctgccaggtggcggaagtacagaaatgagttagatacaggactttcttctcaaagatcttaacatctagtggaacagtgtgtaccctgagaatgatattaacgagtac

SEQ ID NO: 31892 - DNA, 207 bp, Homo sapiens
  misc_feature 123: k=g or t
  misc_feature 125: w=a or t
  misc_feature 127: w=a or t
  misc_feature 136: r=a or g
  misc_feature 137: v=a or c or g
  misc_feature 138: w=a or t
  misc_feature 139: k=g or t
taattcaggttatactccttcacatagttaatggactgaagggatcttctactcctatggcacaggttttattaactaaaatatccccatgtggagttatgaggaaagcttaggttatacttkawgwctgtctgarvwkggtaacgatcaagttcctgaaccacagcagtcaaatcaaacttaatactgcaagacatggaaatataa

SEQ ID NO: 31893 - DNA, 421 bp, Homo sapiens
  misc_feature 127: k=g or t
  misc_feature 354: h=a or c or t
  misc_feature 355: r=a or g
  misc_feature 356: m=a or c
cttcttccggccctgctgtctgcctccccggctgattggattcgttactgctttgcaacgcgcacctaactccaggctggaatgcaatagcgtggtcttggctcactgcaacctccgcctcccgggkttcaagcaattctcctgcctcagcctcctaagtagctgggactacaggggccctcctgctgctccctccatgaggctggtcctgaaggaataggcctgtggctcgtccctcctccccatctcggccctgaggcagacataccttccacagctctgggagcaccgcctccacccaggtctcacaggatgggacacaaggataggcattaagcaggacttccagggcchrmgggaagttggcgcagtgtttcagcatctaggggtcaaaagagggtcttgggcacatgcctccccc

SEQ ID NO: 31894 - DNA, 380 bp, Homo sapiens
  misc_feature 18: r=a or g
  misc_feature 110: k=g or t
  misc_feature 134: r=a or g
  misc_feature 142: w=a or t
  misc_feature 143: w=a or t
  misc_feature 152: k=g or t
  misc_feature 164: w=a or t
  misc_feature 182: w=a or t
  misc_feature 237: n=a, g, c or t
  misc_feature 259: y=c or t
  misc_feature 275: k=g or t
  misc_feature 333: r=a or g
  misc_feature 355: w=a or t
ttgtgatagtttgctgaraatgatggtttccagcttcatccatgtccctgcaaaggatgtgaactcatccttttttatggctgcatagtattccatggtgtataaatgtktatttttaaaaacaactagtgtartacactgwwagctttgtktgtagtgttgtwattccataggcttttgtwctttgggttagttttgaatttttccccatacgtgatgtatgtactttaatatttntgagaaatgataactttgagtytatgtaaaaagatttktatggttagcacttcttgtcttgacattagtggaaactggaatgagagagttatttgraaaaacatattccacatatttwtagttttaacaacaatcacacagaa

SEQ ID NO: 31895 - DNA, 324 bp, Homo sapiens
ctctttccacggtctccctctgatgcagagctgaagctggactgtactgctgccatctcggctcactgcaacctccctgcctgattctcctgcctcagcctgccgagtggcgcgccgccacgcctgactggtttttcatattattttggtggagacggagtttcgctgtgttggccgggctggtctccagctccgaaccacgagtgatccgccagcctcggcttcccgagttgctgggattgcagacggagtgtcgttcactcagtgctcaatggtgcccaggctggagtgcagtggcgtgatctcggctcgctacaacctcca

SEQ ID NO: 31896 - DNA, 445 bp, Homo sapiens
  misc_feature 358: r=a or g
  misc_feature 437: h=a or c or t
gtaatgcagtttttcccttacatctaccgggtgtgggaactcacccagcgcatccgactgcacgtaagtgtgcaccagaacccccgcgtcgtcttagggccaccgctttagtataggcacaagtcggagggtcgaaggtcccttctagctcaggaaaatcgaggtcaggaggcggggatattcgccccgattcagaccccgaacaaaggtgcttaccctgctgtgggctgggcccgcgacttctcgcttgctttgcctcttttctggatcttttcatagaagaaaaggataaatgagcagttaaaatagccacccaaaggaggacgcctgacagtgtgcccagcctgctgggaaaggrcagaccgccctctattgggcctcctttggccgggcccagccttcgtaggatgcagggacttccgggtgatgtaatagghtcgcgttc

SEQ ID NO: 31897 - DNA, 186 bp, Homo sapiens
  misc_feature 124: s=g or c
  misc_feature 133: n=a, g, c or t
  misc_feature 139: m=a or c
tttttagtggagacggggtttcaccatgttggccaggctggtctctatctcttgacctcgtgatctgcctgcctcgccctgccaaagtgctgggattacaggcatgagtcaccccacacccagscgaaatttnggtaamctcaatcaagtttatttatttatttatttatttttttaatgggtccc

SEQ ID NO: 31898 - DNA, 346 bp, Homo sapiens
aatttattttaaccatgtttgaaggtacagctctgtggcattaagtacatttatattgttttgcaaccagcagaacttttaaaaaatttttggggtacatagtgggtgtatatgtttttgaggtacatgagatattttgatacaggtatacaatgcataatgatcacatcagggtaaatggtattggagtatccatcacctcaagcgtttgtcattctttgtgttgtaaacagtccatatactaaaagtaactaaaggagtacttttagttacttttaaatgtacaataattattgttgactgtagtcaccctgttgtgatgtcaactagatcttattcagttctg

SEQ ID NO: 31899 - DNA, 296 bp, Homo sapiens
aatgaaaccgggaggaaagaagacaagagagaacgcaaacagtttgaagctgaggattttccgtctttaaatcctgagtatgagagagaacaaatcacaataagtctttagctgcaggtgtgtggggcctacacgcccagacacacacatacccaaccaaaaaaatctcccaagctcctctcttagaatatcctccgaatcctaaatctagagctccaaggatgctggtcattaagaaaggtaatacaaaagacttacagctatctggattcccagtagtaggaaatcttccgtcc

SEQ ID NO: 31900 - DNA, 411 bp, Homo sapiens
atttcaaaacaacatattgtacatggtaaatatacataattttatctgtcaatctttgaaattgattaattttttaaaaacccctcttaggctcacacagcaactggctgagccagcagtcacatcaggcttggctggtgccagatccttggtagttggtgctctcagcagccaccctgaatggcctcccagcgggagcttgctgagtatttgttgacacaatgattggcccagcctctgggatcctaagcctacagcagttgttctacacttttttccatttgaattgcatttttaacagttgggggtatacaatgaaaaaataaatcccgatttctggcttctcttaaaacataggaaggtgcggcgggcagctctgagtgccagcccggtggcagattttccagagta

SEQ ID NO: 31901 - DNA, 242 bp, Homo sapiens
  misc_feature 60: r=a or g
aggcagaggtttcagtgagctgagatcatgccactgcattccagcctgggcaacggagtragactttgcctcaataaaatacaaataaaatttaaaaatactcatacatgtaatggtcataaataattgggaggcttatctttcagatataggaggctctttgggagggtggtatactaatcaacccccctaatcaatccaaagaatcctcttggattctttgttgttcttatagacacgga

SEQ ID NO: 31902 - DNA, 462 bp, Homo sapiens
  misc_feature 415: n=a, g, c or t
  misc_feature 436: n=a, g, c or t
catacaaattagttaacaaatacaagccactgcaggactttctaaacagcactgtatagttcatcactgtggaaggggtcatttcactaggagtaaagtcaaatttctcttagctcagccctgtccctgattcctcagcatctcttcaggttttgttcagacctgaaggtcagaggtaacagacttccagggccagggtcacctcttgatttaacttgggctgtggccagattagccacattgatctgctctcttggaagcctgaagaagccagtaatctcacttgggcacacatggagggagagagtataagaaaaaaaaacaacaggccgggcgcagtggctcacgcctataatcccagcactttgggaggccgaggcgggcagatcacgaggtcaggaaattgagaccatcntggctaacatggtgaaacccngtctctactaaaaatacaaaaaatta

SEQ ID NO: 31903 - DNA, 307 bp, Homo sapiens
ggaaaatattttagaattaaatagtgaggatggttgaccaagcttgtgcatgtactaaaagccattaaattgtatatactttaaaacagtggattttatggtatgtgaattttatctcaattttaaaaaaagtctttaaatgtagtatgaaactttttttaaggccaggcagggtggctcacgcctgtaatcccagcactttgggagactgaggcgggcggatcacctgaggtcaggagttctagactagcctggccaacatgatgaaaccctgtctctaccgaaaatacgaaaattagcccagcag

SEQ ID NO: 31904 - DNA, 319 bp, Homo sapiens
aaatagttaagtggcctccagtacaaactcccagttcccagaaaagacttaaaactagtatctggagattccaagtcctttaaaaggattttagctgatatgcaggcatctggatgttagcctggggttttggctggattccacctcgctcagtgatgatagtctgtttccctggaacattcctgtggttttagtagtaatgagatgtgtgcaccactccagtgggaactgaagctcttagtagttacattgtaattaaaaaagaattataaaacaagaaatcagcaagcctgcttacctccagagacacaccgttcca

SEQ ID NO: 31905 - DNA, 373 bp, Homo sapiens
  misc_feature 313: w=a or t
  misc_feature 315: w=a or t
  misc_feature 332: w=a or t
  misc_feature 333: w=a or t
aatattaaataaaaatggagaggcattctaaatcagcctggtttaaaataagagggttgccttctatgatattgctttaaattttactaatgacaaaggtagttgtcttttaagaactgaaattttggtgtatttaagatgaccctttttgaacttgtgtgctaacagcccatttgctgaaatattctactgctataagataaaaagaatgtttctagaatgttagtgtagtatttctacattttattagtgaagtatgatatgtataattacattttcatggattttataaaacttctatgttattctgggwawctggtaactttatgtgwwaccttagcaaattatataacaatttgatgaggagactttt

SEQ ID NO: 31906 - DNA, 442 bp, Homo sapiens
  misc_feature 419: m=a or c
ttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttggagttacagctggctaggctgcaggagctgggattcagcatggatgattgtcgcaaagctcttttggcgtgtcaaggccaattgaaaaaggcagcaagttggttgtttaagaatgcggaacctctgaagtctctttccttggcctccaccagccgagatagcccaggggctgtggcagcgccattgatctctggcgtggagatccaaagctgagmgtgtgtgcatctgtttcatcgat

SEQ ID NO: 31907 - DNA, 253 bp, Homo sapiens
  misc_feature 73: w=a or t
  misc_feature 152: m=a or c
  misc_feature 184: d=a or g or t
  misc_feature 193: r=a or g
  misc_feature 225: y=c or t
  misc_feature 226: s=g or c
taatcaaagggatgtataaatcagccaataatttggaaaaataaagaaaaaaatatcttccattatattcctwttgccatttcttctctgttcctcacagaaccctggcttcctgtttatcctggcttcctttccccttgctcctctagcamccatataaagtgaatcataagatttcttcttdaaaagattrtgactacctccaccaatgagaattaatgcttysgggcatttttggtggaattaggtactt

SEQ ID NO: 31908 - DNA, 146 bp, Homo sapiens
aaaccttctgactactaacctgtagatccctttagttccttagcagtattcacaaatgtttttctactcacactttttacttctttttcccctctcgttacttttcacacttggatttttgtttgtcttttttttttttttttttt

SEQ ID NO: 31909 - DNA, 187 bp, Homo sapiens
  misc_feature 120: k=g or t
taaaggtaagacttgatttcagagattaagcataatgggaaaaaaaatgagctctacactttgaatttaagatccaggatatgtaggaatggatagaaagatgattgtcaggaaatttgktttctccaaggagcacagcatgaattggtagtcccaggcggtcttaccaaaggataggttggggcca

SEQ ID NO: 31910 - DNA, 103 bp, Homo sapiens
  misc_feature 54: k=g or t
  misc_feature 69: y=c or t
  misc_feature 77: k=g or t
  misc_feature 85: b=c or g or t
gttcctaccggcctggtccagcggacagcggctgcagcgggggcgccggctggkagctgtttttggaaygaagaaakatggaaabcggtgcagttctgctgga

SEQ ID NO: 31911 - DNA, 244 bp, Homo sapiens
  misc_feature 72: y=c or t
  misc_feature 73: y=c or t
  misc_feature 150: k=g or t
  misc_feature 151: n=a, g, c or t
caccttcaagtaaaacagtaatagcaagagtgaaggtactttggaaccactaacacctctgcacagggcagyyagccagctcaagttctttttcagagaaagggacttggccagtggtttaagtacctgccccttcacctctcagacgakncagctgacgaggcagctggcccagtcttgggagtctgctcaggacagtggtggagctgggtcttgaaccccagtctgcacctaaaaaactaaa

SEQ ID NO: 31912 - DNA, 66 bp, Homo sapiens
aacattgctctgcgagtcctcccgtttaaacgcattcaatttttgggtctctctctctctctctct

SEQ ID NO: 31913 - DNA, 336 bp, Homo sapiens
aactctctaatggcagcccgagggccagcaccaggttcaacttgagcagccttccagccgtcgttctgactcacagcccctcaccttcctagaaggagcgtggtgtgccggcatttgacactttacattatctattgtggatcgggccaatcttcagctcagcaaccggcggctggagcggaaagtgaaggagctggtgatgcaggtggatgatgagcacctgtcattgactgatcagaaggaccagctgagcttgcgtttgaaagccatgaagcggcaggtggaggaggctgaggaggaaatcgacagactggaaagttctaaaaagaagctgct

SEQ ID NO: 31914 - DNA, 385 bp, Homo sapiens
cgtcagcacctgcctcgagtggtgtgtttattatggtcgatgaaccgtggatatctcattactacacagagcccatcatttacatcaggggtccctcttggtggtgcacgttctgtgggctgggacaggtgtagactctgcagtcataaaccattccccaccacacagggcccttagttgtgacagtggaccaccggtgcgctcagtgacagcatgaccatttattatcattgggtttttaatacaggtcgagagctatgaattttgattttccttttaaaaagggatcaggaatacctctactaacaaccaatttgtccccacaatgcctctccctcctgcacgcaatggtggcctatgatcccgatgagagaatcaccgccca

SEQ ID NO: 31915 - DNA, 361 bp, Homo sapiens
  misc_feature 137: b=c or g or t
  misc_feature 138: w=a or t
  misc_feature 360: k=g or t
  misc_feature 361: k=g or t
tttgtcttagttaataaaagaaaaatgttgaggaacgaacagagaaacgagtctgctctgggtctgactgctgcccttcctgtccgtctggtgtggatattaatgttgctctgagggttagatgagagcatggcatbwagtggaccttcctgattgaagagaatcacattagggctataattaatttttcagctcaattacaggcttcttttgatatccttcatattgtatttgccagatttctaagagctttggtatattgcagttcaatgccagcctaacttggtataaatttaactgtagggaattgatttctgcatagttacttgttttagaaaatgctgaacacatgagaacagkk

SEQ ID NO: 31916 - DNA, 328 bp, Homo sapiens
  misc_feature 308: w=a or t
caaatagtggtcttagaaactaattattgctgtaatttcaataactaagtaggcattcctattcaaacctttactcaagtagttatattctttaactatagttactcatttgtaacatttttcactgtaagggtagtgacatcctgtttgtaacacaccctgtcctgggactaaatggaagggattgaggaaattctgctggagtctaaccccaccatagggcagcagcattttaggaacaaaagcagagaagctcacactcttctgagtataactggggagaagatttagggaggtggcttgtaggwtcagttttaagaccaggcca

SEQ ID NO: 31917 - DNA, 553 bp, Homo sapiens
  misc_feature 450: h=a or c or t
  misc_feature 451: w=a or t
agggaaggtgtctccggtagatgtaatcagcgcactcaaggagaggcgggagcgggccgctttcgcccagccaaaatcgtggcccctggatcttaatatttgccagtgatgcctgcaaaaatgtgacattgcatgttccctccaaactagatgccgagaaacttgttggtagagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtcctaaagaaaagacatactaaagaaaaagttctaaggcgcgccaagagaagatgggctccaattccttgttcghwgctagaaaactccttgggtccttttccacttttccttcaacaggttcaatctgacacggcccaaaactataccatatactattccataagaggtcctggagt

SEQ ID NO: 31918 - DNA, 255 bp, Homo sapiens
  misc_feature 195: n=a, g, c or t
tgagacattattgagacataatattgagagtgtgtgtatatatatatacacgctttattgagacataattcacataccatacaattcactcatttcaattataccattcagtgtttctttagtattttaacagagctgcacaacaattatggaaatcaattttagaacatttccttacttcaaaaagacacctcnttactctttagcagtcactcctcatttattcccagttccaccctcccctgcaccacccgc

SEQ ID NO: 31919 - DNA, 206 bp, Homo sapiens
  misc_feature 125: r=a or g
  misc_feature 144: k=g or t
ttatcatataagtctgatttttttttttaagcgtcttgaatggttttctggagagacagcattggtaagtggcacatgacggtatcccagtcataagagggttgcatgattcctttgagtgtttrattttgaaagcctagtctkgtctctcaagagcatctcggacccagaacattctccagtagtgcattcagttcaacacagcc

SEQ ID NO: 31920 - DNA, 409 bp, Homo sapiens
ctatttctcattgtctgtctggttttccatccccctcacatgtggtgaccagcacctggcccgccacggcagccaggaggcatttgttaagcgaataatcgagacagggaagaggagtggagttggctgctccagactctgcttagttttcctttctcaaagttctccctcctgtgtcctagccggggaattagctaaaatggaattttctttggtgatcaggtatccttctgatgaagagaagaaaggcctaaactcccaggcatggatgcattagaaagaggtagtcttagaaatgagcaggcgttggttatttatgcaggactggcatactttctgtgctgccaaggggtgatttttggaagtctcccctctaatgctggtgctgggcctttgggatggtctagcc

SEQ ID NO: 31921 - DNA, 272 bp, Homo sapiens
  misc_feature 124: s=g or c
aatgacagtgagctgaaagttagaatttccaagaactcgtgggttggtagaggagcatcaaggacacatattgggtggtatatgttacaggagattttgagctgggaggtttcagggagaagasagaaaaaatgacgaagaagctatgtatagtaaggcacactgaatttacttccaggcctatttgaacatggaatgtgggaagactttgaggaagcagtatattcaggggagagctgggtttcacttagaatgagaaagcaaggggacca

SEQ ID NO: 31922 - DNA, 425 bp, Homo sapiens
  misc_feature 402: r=a or g
ttaactaaatggtcatttctttttgcaacaaggctttcttaaacactctatctggaccctcctctgtgcttccaaatttgtactacctctaactgagcacatctcattgtctgttgagtaaatatcttaattggtcttccactaagctgtcagcttgttaatggtgaggacttttttatagtacattcaaaacctggaacaatgcctggaatatgccagtgaccaatgaacgtttgtggaatgaatttacctcgggcattgcagttccttagatgtacgtgacctccagggccctctcacattgtccccttgatccatgattctctgcagcagtgttgtccgtggcggcttgtttacctgctgtgccagacccagtttgtggtcatcactgtgtccatgagrataaacagacacagctcagagat

SEQ ID NO: 31923 - DNA, 262 bp, Homo sapiens
  misc_feature 159: d=a or g or t
  misc_feature 162: n=a, g, c or t
tccagatcttagaagaaatgatttcagtttttcctcattcagtatgatactagttgcatgtctgccttatatggcttttattatgttgaagtatgttccttctgtacccagtttcttgagggttcttctcatgaagggagttgaattttatcaaatgcdttntcagcatcaattgagatgatcatatggtttttgtcctcattctgttgatatgatgtatcacattgatttatttccatatgttaaactatccttgcacccc

SEQ ID NO: 31924 - DNA, 246 bp, Homo sapiens
  misc_feature 119: r=a or g
  misc_feature 125: r=a or g
  misc_feature 126: w=a or t
cacaaagcctgtttcgtggtctcttcacactgacgtgcatgaaatttgttgccatgacttggatcgggggacctccctttggagatcaatcccccatcctcctgctctttgctccgtgrgaaagrwtccacctatgacctcaggtcctcagactgaccagcccaagaaacatctcaccatttcaaatccgtacaagaaggcaggaatgtcaggcctctgagcccaagccaagccatcgcatcccct

SEQ ID NO: 31925 - DNA, 112 bp, Homo sapiens
caaggaagatcaggacctggacaaaatgtttggagcctggcttggagaactagacaaactcactcaggtgagtagtgcttgaaaaactggttgaggatttgaagtcaccatt

SEQ ID NO: 31926 - DNA, 403 bp, Homo sapiens
  misc_feature 127: m=a or c
  misc_feature 134: m=a or c
actcctctcaccggcccctggaaagggttccaagtcctttagtacccgacgctgtctgggaattccgggcgtttcggctccttggtcgcagaggcaggaggcacccgaccgcatgtctgtcatggamctcggcmaatacttgctccagctttcagtcggacctggatttctgttcagattgcggctcggtcctgcctctgcccggggctcaggatacggtcacctgtattcgctgtggcttcaacatcaacgttcgggactttgaggggaaggttgtgaagacttcggttgtgttccaccaactggggacagccatgcctatgtcggtggaggaagggcctgagtgccagggacctgtggttgacaggcgctgccctcgatgtggtcatgaaggaatggcata

SEQ ID NO: 31927 - DNA, 265 bp, Homo sapiens
  misc_feature 132: k=g or t
  misc_feature 133: y=c or t
  misc_feature 134: m=a or c
  misc_feature 137: k=g or t
  misc_feature 243: k=g or t
caaagataaaattctatcttccctttcttttatgagtctattaaaaattcagggcacctttttaaaagcccgtagagaagattaacctttaacatcatcatttaaatctaatgttaccacattttacagtgkymatkgacactatgtttagccttagatagttgcttttcctaaccatattgtgaaactactaaattttttttttttccaaatctaatagaggaactgctctcttttttttckggtttctctagtgtagcactat

SEQ ID NO: 31928 - DNA, 267 bp, Homo sapiens
atgtttgatccctcaacctaaaccatcaggcccctttccctggcctaaaataaggtcccactgaatctgcactcagagccaggcctcagatgacctctgctgattctctgagttgtttaatgtgggttccagttaatcccgaactgggactgcgacacccctctgtcacctcagccaggatgactcttcttccagatcatttagaacagcacttccaattgaaacataatacaagccatatttgtcatttttaattttctggcagcc

SEQ ID NO: 31929 - DNA, 189 bp, Homo sapiens
  misc_feature 140: s=g or c
cagacagcatacttagttacctgtcttaattggtctcctttaacttgtattattaccattttttcgtttttccaatattattaaatatttattattaagtaatattttccaataatattaaataatatttgttgggagasccccgtttgagattctgctcttactggaatgaatgcagtgtgcccccac

SEQ ID NO: 31930 - DNA, 175 bp, Homo sapiens
  misc_feature 154: n=a, g, c or t
atttgaggaagaggtatgtggatagacctctctgagtggttaaaaactgtgatgttgtatctcatgtgagtgctcaccaacaggtgacctcagcagagaaggattttaataatcaagtggatagcgtgacctgttctgtggatgccacttagcntctttccccagctaccccgaa

SEQ ID NO: 31931 - DNA, 341 bp, Homo sapiens
  misc_feature 136: k=g or t
aagctagtgtttcacatttccaaaatcagccttctggcagacttggaagtactcttgagaaaagaagactcgtgaccaaattctcccacagatttgtaataatgtacatattgaaaggactgaaggctctcagacktgggaaagaaacttacccattttaaaattcagcattgctcaacttacctgactgccggaccccttcacccatgattctatgcactgtattgttggaacatacattgtgaaaacactgccctgcctaggcataccccctttccagaattaactttccatttaattctatagtttttcactgatgtaactttctagactggacaccc

SEQ ID NO: 31932 - DNA, 331 bp, Homo sapiens
  misc_feature 122: r=a or g
  misc_feature 310: y=c or t
cgacaataaattccacatcatcggcgcagtgggcatcggcattgccgtggtcatgatatttggcatgatcttcagtatgatcttgtgctgtgctatccgcaggaaccgcgagatggtctagrgtcaggctacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgayatttgtagttgagcggagggt

SEQ ID NO: 31933 - DNA, 198 bp, Homo sapiens
  misc_feature 140: m=a or c
  misc_feature 141: m=a or c
gattaaaagtgtttattgtattagctgtttagagctgaaaagatatttacaaattccagggaagtaaaaggaaaaaaactgaaaaaggtacagctacttttggggatgtgagatcatgggtgtgtatccttatagatttmmcattatttatttactttccattattttcttctacattatcatatttagtagctaacc

SEQ ID NO: 31934 - DNA, 362 bp, Homo sapiens
  misc_feature 123: r=a or g
  misc_feature 139: k=g or t
  misc_feature 140: n=a, g, c or t
  misc_feature 162: r=a or g
  misc_feature 163: k=g or t
  misc_feature 356: h=a or c or t
  misc_feature 357: n=a, g, c or t
  misc_feature 358: n=a, g, c or t
catctggtcttctgtagtgaccagacgaagaactgtcttaatataattaaactagctttcatgatgaagtatacttggctactagatgatcttagatttctggccagcaattaatatcactgrtggtctaaagttattknaatgttattcattttatagacrkattgctcagcatagtgagtatgggcttgagagccaatctgcctgatcttggctccagaagttaattagttctgtgcacttgggcaagtttcttggcttttctgggcctcagtttacccatctctaaaatgaagataagagatgtacctacattgtaaagttgttataagaattaaatgagttgcatgaacathnnagat

SEQ ID NO: 31935 - DNA, 212 bp, Homo sapiens
caatgaatctgctgcctgaaataaaaccattaggactcactgggacagaactttcaagttccttcaactgtgaaaagtgtctttttggacaaactatttttccacctccaaaagaaattaacacatgggacattttaaagtctttagtataaagaaaatttgtattcaatgtgttaagcattaacatgtattttatttgtgtatccactccg

SEQ ID NO: 31936 - DNA, 420 bp, Homo sapiens
  misc_feature 122: s=g or c
  misc_feature 286: k=g or t
tgtttgtttgagacggagtcacccagagtcccagctctgtcacccgggctggagggcagtggcgagacctcggctcactccaagctccgcctcccgggttcacgccattctcctgcctcagscttccgaagtggctgggactgcaggcacccaccaccaagcccggctaatttttgtatttttggtagagatggggtttcatcgtgttggctagggtggtcttgatctcctgacctcgtgatccgcccacctcagcctcccaaggtgctgggattacaggcgtgakccaccgtgcctggcccctcctctgtgtttctacagctccttggcttccctctgtcacacgttattgagaacctagcttcccttggcccacttcccggctacacagctccttgagggcgggactatgattttttc

SEQ ID NO: 31937 - DNA, 473 bp, Homo sapiens
  misc_feature 122: r=a or g
  misc_feature 124: m=a or c
  misc_feature 132: k=g or t
  misc_feature 134: m=a or c
  misc_feature 400: m=a or c
  misc_feature 473: k=g or t
cccctaatgtttatgttgttcatagataccagtgagattctctagatatttgcattctaacatacatgcagactgaaaggctttattatagcttaatttcatttacttaaaagctttattgramcacagtakgmctaaatcactatgctaggaattacagataacaggttaataaaacatagtcccttcctaagggagctcacagtttagtgaatgaaaaagactagaaaacttcattataggagtacagacaagggagcaagtaattctgcaaagagtgcctatcaatatggacttggatagcgatatttgtgttgggtcttggagaatgattgagtttaccaacagggaagaagaggagatgcgtatttcagcccagggaatggccagatgaaagagmgaagataaaatgtatattatgtttttgcaaattctgtagctagatatagctagtgtacaaaatgtatgttttk

SEQ ID NO: 31938 - DNA, 344 bp, Homo sapiens
  misc_feature 124: r=a or g
ctctagcatctccaccgaggggtcagtgagcttccacctgcgtacctggatgatgggcacctcagtactgactaaggtaactcatgtttgatggctccaggggatatacaatttttatattaarggcaaaattaaattccttgcagtttccacccatttttcttaatgtgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggacct

SEQ ID NO: 31939 - DNA, 241 bp, Homo sapiens
cactctttaaagcccccaatatcttgtccctaccctattgagtttatgagcttccttcagatttcactccctgtctattatctagggatctttaggtcagttattttaatatttttgagaaatcagttctctcaacttcttgccttctacccctcttgtcccgccaatcttgctggattaattcactagctgttacctctgatggcttaatcccttcaacaaaaatagaataagtatgcta

SEQ ID NO: 31940 - DNA, 58 bp, Homo sapiens
  misc_feature 15: m=a or c
  misc_feature 36: r=a or g
taggaataaaatgamcatccctaagaatggccagaractagagacctcaaccagctgt

SEQ ID NO: 31941 - DNA, 205 bp, Homo sapiens
  misc_feature 145: m=a or c
aagatataccatggcatactgaactctagaacatttacttctttttcagttataaatcctgtcagctttttttaaaaaataatttttaaattacaaatgcaaatatagtactaacttgaggagaaaataacttctatttcaaggmaaacactattaaaaattttaagtgtttctttccatttgcaaataattccttcactcgggt

SEQ ID NO: 31942 - DNA, 227 bp, Homo sapiens
ttaaacgtcggctcactagaaagctcagtcaaaggccaactgtcgctgaactccttgccaggaagattctgaggtttaatgaatatgtagaggtaacagatgctcaagattatgaccggcgagccgacaaaccttggaccaaactgacccctgctgacaaggctgccataagaaaagaattaaatgaatttaaaagctccgagatggaggttcatgaagagagcaaa

SEQ ID NO: 31943 - DNA, 340 bp, Homo sapiens
  misc_feature 140: r=a or g
  misc_feature 150: w=a or t
  misc_feature 162: k=g or t
catgagccactgtgcctggcctgttcaacagtttccagttttgggctgttataaataaagctctaagaacatttgagttcagtttaatctttgggtgaacaaatgttttcatttatcttgggtaaatatctaggagtggratgtctgggwcatatggtagckgcatatttaactttttttctttttttgagatagggtcttgctccttcactcaggctggaatgcagttgtgtgatcatggcacactctagccttgacctcccaggctcaagcaatcctacctcggctgccttagtagctgggatcacaggtgcacaccaccatgcctggctattttttt

SEQ ID NO: 31944 - DNA, 347 bp, Homo sapiens
  misc_feature 158: r=a or g
aaaggcaaaggcactgccaggcaagaaaacgctgggtctccttccacaagtttggtaagtaagcaagataccaggaggatagaatggtaagtgagcctagaaatagactattatatacatagggtttattaaatacatagagaacactgaatgctagrctaagaaatttggactttattctggaagtcccttgcaataggggaccttgtctgttttattttctaatgcctcgcactttgtagaagctcagtgaatgaatatattctttattaatttatgccgtctgcttaataaacagaaatgttggaaggtgaaccagttgggagtcaccatctgatcaaccccaa

SEQ ID NO: 31945 - DNA, 120 bp, Homo sapiens
ttgttctttcattgttttgtagcagttttctatgatttcacctctttccccccaccacacaccgtttctttactcatcatgtcatttgattatagtccatcgggacagagaaatactacc

SEQ ID NO: 31946 - DNA, 338 bp, Homo sapiens
  misc_feature 140: s=g or c
  misc_feature 154: m=a or c
  misc_feature 155: b=c or g or t
  misc_feature 317: k=g or t
  misc_feature 336: n=a, g, c or t
catctgatcgataattatgtcacctgtacctgtcgccagcttgtcttgttatgacgttagttttactgctagaaatatctagtagatggctggaaatctgcaggcaaagtgcagagggagtgagcctgcgaggagagggsctgggcaaagtgambgccctgggccgcagagttcttatctaaaaaatgggaacagtagtgtcttcctaaaggcaccatggacttaaaatgaatggcacgtttcctgggacttatgtatatttggttgcttatggggacttacgtatatttggttgcttttggggacttatgtatatktggttgcttttggggtctnaa

SEQ ID NO: 31947 - DNA, 174 bp, Homo sapiens
  misc_feature 146: y=c or t
  misc_feature 147: n=a, g, c or t
  misc_feature 148: b=c or g or t
agccgcgtccctgggcccatgtcagggacggctctggctgaagcaggaggacggcgtttggagggtggggtgggcgcgtcctctcggcggcccgcgtggactgacagccaccactgcccccacgctgccctcgtgcccgcggttcynbgaagtcgaatgccaggcagaggcgac

SEQ ID NO: 31948 - DNA, 252 bp, Homo sapiens
  misc_feature 152: k=g or t
  misc_feature 158: k=g or t
  misc_feature 217: b=c or g or t
  misc_feature 234: k=g or t
caggaggtggaggttgcagtgagccaatatcgcaccactgtactccagcccggacaacagagctggactctgtctcaaaaaaaacaaaagaaaaaaggaaaaaaaagacagtatacaggcatactctgcaaaaggtggccttgttaatggtktgctckctaaaacatctttgtttttaaatacccaaacttcatacgatatacttatctctcagtabaaatttttttgtgtgtkgtttagaaattgggcctc

SEQ ID NO: 31949 - DNA, 114 bp, Homo sapiens
atattggccagaccggtctcaaactcctgacctcaggtggtccacccgcctcagcctcccaaagtgctgggattacaggcgttagcaccgtgaccggccgggtttttttttttt

SEQ ID NO: 31950 - DNA, 108 bp, Homo sapiens
  misc_feature 65: w=a or t
caaatatgcagtcttggtttttttccccctttctcaccattcacaccattctggattgtgttgtwtgtttatacttagattcttggagtcctttccattttagtatat

SEQ ID NO: 31951 - DNA, 100 bp, Homo sapiens
taaattttgattaccgaagaacaaggaaagtgagaaggcctaagtttcagaaatttttaaatgttaccatttaggttactgatatatgcttttttttttt

SEQ ID NO: 31952 - DNA, 155 bp, Homo sapiens
ctcagaattattatataaatatgtacattcttgtgaaagaagaaacaaaaagaccttggaatgaaaagctttaactacagccaagtttaccttttctatacatgtcatcctttctcttttagggggagcaaccaggggaaaatgaagatatcacc

SEQ ID NO: 31953 - DNA, 176 bp, Homo sapiens
  misc_feature 126: r=a or g
  misc_feature 129: r=a or g
  misc_feature 161: n=a, g, c or t
agtcggtcgacgctcaccggacaggaagcgtctcggagacagtctgcgaccggacgggtctaggtgagacagaagccaaacaggaggaggaagtggagggactgatcctttgaaatactccagccrtgrctaaaagagaagcagaggagctgatagaaatngagattgatggaatc

SEQ ID NO: 31954 - DNA, 325 bp, Homo sapiens
  misc_feature 129: r=a or g
  misc_feature 249: y=c or t
  misc_feature 255: w=a or t
  misc_feature 289: n=a, g, c or t
  misc_feature 290: w=a or t
  misc_feature 295: k=g or t
cttacatagtttttaattatatagctatatgaaagaggtggctaagacatttgctgcacacacttgaactaatgttgggtcagtagcttcgtgttactgccctgatcccagtgtaattcaggtggaaargtatttttatctcacagggatatgtagctatgtattttactaattgtgaaacactggaaattaatgatgcagacaacttggtgtggtctttgaacagctctctgcagtattttttttttycctgtwaccataaattgtatttaagtgcttgctttccacnwaagtkgtactaatagaaccggtaactcccagccac

SEQ ID NO: 31955 - DNA, 335 bp, Homo sapiens
atgaaactactaaacaaaaacattggggaagctctccagaacattgtagtgggcaaaaatttcttgagtaacactccagaagcacaggcagccaaagcaaaactggataaatgggaccacatccagtttaaaaaccttctgcacagcaaaagaaacaatcaacaaagtgaagagacaacccacagaatgtgagaaaatattcgcaaactagccatctgacaagggattaataaccagaatattacaagctctaacagctctataggaaaaacatctaataatccgatttaaaatgggtaaaagatctgaatagacctttctcaaaagaagacaca

SEQ ID NO: 31956 - DNA, 440 bp, Homo sapiens
  misc_feature 272: d=a or g or t
tgctggagaatgaacgtcattgcgatttatcttgcttcattctgaaccttatcaagaggatctgactgagagcccactgcagttagagctgagcacttttgaaaagcttgtccatcactctagtaaggaagaggctctggacagatgaataccttttcttcggcttgtgaggcttcccactatttattactgaactattatgttaatgaagatggacattttaggaatcaccaaacaatataatagcctcaagcaatataggccagacttgdtcctaagcacctgcctcagcagttgtctacattcagttgttttgcattaacgtctgccttctttcctttacggtccatgcctttaatgttgtccacattaagcactgtggatcacgacaggaaaaaggttggagcagtgcttttcactactttgtatcaatccaggca

SEQ ID NO: 31957 - DNA, 311 bp, Homo sapiens
  misc_feature 299: w=a or t
  misc_feature 300: m=a or c
  misc_feature 301: w=a or t
tgactatatattttttctttaaagaaaacatttgagtgtttaggaatctaatatttcttctttggatatttactttgctctttctccaaaaatatttggagaaaataaaataaataatgtttattatgttttggaaaattacattaaatgcattaagtacttcctgaatttcccagtgactaattgaacccagctatagtatttgcaaatgccagacatttctctctctatttgcagataaaaacaagaaacttgaaagtttacatccttagaaggagaataacacaccatagtcaacwmwagtagccctt

SEQ ID NO: 31958 - DNA, 274 bp, Homo sapiens
  misc_feature 117: r=a or g
  misc_feature 124: r=a or g
  misc_feature 138: r=a or g
cattatcacatatcatcagagattgaggtttgaaagaaaggaaatgagtagatgtaactaagaggtttgagaaaggaatttcagcagagttattgaaggagaagtcatgagaggagraggagarggagcagtgaatgragtcgtgaagaggtgttgtcttgaaatactgtatttttttcctccttttcttttctgaacattcttgtgctgacctttcctctagtccaacagaggcattcacaattgcctgtggagaattaggattgccgcaaca

SEQ ID NO: 31959 - DNA, 66 bp, Homo sapiens
caattttaggtctttcccgctttctcctatgcacatttagtgctataaatttccctctaaacacgc

SEQ ID NO: 31960 - DNA, 56 bp, Homo sapiens
agttcgtttgatattcagagactgattcaacttagtgttttttgcttttttttttt

SEQ ID NO: 31961 - DNA, 229 bp, Homo sapiens
  misc_feature 121: m=a or c
  misc_feature 128: m=a or c
  misc_feature 136: m=a or c
  misc_feature 137: w=a or t
gctaaccaaagaaaatggcttcagtaaattaggatgaaaaatgaaaatataaaataaagaagaaaatctcggggagtttaaaaaaaatgcctcaatttggcaatctacctcctctccccamccccaamctaaaaamwgaaaaaaaggttttctaatgaaaatctttaaaaatactgtcagtattttaaaattttcaacagtattataaaaacattgcatctccccacca

SEQ ID NO: 31962 - DNA, 163 bp, Homo sapiens
  misc_feature 125: r=a or g
attatcgagctagttgatgaccattttgaaggctctctccgcaggcctctcagttggaagtccctggctgccttgagcagagtttccgttaatgtctctaaggaacttatgctgtggctatttgrttaaaccctctactatgactgacaaggaaatggagtca

SEQ ID NO: 31963 - DNA, 72 bp, Homo sapiens
  misc_feature 29: k=g or t
ctaggttgctgtgaatgccattattttgktcctttttatggctgagtagaataaacatatatatatgtatgt

SEQ ID NO: 31964 - DNA, 106 bp, Homo sapiens
caccgcttttctttatctgatctttcaataccatttatacactgatgactcccaggtttatatctctagactggacctcacttttgaacttactcttatatcttgc

SEQ ID NO: 31965 - DNA, 432 bp, Homo sapiens
  misc_feature 70: m=a or c
  misc_feature 127: r=a or g
  misc_feature 397: r=a or g
  misc_feature 400: m=a or c
  misc_feature 401: r=a or g
  misc_feature 403: n=a, g, c or t
agaatcagactcttccagaaattctttccatcatccagttcttagcagagtttcttctgacataaagggmaggaaaacacagtattgatggaatccgctttagaagtttcggcctgtaggtgggcarcattgtaaggttttggaagtcgtgagctcccaggtctctgcttgcctttcccccaagcctcatccacccgtgccacatcaggggagctaacatcactatacgctcatgtgagcatcccccatgaagtggcgctgaaagatcacgatagcacagttccatgatgtgaaataccacaagtctgcaatttttcggtcttgagagtgtcgctgggcttagaggatggaaatctttcagtaattataccagtttgtattcgtctcacatttgggrccmrgntacaaatccgatccactctttctccctgt

SEQ ID NO: 31966 - DNA, 450 bp, Homo sapiens
  misc_feature 120: n=a, g, c or t
  misc_feature 298: r=a or g
  misc_feature 299: n=a, g, c or t
cttgtagttttctgcctgcctaatactggaggcctcaccttctgtccccatgtgaaaaagaaaaacctagacccaagctctgtggcctctatccaagactaatatccttcgtgtgctttnacttatttgttctatatttcggtttcttccttggttctgatggctgaagctgctgttttatttaaccttgatgatgtattttaaaaatatatttcttaaaacttttccagcacttttatatgtttgcattgggagggatttcttctgtattcaacttagtccttttcattcctggaarnttcccacaagcacctgaaacatacaaatgtgtcaatatattgttttgtaagggttgtccttctcagtattttaatttcaatttcttccaaaattttggctctaaaatagctttggaaaacaaagagaatatattgtagaataattctgagt

SEQ ID NO: 31967 - DNA, 481 bp, Homo sapiens
  misc_feature 300: d=a or g or t
  misc_feature 301: d=a or g or t
  misc_feature 422: r=a or g
tcagggttaaagagatcactagcttttagaaggaggtggatattttgacttgggaaaagaatttcagtgagatggtagtagtaggcatcagacagttaggggcaaaacacatgttggaagacaggaagaagtcctggagatttatcctggaaatctttgtcagagaagagactggggtattaaactgatggatgaggccaggcacggtggctcatgcctgtaatcccagcactttgagaggctgaggtgggtggatcacttgaggtcaggagttcaagaccagcctggccaacatggcaddaccctgtctctactaaaaatacaaaaattagccaggtatggtggcccatgcctgtagtcccagctactcgggagtctgaggcatgagaattgcttgaacctgggagagggaggttgcagcragttgcgattataccactgcactccagcctgggtgacagagcgagactctgtctacata

SEQ ID NO: 31968 - DNA, 474 bp, Homo sapiens
ctaatctcttgatctctgttttattctctcttcatgtaaattgtccctttccttgactttttccatagatcaaatccagcagggatcaagctttggctgaacattgtcttgctgcactaaccgaatgtgctgctagcggagatggaaatatcctggctcttgcagtggatgcatctcgggcaaggtgaagatatataagtttggaggtttccaaagactaaaagttgaccagtttagcttttcagagtatacttaaataaaaggttgatcctgtaaaccatgtgagcccaaaagaaaataatggcatccatcgtaaatttaattcttatcattttaaaatttctgtatttaaaacattcatgttttgagtgaactgtattaataattgtgtattttactgtggctgaggaattttaaaactattgaaatgaatccatttcactgattcgcaggttgaaatgtgttggactactc

SEQ ID NO: 31969 - DNA, 176 bp, Homo sapiens
tatactgtgcaaaaagcaatcgtgagacctggagtgaaactttaaaaatgttgctagaagggccgggcacggtggttcatgcctgtagtcccagaactttgggaggtggaggcgggcggatcatttgaagtcaggagttcgaaccagcccggccaacatggtgaaacctcatctgt

SEQ ID NO: 31970 - DNA, 350 bp, Homo sapiens
caagaattttggtgggcatcgaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagcct

SEQ ID NO: 31971 - DNA, 448 bp, Homo sapiens
  misc_feature 379: w=a or t
cttgagccagctgcctaacttctggaaactctggatctcctacgttaatggaagcctcttcagtgaggtgtgtatacggactcggctagaggtggagctgagtcactgtgcatttctggtctttaaaatgttagatttaagtgattttttaaaatgtagaggcccaacatctctagccatcgtcatagtttaaaatcagttaaagcattataaagccctctcacttagtagctgtgtgacctcgaacaagtcacttttcctcatgtacaaaaagaatagtctgggcacctgtctcaaaaggtggttgtagggattaaatgagataggcaattaaagaaaaaagaaagctcgaactcttttcagggactccgaattgagwgattgccagtcaggccaaattctgggtgatgtgcggtagactgtgaacaaatgaggaacaaggatagca

SEQ ID NO: 31972 - DNA, 232 bp, Homo sapiens
cttgcttgtaaacataagcatgtattattacctaggctttgaatttcaaaatacggtgtaaactactcatggtaatatagatcttgttagacaaacgttcatgtaaaaaatgatctgcaagcattactgtataaagaaaaataacctggattacttgaatagaatggtttacagtgctcagttaaagttgatacttcttctacattgcagtattagggtttttttttttttt

SEQ ID NO: 31973 - DNA, 255 bp, Homo sapiens
acccacgaaatgcttaaaaggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgacagaatcttgctccgctgccaaggctggagtgcactggttcaatctcggctcactgcaaactctgcctcccagac

SEQ ID NO: 31974 - DNA, 166 bp, Homo sapiens
tccataataaagctgtttaatttgttatcacctgcctggctctaaatccctctattatttcttaaactagttcaagtcatatggctttcttgttatagtgcttatcttcagctgcatattttagttatatcttccaataagtttgggaagagttgtcaccagcaac

SEQ ID NO: 31975 - DNA, 447 bp, Homo sapiens
cacacaattaatattaatggataactaattggagtaatgattattagctactgaatgctgataatagaagtcatatttaaatgcttacttagttacttaagttagtcaaggactctgaaaaaaataaggtttaaagttaacagtgtcatcagtcattcccagttatcttcttatttaagaacaagatggtaatgcagttgcctttgtttatttaaatagaaaaaattaaatcaggataaaatgacccaactacagtgatgtatttggacacactacttcttatctttcaatatagacttttatttctggattaccatagatggaaatagtattactggacatatgttggtaggtatttacttctgtgtttttctttttcccttaatttcgaatacttctagctacaaaaattgtcataaaactttgcaacacactatacctccccac

SEQ ID NO: 31976 - DNA, 213 bp, Homo sapiens
tgatccgcccgccttggcctcccaaagtgctgagattacaggcgtgagccactgtacatggccagtacagtctttattaattagacaaacatctggtccctgttggcataatgccttttaaaaatataagatagagcctttttctaagataaaattacttatgtcaagagcactctatacagttcccctttctgcacattctttccagcatct

SEQ ID NO: 31977 - DNA, 208 bp, Homo sapiens
  misc_feature 120: r=a or g
  misc_feature 122: k=g or t
cagccagcttgtggtcccattattctttatattgtttttcttagcacacgctagcaaagatagatgcctaggacttttcttggctattggagtttatagaaaaaaagttctttgttgaargktagtcctccaccagaataatacaccctttttccccttagtagaagtccaaatgttaatcttgctatcatatatgtatgaatgccca

SEQ ID NO: 31978 - DNA, 317 bp, Homo sapiens
acactcagaacaaagggaaggagagaattggctcttgagaaacagcgctaagaatggcagcagaatgctccgtcactatatgcagaaacaagacaacttgaagctaaatggaagcccttgcagagtcaacaggtccagattcacagtgcacgccctgagctacagcccctccaaaaggcatcttcccccagagcctcaatgccaagcaaggagccgtcaagagtctgccttggttgttttgttctttttacaaaccgtacagatatacaattgataactcaggatttctagtcaataaccagatagttaacaccatc

SEQ ID NO: 31979 - DNA, 376 bp, Homo sapiens
  misc_feature 126: w=a or t
  misc_feature 336: n=a, g, c or t
  misc_feature 337: n=a, g, c or t
  misc_feature 371: h=a or c or t
  misc_feature 372: s=g or c
cataaaaaggcatatatagaaataaatagaaaagctgctgagtctatggtaaaattttatacctgcttcccagtattgatggatggaaatcaactctcaataagtatggctcctgaaaacaatgawtataaaagatgaggaagctatatttataaccttggtaaaagaaaatgacccagaggcaaacatagatacaatctatgatcgatttgtacatcttgataatttaccggaagatggacttcagtgtgtactttgtgttggacttcagtttggaaaagtggatcaccatgtattcataagtaatagaaataaggtaacaagttccctcataanntagctattcattctgtaaagaatgtataataachstggg

SEQ ID NO: 31980 - DNA, 267 bp, Homo sapiens
  misc_feature 122: r=a or g
  misc_feature 135: k=g or t
  misc_feature 170: k=g or t
  misc_feature 177: k=g or t
  misc_feature 180: k=g or t
  misc_feature 189: k=g or t
  misc_feature 221: k=g or t
  misc_feature 231: k=g or t
  misc_feature 243: k=g or t
gatctttagaaaagatatttagtgatttaaggagaaaaatacttattcctcctatcattactcctaaataaagagtagatcaaaatttgcttagggcctgccctctccagaatagcactggracagaagtgctakatttcctggattccacacccatagcagaaattgtkaatcatkatkgatattgtktctcacaggttctggttatagtctcagaatckatttcatcakagtactggagtkacatactattaatactaacccaat

SEQ ID NO: 31981 - DNA, 472 bp, Homo sapiens
  misc_feature 120: s=g or c
  misc_feature 124: k=g or t
  misc_feature 369: n=a, g, c or t
tattgtttctaatccttatttatcctagtcttagagagtttatttggattacgttctttaaaaagtaatgtatgagcaacttcagaaaaactggctttagatagtttgtaggccaatagscatkgggaagcattttggtaaggaaatcattttataaagattatttttaaaaaaaaagcctgtctggttcctcagtaaaatttaagacttattcataaaaattcatcctataaaaattactctaaacaagggcttggatttttaaaaactttataattagcttatattaatggattcatagtttaccctttttagggttttttctatgtgtgcatttttcgagtttgcttatatacgtaacatgttgangttctaaatttatgtgctttttaaacccaccagtagacaaacgaggagtgtatattttctgatatgtaaattgaatttatagtacgcatttctaatgaaagca

SEQ ID NO: 31982 - DNA, 418 bp, Homo sapiens
  misc_feature 107: m=a or c
  misc_feature 127: r=a or g
  misc_feature 133: k=g or t
  misc_feature 144: h=a or c or t
  misc_feature 236: b=c or g or t
  misc_feature 305: n=a, g, c or t
  misc_feature 306: v=a or c or g
  misc_feature 307: k=g or t
  misc_feature 411: m=a or c
atttcaatctattcctatatgttagttattgaaaaacaatagacaatcacaaaaacaagttgacatttttgtgttccttaagcccagtcatgaagggccctcgtgamtgggcctcatggccaaacarcttgtkacaaaaagaghtagggtcccagactgcgccgaagcttcatgagaccgatcctcgtctgtggacagaggagtagctgactctgaagcccaggctgttgctatcbagtctggtggtgaatcctccacagtctggtggtgccttgacattattggttcaccaacagagcagactnvktcagccatcaataataattcaacgcatcaggatgaggcctacgcatgggccacagaggatatgtaatgacttaagataccaactccacattctgtggtaagagmtgaagat

SEQ ID NO: 31983 - DNA, 425 bp, Homo sapiens
  misc_feature 110: s=g or c
  misc_feature 301: n=a, g, c or t
caagactgcttctaacctcaaagagcccactaactatagccgtgccatgagattctctgttgcccacctaaaagcatactcctgtcccactctagcaccctggagtatgsacccggatcatcacccagcatctgtcacctgaccttgaagaagctgagaagcagcagcttccccatgggacctgtcctggagttcttttgttctggtaagtccagaactctccaccggccgccgtttattctccaccaccaagtagtgatgtgtggggaaaatgctttggattttaaggtatagcaactgnttcataaaaccattatgtatctgctttcttctttaatccattgcttggaacccttagctgcaattagaatcacctggggagcttttaaaacataaactgccctgtcccagtccaagaacgatga

SEQ ID NO: 31984 - DNA, 308 bp, Homo sapiens
  misc_feature 114: s=g or c
  misc_feature 122: s=g or c
  misc_feature 216: w=a or t
tttttaagaatagcattagtatttatgttgaagagtagtttttaattctttggccttctgatctcttcagctttgtttggagacagtctctttctgccacccaggctggagtgsaatggtgsaatctttggatcactgtaaccgctgcctccagggttcaaacgattctcctgcctcagcttcccaggtagctgggattacaggcgtctgccaccwcgcccagctaatttttgtatttttagtagagacggtttcaccacgtttgcccaagctggtcccgaactcctgacctcaggtaatccacctgc

SEQ ID NO: 31985 - DNA, 365 bp, Homo sapiens
  misc_feature 203: r=a or g
  misc_feature 248: r=a or g
aataaatacaaataaactgcacaaggattagaaaaggagacaagatccagaagggattctttaagaacgtttttatattaacaaccttgtaccaatgaaatctgttgtatacaaaaaggaagcaggaggccaggtgtgatggctcatgcttgtaatccgagcactttgggggctgagacaggtggatcacttgaggtcaggarttcgagaccagcctggccaacatagtgaaacctcgtctctactaraaatacaaaaattagctgggcttgatggcacatccctgtaatcccagctactagtgaggctgaggcaggagaatcgcttgaacccaggaggcggaggttgcagttagccaagattgt

SEQ ID NO: 31986 - DNA, 245 bp, Homo sapiens
gagagccgaggaaaactgagcgtgggcctcagaaagaagttaaggcacccgcgagccgggcaactgccctccttccgcgccggcggagcgattaaagtgaagaaacaatggccagcaatcacaaatcttcagcagctcgccctgtttcaagaggtggagttgggttaacaggaaggcctccttctgggatacgacccctatcaggaaatattcgagtggcaactgcaatgccacctgggacagct

SEQ ID NO: 31987 - DNA, 131 bp, Homo sapiens
cgtaataactttttgtggaatctaataatatcacagtatggacacaaaatagtttggatttttttaaattattaatttcaaccatgttccatcaaatttctctctctccacaactaatgataccttggccg

SEQ ID NO: 31988 - DNA, 211 bp, Homo sapiens
aaaatagaatacatataaaaattttgcaggaaaaaagtatgatagaaaaatgtgcctagtataagaatttctgtcaattcagtaagtaaaatctagcaatattagacaaaaataatggtattaacatttgtatcttctcttgacagttttaattgataaagaccagagtccaaaatggaaaccagctgatctaaaagaagttactgaggaa

SEQ ID NO: 31989 - DNA, 264 bp, Homo sapiens
cagtatgtatcttaactgacttaaaatgtgggatgatcagatacgtgcctcctaatgtaatccagtaagaagtataaaccaccacctgtggaatgttcttgctaaagaaattgaatctggatctatccaagcttctagatctactgaccagttcacaggaaatatgaggggtaaaggaatacgttaaaatgacacttgggcacttagataaattacctagtttctttaaataaattaataaagaagcacttaaaaagggaacga

SEQ ID NO: 31990 - DNA, 445 bp, Homo sapiens
ttgtcttggctatacgggatcttttttggtcccatatgaaatttaagtagcttttcctaattctgtgaaggaagtcaatggtagcttgatgggaatagcattgaatctataaattactttgggccgtatggcatttgggcaatattgattcttcctattcatgagcatggaatgtttttccatttgttcatgtcctctcttattttgttgagcagtggtttgtagttctccttgaaggggttcttcacatcccttgtaagttgtattcccaggtattttattctctttgtagcaattttgaatgggagttcactcatgatttggctctctttttgtctattattggtgtataggaatgcttgtgatttttgcacattgactttatatcctgggactttgctgaagttgcttatcagcttaaggagtttttgggctgagacgacgg

SEQ ID NO: 31991 - DNA, 210 bp, Homo sapiens
  misc_feature 124: k=g or t
  misc_feature 132: r=a or g
  misc_feature 134: m=a or c
tccttctattatataaagccaccaagatttaatttcttctataagagcaaaatttatataaagcaaatttggtcaagtaaaaatgcttattgaactcattggtagaaactatttcattgttggktatgtggramcaggataataaggtgcaataactctctgaattaaagtgaaactttaattggaaatggaagaatatctggcctgcat

SEQ ID NO: 31992 - DNA, 124 bp, Homo sapiens
gtactggggcggttcagtcgcctcagccgcggtgtgagggagcgggagtcttccttagcttctccgccatgggtgtcgcttcgtagccgggctgctccgggaaaggcctcgtacagcacgcaca

SEQ ID NO: 31993 - DNA, 346 bp, Homo sapiens
  misc_feature 139: m=a or c
  misc_feature 196: n=a, g, c or t
tatattgttcatagttggaggtattgatgcatgtgttggtttgccaacatatctctatgatattgatctctatttgcttgacggctgcccttcttaagatcatgaattacaatatattcaaatttgttttttctgaaamcaaggaagaacagatgaggcagtggagtgcactgaaggtagtgtaagtctttggttngaaaccaaatctcctgcatgctagttactcttgggattggtggagtgcttttagcctactgagtgcagtgatggaaaaaatactagctgtaagaaatgattttgattgaagaatattgtattttaatctttgaagttttataaatggaca

SEQ ID NO: 31994 - DNA, 97 bp, Homo sapiens
  misc_feature 5: r=a or g
  misc_feature 6: r=a or g
gaggrracaaatgaccgggagactcttgaattgttcttcaagtatatgtgtgtctcagtggcaaagaatggtgacccactggtatctatttccatct

SEQ ID NO: 31995 - DNA, 447 bp, Homo sapiens
gttatgtaggtaaactcatgccgtgggggttcattgtacagattatgtcatcacccaggtactaagcctagtacgcaatagttattttttccgttcctctccttcctcccaccctttaccttcaagtaggccccagggtctgttgttcccctctttgtgtccatgtgttctctttatttagctccaacttataagtgagaacatgcagtatttgttttctatttctgtgttagtttgctaaggatgatggcctccagctccattcatgttcctgcaaaggacatggtttcattctttttttttatcgctgtttagtattttgtagtgtatatgtaccatattttctttatccagtctagcattgatggacatttaggtagattccatgtctttgctactgggactagtgcaatgaacatacatgtgcatatgtccttacagtacaat

SEQ ID NO: 31996 - DNA, 160 bp, Homo sapiens
taaatttttagggtctaaaattaatagggggctgggtgcagtggcacatgtctgtaatcccagtgctttgggaggctgacgcgagaggatctctagagcccaggaattcaagtttaacatgagcagcaacattagcaagaccccgtttaaaaaaaaaaaa

SEQ ID NO: 31997 - DNA, 147 bp, Homo sapiens
taaatttgccttttgcgagaatgacatatgaatgaatcatacagcacatagtctgagtatggcttctttttacttagcataatgagattcatccatattttttcttgtattggaagttcctttttatttctgagtagtagcccacat

SEQ ID NO: 31998 - DNA, 215 bp, Homo sapiens
  misc_feature 151: k=g or t
  misc_feature 157: b=c or g or t
gtttttatctttctaggaatgtgtccattttatctgagttgtttaatttgttggcatatagttgccatagtttatccttttcatttttgtaaggttagtaataatgtcctctctttcatttctgattctagtaatgtgagtcttctctctktttttbctaggccacactagctggatattagtcagttttgttgactttccaaagatgagcgtat

SEQ ID NO: 31999 - DNA, 376 bp, Homo sapiens
  misc_feature 118: r=a or g
  misc_feature 123: w=a or t
  misc_feature 132: b=c or g or t
  misc_feature 173: r=a or g
  misc_feature 197: k=g or t
  misc_feature 300: n=a, g, c or t
  misc_feature 301: m=a or c
  misc_feature 305: w=a or t
  misc_feature 314: w=a or t
  misc_feature 342: r=a or g
  misc_feature 356: r=a or g
ctaacatatcctgcaagtatactaactcacaaatagtagatagtacaaccagaaggactttggaggctgaatccaactaaaatctagtctaaaataatccacaaaatagtaagaggtrtacawttttttttbcatttaatattaagtctttttgtggctgaacatccccttgrtatttattttggcttaagcagackgttttgtgtgtgtgtgtaacctctgtttttatattctgaggtctctgtgtatagaaacttaaggagtcttcccattatatttgtgtagcagccccttctctanmgtcwacctgtctwctgatctttcttaatagaaagatttcaragttaaaatcaggrcttatgcagccatcttatct

SEQ ID NO: 32000 - DNA, 174 bp, Homo sapiens
  misc_feature 124: y=c or t
taaaaattaggggactttttataaaatctgaaaaaacacaaaaaagattacagacgcattaacagttacaaaaagcttatggtgttttaagatactttcaaccagttttgtttggaaagttttyccccccttcaaatagtcattattgtcttttcttttctttttttttttttt

SEQ ID NO: 32001 - DNA, 144 bp, Homo sapiens
  misc_feature 123: r=a or g
  misc_feature 126: m=a or c
acacatcttttgagccccaatttggccatgagttgcccttagatttttttagttatgtgagccaatacatttcctaaaacaggtaaaattatgtttttagacactgataaccaaaacaggtcraamctaatgcttacggcaaac

SEQ ID NO: 32002 - DNA, 245 bp, Homo sapiens
  misc_feature 131: y=c or t
  misc_feature 133: k=g or t
gtatccctctgtgcatcttgcctacgattattgtggtgtttgcctaatgaagttcattacttgtatatttattagttgatcattacgttagaaagaattttcttcttctccatggaatcattaatttcctyckgtgaaataaagtctaataccatattttttttgttacttaaattgtttcagctttagccattggagcttttcaagtgggctcctgtatttttttttgacatgctccaccctct

SEQ ID NO: 32003 - DNA, 148 bp, Homo sapiens
  misc_feature 27: n=a, g, c or t
  misc_feature 122: k=g or t
aatatctttttattaacttgttcagtnatgtatcaagagtggcaaattacaatctcacattctccccaaagtggaaaagaatccaaatgtccaccaactcctacacggataaataaagtgtkgtgtgcagtctagccatacgagggac

SEQ ID NO: 32004 - DNA, 275 bp, Homo sapiens
  misc_feature 110: r=a or g
  misc_feature 127: k=g or t
  misc_feature 129: y=c or t
tatatgaacaagcctcacagtgctaatgagtaccataatgttcagtctatggacaatatgtgttggcctgcccccagccagatccctcctgtatccacaccagtaactgractttctcgaattttgktycccttgttggaatgccacaacctgatttctcctttcttaggatgccacaggtatagtatactactttctatttatataaattatttaacattaagcttaaataaattggttgaaaatgtttagctagaaaaaataaaatggggcgt

SEQ ID NO: 32005 - DNA, 186 bp, Homo sapiens
tgaagataaagtaaaattgtcttttcccttgtcccacatttttgggattaaagccagaattgaataggaaatacagtactatttctgaagttgatagccgatctttaagaagaccctgtctttaaaatgaaaactagcaggcaaacacctaaataatcgaaaattaccaagaacaacaacgaaacg

SEQ ID NO: 32006 - DNA, 262 bp, Homo sapiens
  misc_feature 105: m=a or c
  misc_feature 108: r=a or g
  misc_feature 112: r=a or g
  misc_feature 129: m=a or c
  misc_feature 130: s=g or c
  misc_feature 150: r=a or g
  misc_feature 165: b=c or g or t
  misc_feature 169: h=a or c or t
  misc_feature 171: k=g or t
  misc_feature 241: s=g or c
ttctagggctctgagccaggccgagggacagactgctgggaagtccccaaaagggcagcagcactgaggggcaggattccagggtcctggaggcggaagctcggmcgrctgrctcccagttcgagagamsggggcgggggcagcccaccratgctggaacccgabggghgkgcgaggaacgctggactgggagcaggacccttctcgcctcggacaagactccttgtctggggacccagcscgacttcattgtagctgggtc

SEQ ID NO: 32007 - DNA, 450 bp, Homo sapiens
  misc_feature 147: r=a or g
  misc_feature 153: y=c or t
  misc_feature 305: k=g or t
  misc_feature 306: k=g or t
  misc_feature 404: s=g or c
atactatttatttctaatattcaaataaatctagcaatcatttcattaagtctaataaaaattaatgaccctccttgcttgcagactttgaggaaataaaaaatgttttacagtggccaatgtaagcaggtgaaataaatgatggaraagaayagccagtaaggccacagcatggcactcattgaaggttgcttttctgtcagtcaagactgaagattaaaggagatgagaaactgagactcagaaatggactgtgacttgctctcacagagctcgtgatggggctggatgtgtctatatttaakkaatatcagttataaaaacttctgggtatttgaacttcctaatttgcttggattttgaataaaaggttttttgtataatcgttatcaactgtgaaaggsataaaataatgttaatgcttctgttttcctttacgataaaccaata

SEQ ID NO: 32008 - DNA, 370 bp, Homo sapiens
agtccggtgcaggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcattgagagtgctgaagagatacgagaatatgttactgatctcctccagggaaatgaaggcaaaaaaggtcaattcatagaagaacttataaccaaatggcaaaagaatgatcaggagtttatatcggatcctttgcagcagtgcttcaaaaaagatgaaattttagatgggcagaaatcaggcgaccatctaaagcggggtac

SEQ ID NO: 32009 - DNA, 176 bp, Homo sapiens
agcatatttgatcactttgattctctgttcttttctctccgcggtgtgtgtgtgcgtgcgcgcgtgtgtgttttcttcttctcctcctcctctccccgagttgcctcctttctccgggtgccgtactgcctttttttcccctctttcattctttctctccgtcttttctcccgccc

SEQ ID NO: 32010 - DNA, 371 bp, Homo sapiens
  misc_feature 24: w=a or t
  misc_feature 275: m=a or c
  misc_feature 276: n=a, g, c or t
  misc_feature 277: r=a or g
  misc_feature 339: y=c or t
  misc_feature 340: w=a or t
agtattgcagacatgggccaaggwgccagaggccatgcagtggctcagggtccgtgagtcgcctggggaggccacaggacacagggtcaccatggtgacagccgccctgggtcccgtctggggcaagcgctcctgctctttctcctgatgtgtgagatccctatggtgagctcacctttgacagagctgtggccagcggctgccaacggtgctgtgactctgaggaccccctggatcctgcccatgtatcctcagcctcttcctccggccgcccmnrcgccctgcctgagatcagaccctacattaatatcaccatcctgaagggtgacaaaggggacywggcccaatgggcctgccagggtacatgggca

SEQ ID NO: 32011 - DNA, 273 bp, Homo sapiens
  misc_feature 127: s=g or c
  misc_feature 167: k=g or t
gtacttagggcaaagtagtgtcaaacaactttctctcaaatgattttttgaaaatcatatatagaacattgatgttcatagcggcagcattcacaatagccaaaaggtagaggctacctaagtgtcsattgattgatgaatggataagcaaaatgtggtacacacakgcaatggaatattattcagccttagaaagaaaggacattctgacacatgctacagtgtaaataaaccttgaagacattatgctaaatgaaagtcacaaaaggacaa

SEQ ID NO: 32012 - DNA, 238 bp, Homo sapiens
  misc_feature 135: w=a or t
actgttttgatgtgtattgtccacattcatgatgaaagaaatgcaaagttgcagttcaaaaatactgaaaataaagatgcaagtattggccatccaatttcatggcccccttgctctaaaatcccagatcaagawctgtattctagaaccccaagttaagaccacctgatctaaaactgagaatcttgttttcacttaatcaggctggcatttttttccgcgtaatcacccacccaga

SEQ ID NO: 32013 - DNA, 99 bp, Homo sapiens
  misc_feature 50: r=a or g
  misc_feature 61: w=a or t
  misc_feature 78: r=a or g
tctatgcaaacttgcctcctgctgttatctgtgaagctcaggaaatccaracatttgtgtwtcaacaagggacagtaractgtgtgtttacagccaaaa

SEQ ID NO: 32014 - DNA, 414 bp, Homo sapiens
  misc_feature 256: n=a, g, c or t
  misc_feature 348: r=a or g
  misc_feature 377: r=a or g
caaactaagtatggaacttcatataccaaagggactttttcccctaataacaactgcctaactaccatatgctatattaatactgggcagttaaaaatataaaacgaaagcaaaactataatatcctataagagtatacttatgacttccagaaaagatgaaattattcaacaaaatacaaaagtgcaaactgcagaggtaaagtttaaaatgcattaagatgactatcagaaattctgatttctaaccatcaaantcaatgaaaaaaaaacaaaagaactacacactgagagatgatattttgtaatacacataagcagcaaaggattaatcaatatccaaaaatarataaaaagaatcttataatttgcaagagraagaataactcacttgaaataatagggaaaaatctta

SEQ ID NO: 32015 - DNA, 393 bp, Homo sapiens
atgaatttatctttcctgacacattttcattcattggctttttaatttcttattttattaacaaaatatatcagatatattaccaaaacacatggagttccatacataatatggaatttgatgtcttttcaagttgcacaagaatttgagcatatataattttaccaaagcataatggaccttagattatagaatacagcattgttaggtctgcagtgggcagtttctttttgttttgctttgtcaaaaatgggaaattgttaactgtgatgaaatgtgagaattacatagattatgttattttttagttgttttccaaatgcagagtttaaggactttctaacatggctagtattacttccaaaaagtataacaagcagcagtcacacatga

SEQ ID NO: 32016 - DNA, 475 bp, Homo sapiens
cataattctcacttccttatttgtcaactttcctaacagattagacccccccaccaccaccatttcagatttattttttctttatgggtaagtgtgtttgttgaatttgcatcatgtaaatgcacatacacatgtaacttgtgtcaacagcagctgtttccatcttcaggagggaactgaattttccctgtccaggactgtgaaggaagggtttctgacatgtcgtggagggaatttcccagtggcacctccttcagtaggaggattgccatgtgtgtgagtgtgcaggggtgtgtgtagcaggggtggcatgtagcgtctcagctgtcctgtgttgcaagggtcacatcaccgagtccccaactcaagtttattgcttaataaaattaatgatgatagataacagtcatgactaattttaactgcagtcaccaagtgtcaggcagcaatcgaagttcttcaaatggatcaagat

SEQ ID NO: 32017 - DNA, 367 bp, Homo sapiens
  misc_feature 131: r=a or g
  misc_feature 160: n=a, g, c or t
  misc_feature 342: n=a, g, c or t
aagtgccaatccttttctgcttgagcagaagagcagaccaaagagctcattgactcaaggagcatcacggcaactgagctgcacctggaagagaagaatccagggtgtgatccacagccaaggcctggaargcaatggggcccatacttggcctctccanggtgagttgtgacccaagtgctgggctttagcccatgagtggtccctcttgccatttccagtttcctcccaaagagaggccagtgttggtgatttcatttcttataatctccttaggagcacaggttttggtttgtgccttttttggatcaggttccctgcattgcagctgctataattaanactattaacaacaacacagacccac

SEQ ID NO: 32018 - DNA, 205 bp, Homo sapiens
  misc_feature 123: r=a or g
  misc_feature 147: k=g or t
ttgttgttttgttttgattttaatttttatccaagcaatgcaagcatagagtttaaaaattcaagtagaactaaaaatattatagacaataacaaaaaaacatttcttggctccttcttcagrtgcaattccctggtaacattttakgccattcaggagttccagaccagcctgggaaacatagcaagaccctgtctcaaacaac

SEQ ID NO: 32019 - DNA, 440 bp, Homo sapiens
  misc_feature 123: r=a or g
  misc_feature 125: s=g or c
  misc_feature 134: m=a or c
  misc_feature 137: b=c or g or t
  misc_feature 139: n=a, g, c or t
  misc_feature 310: k=g or t
cttaaatgcctgcatggtgcctttttaggataaggtataaccatacatttttggtggaagtgtttctgggttagggaagttaaagtctgtttatccgtaagtggggaggagggtcagctaagrgsagttgggamggbcnagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttacktctgcttggtaacttagattaaactgagcattgtttttctgtcacaaatgttttccttatgacactggtttcgacatgtaaaatgtgtttgaaaacctgctttgtagatgcagagagaagctataggaaa

SEQ ID NO: 32020 - DNA, 377 bp, Homo sapiens
  misc_feature 130: m=a or c
  misc_feature 131: s=g or c
  misc_feature 344: h=a or c or t
  misc_feature 345: k=g or t
cacgaaacattcttgaccaagaaaaaagataaggtcattgagataggaagacagaggaaaagcctcttgctgttgtttcttcccaagaaaggagaagccctgccagggagaagtcagtagtattgctgamstcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagthkaaaacattaaaagatgactgatactaatggga

SEQ ID NO: 32021 - DNA, 443 bp, Homo sapiens
  misc_feature 84: b=c or g or t
  misc_feature 190: n=a, g, c or t
  misc_feature 191: d=a or g or t
agaaattattcattgtcattgtcattattcttaattagaatattaattaaaaaataatgatcttactgaaagcatgttagagcbataattttactcattgaattccattttgctcaacctaaaacactgaaatgtttacctacaaaatatggcaatttataagctaattttcttctacctaatacatatndttaggtagcatttttacaaattgataggtattttaaagtcaccaattaaaaggcaaaacttgtcagattggataaaacaagacccaactatgatggccataaggcatgatggcattgcactttaaatataaatacacaaataagttaaaaggaaaatgatagaaaaagatgtatcatgctaacactagccaaaagaaagctggtgtagctatattaaatattgagcaaaataggtgtccagcaaagttacta

SEQ ID NO: 32022 - DNA, 59 bp, Homo sapiens
  misc_feature 7: y=c or t
  misc_feature 9: s=g or c
  misc_feature 10: r=a or g
  misc_feature 21: s=g or c
  misc_feature 31: r=a or g
  misc_feature 48: r=a or g
gggacgygsraaaatgactasgcgtcactcrtgatgtcgcgcatccgrtaggccctttt

SEQ ID NO: 32023 - DNA, 117 bp, Homo sapiens
  misc_feature 53: s=g or c
ctccccgcccattatggtagcacaatgtagatagaattatcctgtaagcgtasagcagattctactacatacccctggagtgtccacctcaggcctacatcaacctcatctcacctt

SEQ ID NO: 32024 - DNA, 140 bp, Homo sapiens
  misc_feature 131: s=g or c
cctaacattctccaagatagccatgagatttttttgttttttgtttgtttgtttgtttgtttgtttgagatggagtcttgcactgttgcccaggcaggagtgcagtggcgcgatctcggctcactgcaagstctgcctcc

SEQ ID NO: 32025 - DNA, 285 bp, Homo sapiens
cctttaaatatacctataacttgaatatttacttttaattaagctgagcactctttaagaaaatccttttaaatcccttgttacttgactttagccacaccaagcagttaagattttcggctttttgaactttacagaaagtacccttataggtgaaaccaacgagccttaattaggttatgatttaattacgagtgtacaaggtatttttaaaggagtgatagacagcttttgaaactgtcattgcaaaactgtcactgagacagtcaaagagatcccacccgt

SEQ ID NO: 32026 - DNA, 427 bp, Homo sapiens
  misc_feature 116: s=g or c
  misc_feature 120: m=a or c
  misc_feature 125: s=g or c
  misc_feature 129: w=a or t
  misc_feature 130: k=g or t
  misc_feature 142: m=a or c
  misc_feature 156: h=a or c or t
  misc_feature 332: w=a or t
  misc_feature 334: h=a or c or t
  misc_feature 356: s=g or c
atcggaggcccctcccgggtgctttctggggcctcactgaggtcctggtcccctaagtcctcccccgcagcccctccgcgtattaacccaccggtctcgctgggctcagagattgsttamttagsacawkggattgcctgtmacgtctaatgtgghtgctgcctcgtgtcacatctgaaactcatctgtacctcacttagaaagtcgacagaaacctaatgggaccattgaagaattccaaacaggtatttgcataggaatcagaggagttaatcttgtctcttctcacaggtttgaatcttcagacaaacttctgggaggactcggtcccwghctcgcagcagatgttccctgtsactcagtaggcatatggctacccattctccccagaaatctcaccagtgtgctcactgtgagagacgttcaa

SEQ ID NO: 32027 - DNA, 217 bp, Homo sapiens
  misc_feature 37: s=g or c
  misc_feature 122: r=a or g
  misc_feature 129: y=c or t
  misc_feature 205: r=a or g
gcggagggccgagccgggtgcgcacggggaggcggasaggaccattctggctgctgtctggacaagaagtcgtagggggtgagggtggaagctgggaaacccacaggaggcaaccacactartttagaycttctggtgaccccacttctcgctgctcatgccgctgggactggggcggcggaaaaaggcgccccctctagtggaraatgaggagaca

SEQ ID NO: 32028 - DNA, 250 bp, Homo sapiens
  misc_feature 118: r=a or g
  misc_feature 122: w=a or t
aactttaaacttcttggtccatgatgccattaactcatcccagccctgccttattaagatgaaagctttgacctaaaatatatatgtttcagaaaacctagaacaaaaagtaaaatgrtaawttaattttcaaaccaaaccaacaaacagaactgtccttaaagcttctccttttagaagagtttcagttaataaataaatgtagaaggaattagagaaatacaaagttgccattagaacccaggaggtt

SEQ ID NO: 32029 - DNA, 185 bp, Homo sapiens
  misc_feature 128: r=a or g
  misc_feature 129: k=g or t
  misc_feature 138: k=g or t
tagcttttatttcacatttaatttaaagtgacttttagcactaaaatgcctagaagattttactccagacctataaggaaatgtttagtttttatgaaaaatgacaagtcgatggttaaacttccccrkgtctttggkgctttggccctaatagcactggacaacaccacgaccacatggaagct

SEQ ID NO: 32030 - DNA, 293 bp, Homo sapiens
  misc_feature 161: s=g or c
  misc_feature 168: w=a or t
  misc_feature 177: y=c or t
  misc_feature 179: k=g or t
  misc_feature 182: k=g or t
ctctctgagcgtctgttcctctatttataaaataatagtgctaagagttgccacagacagggcctggctagatgctgagtgactcctaacaccccagtcaccattgggttcctcttggtacacattgggctcatcctgtgtgcgccagtgtgtactagggsctggggwccgagcccyckgakgctgccctgcacccatttccccgtcctgtgcaccagcccgtgtggcagctcggctcagaaccctgcagtggccaccctgccctcagcacagactcagctcctcagacccgc

SEQ ID NO: 32031 - DNA, 121 bp, Homo sapiens
ttttctttcttttgttaggaacagcgtttacattttctaaagcaacaggagcgccgtcagcagcagtctatttctgaaaatgaaaagcttcagaaattgaaagaacgagttgaagcccaat

SEQ ID NO: 32032 - DNA, 355 bp, Homo sapiens
  misc_feature 308: w=a or t
  misc_feature 309: k=g or t
tagaagtagcaggatcgccttaataataataatagttttgtagcatgaagcctgagcattgtccaaagtttggaaatgtgaacgctgatagtcacatctgtccatctttccacatttctaggatgctgacagacagcaccaagaagtaattgcaatttatcggacacaccttcttagtgctgcacaggtaaagaactacttctcctttggaaagaatattgctttagagataataatttttattttcaaataaatttatgtgaaagtaattgatgtttaaagtagctgcaccccctatgcttatttawkaaataattatgtttcttttaatcattgtttgtggatctcccaggcc

SEQ ID NO: 32033 - DNA, 341 bp, Homo sapiens
  misc_feature 124: y=c or t
  misc_feature 129: r=a or g
actttacaaacctgattcatttagttcttcatagccaccatcttgataatgaataaagaaaaaacaaatgatgtattttgtcactctattcatttttatctataaagatttaaaatacctttcyttttragttaggttggttttatggttggaagaaggaaaggaggtagacctttgaatgccttgattgctgcccatttctctaggcagtgaagaaaggcagctaaagtgctgtctctgattatcaaatgccatatatgtgagtatacctgtgttgtttgtcatgctgttgtgaatactcacttgcttttttatccactcatcttttttatccacgagct

SEQ ID NO: 32034 - DNA, 92 bp, Homo sapiens
  misc_feature 2: y=c or t
  misc_feature 13: w=a or t
  misc_feature 21: r=a or g
ayccggcctttgwctctcgtrcccgcacgtgcgtgtctcggtcagtagccctgcgcttctccttcactctcggcggttcaggaggctctgcc

SEQ ID NO: 32035 - DNA, 297 bp, Homo sapiens
ccactaaaaaactcttagaactaataggcaagttcagcaaggttgtaggatacaaggtcaatacacaagaataatggtatttctataatctagcaatgaataattcagaaaatggaattaagaaaacagttttatttacactagtataaaaaagaataatttaggaataaatttaacctctacagacctgtgccacttccagtatatcgcaagatcttcaacccagttgcttaagggaagaacttaagcctcatattgctttttctttgtcttttaactttgacatgtatggcctta

SEQ ID NO: 32036 - DNA, 473 bp, Homo sapiens
  misc_feature 193: k=g or t
  misc_feature 283: v=a or c or g
  misc_feature 284: r=a or g
tgtagatgtggcgcgctgcagtcacgcctcccgctgccagcccggcaccgggatcttaatcagtcactatgaaaactcattagctccacagcaatgagtcctccactgctgaagcttggcgctgtgcttagtaccatggcaatgatctcaaactggatgtcccaaactctcccatccttggtgggactgaackccacgaggctgtcgactccggataccttagttacttatggaaccccagagcctccattgctgagatcctcttccctacctgcatgaagtvrcctggcaggaaggatgtaaaagagatttggagttataaagaaagcaagagatagacatcaataaacaattacaaaacataaacttatattatctaatatttactgagccaatttttttttcaatgtccaagtaccagatttcaacaacatcattgttgaattaactcttgcaggataatgaatgtaaac

SEQ ID NO: 32037 - DNA, 409 bp, Homo sapiens
  misc_feature 259: d=a or g or t
  misc_feature 260: w=a or t
aactgctcgctgtggtggggaagggggcagaggtaggtgagcactctcccagcctggagcagccggaccagcccagaaggcagcggcggcccaggccagcattcccgcacaaatctccttggaccggctgttgggggaaaaaaagtgttagccgtctctcccggatctgcaagggggaaaaaatttggaaccataaagttgaaaacttttttctctcagtttggaagaagcccttcgtcatgaatgggatctgcagagdwcgggcgagaggaggcgagaggcgcaaaggtaacaaagcccgggcccgggctggcgtgttttgatcgttttatgagctcttttcacaactgaaagaagaaacactctctcgcctcttcctttttcttttttaactttcttggccgggtgt

SEQ ID NO: 32038 - DNA, 282 bp, Homo sapiens
  misc_feature 281: y=c or t
  misc_feature 282: k=g or t
agcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaagtttgggcgacagatcagaaaaatgaagacctgcacatgtggagcyk

SEQ ID NO: 32039 - DNA, 477 bp, Homo sapiens
  misc_feature 326: w=a or t
  misc_feature 327: m=a or c
  misc_feature 328: k=g or t
  misc_feature 329: k=g or t
tggatgcatatttgtaattgttttgagttcatgtctacatttgcaaaatacaggcataccacatagctttaagaaaagtgaaaattagagctatatctataagaaatacttgttataatcatatccactatgctttactgataggtattattgtagcagtactaataagttgaattacgaaaagtcattttatgtaataaatgcagggaccattataatatttaacacactagttttctcaagggtagacctggatggaggtaactcagtttgctcctggacaaactcaaaggtacaaagcaaaaacaaaacaaaaaccccagcawmkktggaaagggatttagagatctgctgccaaaggaagactttgtaaaaggcagttggaggttttacatgtattagtgccaaattattgggttgaacagtatggaagtttgcattttgtaggtcagagctattgaatatcagtattttata

SEQ ID NO: 32040 - DNA, 214 bp, Homo sapiens
cattctttcttcaaagagaaaataattttcttccctcccacaaatctgccattctttttctctttacccccatctccccaaccaaaaaaataaaaacaattatacatgggcacgtggatgcacacagcacacaaacacacagttgtaataaactggtcactatttatcttccattgagttgctgaccttagaagatgttatcctcccatccccc

SEQ ID NO: 32041 - DNA, 402 bp, Homo sapiens
  misc_feature 312: w=a or t
  misc_feature 375: k=g or t
  misc_feature 376: r=a or g
  misc_feature 378: b=c or g or t
  misc_feature 379: h=a or c or t
acagacctctttgaaaatctaatgagagccatagacttcaccctaaaaaaatatatatgcataaaaagtttaaatatagtttggagagtaacgcaccttcccctaaagcaattcctaaacctcatttaaaggatctatattctatagttcagttctgcatttttaatgtcttctatattgtctcatgctagaatagtcattatatcttcatatgtaatatttaaagtgtgaattatcatctaacacttcctgtcttctgtcccccaaatctatacttctcccatgttctttattttcattaatggctttacwctccttctaatgaccctagccatgaaacccaggcatcctatttttgacctcttgctattgctkrabhtatctaatcaattgccagttacg

SEQ ID NO: 32042 - DNA, 279 bp, Homo sapiens
  misc_feature 131: w=a or t
  misc_feature 139: w=a or t
  misc_feature 157: n=a, g, c or t
aaacatctataaagatgtgttatgctgaaataggtgttgcacaaaataaatgaaacagactttgtattgcctaatacagtggaaaaagctgataattgttgaagcttgatatgggtgtatgggggttcatwgtattagwctctttcagtttgtatgnctgaaattttccataataaaaaagtaaacaaaaaagatagattagactgatatgtctgagatgtttaccaatataaaaatgtttaaagtttatgccagatacacctagaaatctaagcatat

SEQ ID NO: 32043 - DNA, 198 bp, Homo sapiens
aaaaacaacaaccccggctgtgcgtggtggctcgtgcctgtaattccagcactttgggaggtcgagacgtttggatcacttgaggtcaggagttcgggaccagcctggccaacatggcgaaaccctgtctctactaaaagtacaaaaattagctggctgtggtggcatatgcctgtgatcccagctactggggagact

SEQ ID NO: 32044 - DNA, 146 bp, Homo sapiens
  misc_feature 128: s=g or c
  misc_feature 129: y=c or t
  misc_feature 130: y=c or t
tataggtgattataatcaagtgtaggcttcctgaattttgacatccttttagaacttgggtctggaattccagaaatgttaattgctgcttgtatttgttcttgtttgttttttagccagtatttggsyytttctaatccagccgc

SEQ ID NO: 32045 - DNA, 301 bp, Homo sapiens
caaggactagcaaaaaataataataataaaataggccaggctctgtagcacaggcctgtaatcctagcactctgggaggctgaggcaggaggattgcttgagctcaggaggtggaggctacagtgagccaatgatcatgccactgcacaccagcctggtcgacagagcaagacactcaaaaaacagaaaaggatatttcaaaggaggaaggaagagccttctcaataaatagtgctgggaaaactgaatatccacatgcaaaacaatacagtggcactcataccatagacaaaatgatctc

SEQ ID NO: 32046 - DNA, 394 bp, Homo sapiens
  misc_feature 126: r=a or g
  misc_feature 131: y=c or t
  misc_feature 239: n=a, g, c or t
  misc_feature 379: m=a or c
  misc_feature 380: n=a, g, c or t
aaagagccaaggctgtgtgaccccctcatcacttagccaggcgtatggtcctggtttctgaggctgccagaaagcatcttagcaatttgtgtttggatggtccatgcctgactattctaggctggraggtycctaaagagtaacaagaggaagagaaacaagaatctctgacacttgttgagaatagagcacagtcccatttgtttgaaaagagacaccaggcagccatgtttatgtgncagaaatgcattccacctcaaggaggacttaatttatggacccgtgtgtgccaggctgagcgggcaagatctttctcaggacaaactctgccatgcagctaaaagcctggaaactaaaggatttcatgtagtaaactatmntccaacccctatag

SEQ ID NO: 32047 - DNA, 321 bp, Homo sapiens
  misc_feature 130: w=a or t
ttatatgcattttaaaactctaggcattgaaaaccacccaagtgtcccaaatagaagggtaatatataatcaatcactcagtgtaatattatacatcctttaaaaatgttattgggaaatgttttatgawctgtaagtccaaggaatcctctcccaccatttctttccccccgctgttcccccatacccacacttctttgttccaattggcatgtaaatttggttttcccgccaaatgagtcagtcatgatgggaacctcaactgatttgaacagatgtgtgtcaatgttacttggaaaactagatgtcaataaccaggga

SEQ ID NO: 32048 - DNA, 280 bp, Homo sapiens
taactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggcccct

SEQ ID NO: 32049 - DNA, 425 bp, Homo sapiens
  misc_feature 134: r=a or g
  misc_feature 146: d=a or g or t
  misc_feature 155: v=a or c or g
  misc_feature 159: d=a or g or t
  misc_feature 207: y=c or t
caattcatggatgatctgtacagaaatgaataaatgaaagagtggtgtttgctactcttctgttatctgttttgagttttaagtcaagcccataataagctggttccttcctcctgcctgggccaacaatgaargcgaacagtgadtagagtttvgcadagctggtttatgtggtctgtggccagactacaaggcgagtgttatttytggacccaaataaaaactataagtttttttctttaaattctttcggtaaaaaatgggagccacttattaaaataaccaagcataatagttaaactggtagcagtagataaagggaacccggtagagaagccaagaatataggtacactttgctacctttctcacgaatctcaaaggtaatatgatatcctggatgggaatcctggaacagaaggaccg

SEQ ID NO: 32050 - DNA, 433 bp, Homo sapiens
  misc_feature 119: r=a or g
  misc_feature 164: n=a, g, c or t
  misc_feature 336: n=a, g, c or t
tacgttaaaggtaaatttttaaggtttaaaaaaaatttagtaacttacagggatggagaatttagatgtcagaggtggggagatttatttttataaggtaatttttatcctgataaggrcttaaaaaaaaggttttgcaactgaaattttaaagtaaacatgtnaagtacagttaaaaagtaagcattgtagtaaatagtggattctctggtgtgtattttttatctcagtgttgaaaattggaaaagaatggactgaagtctaaaaactggaataatgaaggacactaaatgcctttattgtagatactatgtttgtaagtctatggctaagcancttaagccaaaaaggtctttcaactgaagctttaatcaacttattttggagatgttctcttcccttatctcatgcgtcatccctaaaataataagat

SEQ ID NO: 32051 - DNA, 375 bp, Homo sapiens
  misc_feature 300: w=a or t
  misc_feature 304: b=c or g or t
agatgcagcagaactcttccacatagcagtagtgtctaccaaaccagtgtggtccagagaggtggtgttcactgatttaatgtttaagttgatagattcagggaaagtgagcagtgaaacaatttctgcttttcaccaagagcagaggttttctaaataagtcgaaggggaaaacccttggatgcttcatagtcctacttctaggcagttctgcatgaatttctggtaatccaggaggatattgccgtagaagaggttgatggtagcttgaaccagggtggacacaaaggttaagagcawgctbatgtgatcgctgtgcagtaactgaagaacatatgcggaaaaacagcaagagtttgaaaatatccggcagca

SEQ ID NO: 32052 - DNA, 457 bp, Homo sapiens
  misc_feature 127: r=a or g
  misc_feature 420: m=a or c
taatatgtttctatggcaactctgaggtcagtggtttagaaatgagataccagtgttaatgaaaagtgtgtgctctttgcttttgcatggcttggcttagtatccaaggtatattagggccacttgraagcatgaagaaccagttatatagggaacaggtttctctcagtggcacattttgctttttctgagccccagatacattgcctgggcatgaacattgttaccgtaaattgcacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtmctggtgtattgccagacagctctcttttggttccatt

SEQ ID NO: 32053 - DNA, 215 bp, Homo sapiens
  misc_feature 138: n=a, g, c or t
  misc_feature 162: v=a or c or g
attttttcttgctatgcagttcatttgattttgtgattcttgaggagttccccctttaatgtcttcatacaaagatgaagtaatattattagcttttaatacttttagtaaatatggaccattatctaaaaacttggntttattaaccaaacattggttttvcttttcagcggggatctgatgagcttctttcttctggcatcattaacggacgg

SEQ ID NO: 32054 - DNA, 279 bp, Homo sapiens
  misc_feature 131: y=c or t
  misc_feature 132: w=a or t
aggaagctcaagaaagctatggatttttatgtatttagaaaacctatgtttcttggattgatttgcattgttcttgcaagaacttcttggaggtgaagttcttttaagaaactgaattctgacaaatggaywataattttgtaaaaggtatatgtaaaaggtataatatctctgagtgtcctatcctttctcaacccaattttgtgcttagtgaaactgctgcttgtagctaaaggttgttcatttggaagactactccattaaaataaaatacgaccg

SEQ ID NO: 32055 - DNA, 286 bp, Homo sapiens
  misc_feature 17: y=c or t
  misc_feature 18: y=c or t
  misc_feature 109: k=g or t
  misc_feature 201: s=g or c
  misc_feature 229: r=a or g
  misc_feature 234: r=a or g
  misc_feature 236: k=g or t
  misc_feature 243: k=g or t
cggtcccgcctccatgyycatcccaagatggcggagatccccctgtactttgtggacttgcaggatgacttagacgactatggatttgaagactatggtacagattgckacaacatgagagtaacggccttcttggacattccaggccaggataacctgcctccactcactcgcctggagaagtatgctttcagcgagaasaccttcaaccggcagattattgccagarggctrcktgataakcttccgggacttcggtaacaatgaagaagacttcctcacggta

SEQ ID NO: 32056 - DNA, 237 bp, Homo sapiens
tcattttattgttttctgttttagataaccatttgtgttgactaatctgatagtgaatagtactgttagcttcacctgttgcaataatggcaacgttgttacctcttctaaagaatcctgtgtttatccaaaggtctgggaccattgtacaggatcattaatatacagttcatctgtgttatcaggtaaatttaaaactttcatgttttctgtaaataggttgtgtgtaacccactc

SEQ ID NO: 32057 - DNA, 231 bp, Homo sapiens
  misc_feature 215: s=g or c
gcactttgggaggctgaggcgggtggatcacgaggtcaggagatcgagaccatcctggctaacacggtgaaaccccgtctctactaaaaatacaaaaaattggccaggcgtggtggtgggcgcctgtggtcccagctgatcgggaggctgaggcaggagaatggtgtgaacccaggaggcggagcttgcagtgagccgagatcgcgccactgcastctatcctgggtgaca

SEQ ID NO: 32058 - DNA, 389 bp, Homo sapiens
  misc_feature 17: y=c or t
  misc_feature 224: k=g or t
  misc_feature 295: s=g or c
  misc_feature 361: r=a or g
tacattctggtgaagayccctcttgataatgggaatgttttaactctcttgatgaaaaaataatctgtatttgtgttgatgttcacatttctgtagcacatttcttatccttttggttgaatgaaaagatcttgtataggggtgtggagacggggagtgggtagaagtgtgtgaaggacgctttgcatttgggatctgttcacaaacagccatatgagtgtgtkaatgaatgtcagccagttaccaaccctgctggttgttatgggttgttttgagaagttggcaaccaggcatstaagatgttgcctggtacaggcctcttttcttccctgaggcccatgacatttctcgttactctagragggtttctcagatggccagtaggctct

SEQ ID NO: 32059 - DNA, 254 bp, Homo sapiens
  misc_feature 202: k=g or t
  misc_feature 212: r=a or g
  misc_feature 241: n=a, g, c or t
  misc_feature 242: s=g or c
actcccaggactcccggccggggtagctcttcactcctcagcgcgacgtcgtgtcgagttcccaaaaagctccgcaggggctgtagggaggtaagagccccccgtgaccggtcgtctcggcctcccctcagccctgctgttcccacaggggggcggggtgaccgctggacccgccgacctgggcgctgggtctggccctctkcctctggggrcagagcctgggccccgaccgattcctttnscgagcccccgga

SEQ ID NO: 32060 - DNA, 425 bp, Homo sapiens
  misc_feature 127: r=a or g
attttactgaaactggttaagcaagaaatcccatgcactgtagctcctaaccctttggctgaaatttgcagtcagtttgaaagctcaatctgctttttgggttttgcagtacaaccggtaccagcartatgggtgcagaggagtgtgtcctgcagatggggggcgtgttatgcccccgccctggctgtggagcggggctgctgccggagcctgaccagaggaaagtcacctgcgaagggggcaatggcctgggctgtggggtcagttaacctctcagagccccgatttcctcatctgtgcactggggagaatggcttgcctgaggagcagcgtggacacattggcagaacctctggtcttctcctggcctccgtaaaactgagcagactaacttgttagcttgcaaagaaagcaaaatcttggat

SEQ ID NO: 32061 - DNA, 333 bp, Homo sapiens
  misc_feature 123: n=a, g, c or t
  misc_feature 128: k=g or t
  misc_feature 129: w=a or t
agatgtcttttttttctgaacccattttttgtgagatttagtgaatctttctgagtatcatatttgagagacaattgctttagccttatttttaattacttagctagcatgtaagctataaangatakwacctaaatacttgactctgtgctgtcaaatgtcaaatgttgatttttaaaaattcatataattctaaacttttaacaaaattactgaagcaaagctctcatatttgtctctcattcttattgtataaaaattctaagcacataactgtcccctttattgtataattccaactacataactgtcctattattacttaccaggcaa

SEQ ID NO: 32062 - DNA, 354 bp, Homo sapiens
agaagcaaaggtactagggacagaaacagttctaaaaattaagattttataggattattttgtgttctctagatagtcaaaaatgtattctcaaatttctctgtatattttttatccatgtgccctggtgtttcatttattatgggaatcctattggtatttaggactatgtcttaattttggggcagggcagagtatggaagtagagaggatgggaaggggattgataagataaagtattgtttgtgaagactttgtaaataccatctgggcaatagaataatagaatttatttatgactcactctacagatcacttttggaggaaaaaatacaaattaaatgtctactttat

SEQ ID NO: 32063 - DNA, 429 bp, Homo sapiens
caaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagta

SEQ ID NO: 32064 - DNA, 446 bp, Homo sapiens
  misc_feature 133: n=a, g, c or t
  misc_feature 134: h=a or c or t
  misc_feature 298: w=a or t
  misc_feature 299: d=a or g or t
  misc_feature 300: n=a, g, c or t
  misc_feature 367: n=a, g, c or t
ccaaaaaaatgtatttttttgtgtgtttaccactgcaactattgcacctctctatttgaatttgctgtggaccatgtgtggtgtctctatgccctttgaaagcagtttttataaaaagaaagcccgggtcttnhgagaatgaaaactggttggaaactaaaggttcattgtgttaagtgcaattaatacaagttattgtgcttttcaaaaatgtacacggaaatctggacagtgctgcacagattgatacattagcctttgctttttctctttccggataaccttgtaacatattgawdncttttaaggatgccaagaatgcattattccacaaaaaaacagcagaccaacatatagagtgtttaanatagcatttctgggcaaattcaaactcttgtggttctaggactcacatctgtttcagtttttcctcagttgtatattga

SEQ ID NO: 32065 - DNA, 211 bp, Homo sapiens
  misc_feature 163: r=a or g
ctcaaggattctgtttcaacatcttttgtgttggtgagacaggcattggcaaatccacgttaatggacactttgttcaacaccaaatttgaaagtgacccagctactcacaatgaaccaggtgttcggttaaaagccagaagttatgagcttcaggaaagcartgtacggctgaagttaaccattgttgacaccgtgggatttggagtccc

SEQ ID NO: 32066 - DNA, 181 bp, Homo sapiens
ggacaagaggttgttgaaaaaaaataattaaaggtcatatttatgtatagaaaaaaccgaattaactgtaataagaggctttttaaacttcccatataactaaagattaataataaatatgataagactctaccaatgaattttaagaaaagtcagtgccaaatcagaattagaggccccc

SEQ ID NO: 32067 - DNA, 150 bp, Homo sapiens
gtatcacccaggtctttaagtggactggaagcaactctttctttgtgaagggagacttggattcactgatgatgggcagtggcagtggccggtttgggctgtggttggatggagacttgttccgcgggggaagctccccttgcccgaccc

SEQ ID NO: 32068 - DNA, 499 bp, Homo sapiens
  misc_feature 349: w=a or t
  misc_feature 370: n=a, g, c or t
tagtgggagatggggtctaggacaaagtgcattggatatgaactatatgactcattacttatatcaaaattcagtccttttttgctgataacattttatgtaattaaaatagtattctgttattttacaacttttaggaactattttttgtcctccttttaaataagaaaaatatacaaaaatttcagaaaagaagagtagtgttgagggttgaattgtgtcctcctccaaattcttatgttgaaatcctgtccgcctctacttcagactataacctcacttggaaatatagggtctttatagaggtaatcaagttgaatgaggtcattggggtgggcttgtccagttwgcactgatgtgcttataaaanggagaaatttggataccgagacactaatagaaggaagacgatgtgaagagacctaggaaaaagatggctctctacaggccaggaagaaatctgaaacagatctttcctcacagcagtcagaaggaagca

SEQ ID NO: 32069 - DNA, 151 bp, Homo sapiens
  misc_feature 16: w=a or t
  misc_feature 29: w=a or t
caagttcaccgatagwagacaggattgawatagttgagaaaaattatattgtcagagttacagggaatagactttctaagttaattttttcttttaagtttggagaggcttatgcggtacctgattcatccagcaaattaagacctgcctt

SEQ ID NO: 32070 - DNA, 128 bp, Homo sapiens
aacacttgctgatttccatggcgttaatactcccaccacgttggagttgagctgccagggtgatgtcctgaaggtggaagagggaagagaggtatgagggctcaggttgggccaccgcggcgcactat

SEQ ID NO: 32071 - DNA, 174 bp, Homo sapiens
tgaatgagagtccaaaaaagaaaaaggaaaaaatacaaacagtcgtagacataataaaaggtgtaaggtgtacaatatagcttataatagaaatttaaactaaaatcacattgaaataccattgttcattcatcagattggtagaaatccaaaagtcttgatatactctgtcgc

SEQ ID NO: 32072 - DNA, 480 bp, Homo sapiens
  misc_feature 433: v=a or c or g
agatatcaaaagaaaaggtgaccttaggccaaggcagtggaattttctgtaagtaaggagcatagagatgatatataaacatagtgatgacaaataagcattgaagtttgtttgcagattgtttgtttagagcttggtctggaatagcaagaaacctacataccctccgactcgtctcgctgtagttgttggttattcaccgcaccctctctctggcttcagtctccaagcccttcagccttgttgaaagggtctagaggtacccttgcacatccaaaggccacttggacaaatgatgccttcagcttttggggtccacagtgccatttcttctacatcccagcttactatgcttgacttcagttacattccccagtaccaagaacgcaggaggactactttaatcccctttgcaaaataacaacaacaatavaggcctccaggcagagcacattgagcctaattcagattttttttaaa

SEQ ID NO: 32073 - DNA, 473 bp, Homo sapiens
  misc_feature 72: r=a or g
  misc_feature 73: w=a or t
  misc_feature 122: k=g or t
  misc_feature 138: d=a or g or t
  misc_feature 177: r=a or g
  misc_feature 185: w=a or t
  misc_feature 191: w=a or t
  misc_feature 207: r=a or g
  misc_feature 300: h=a or c or t
  misc_feature 301: n=a, g, c or t
  misc_feature 375: d=a or g or t
  misc_feature 429: r=a or g
cactgaagtcagtccaggttcaaggggagggttgttagatgtcacctcttgaagggaaatggtaagttcatrwcaaaggaattattatcatagttatctttggaatacataatttgcctgakgcctgttagttccatdagtgttgaatcagaactttgaacttaacaaaacaatgaraaataccwttagawaaaaacaattctaatraacaaaattataaattccacttttgatacttgagacactcaatccttaagaatggaatgacaaaatgtgatacaagggtttcttcatttttahntctaacatttaattatgacttttgacatggaaaaaattgttctgtgttgaaagatgtacccatttgtgtgtatdtataaatatgaacagctgacagatagggaatcttaactgattaggtagtcatgragattttctttcatggtgcttttcatcgcttggtttagacacat

SEQ ID NO: 32074 - DNA, 387 bp, Homo sapiens
  misc_feature 243: y=c or t
  misc_feature 260: r=a or g
  misc_feature 261: r=a or g
  misc_feature 287: w=a or t
  misc_feature 288: v=a or c or g
  misc_feature 289: n=a, g, c or t
  misc_feature 347: s=g or c
acctataatttttcagtttgctttactatattttataaagaaaattctatcttatggttgattgagcattgagatgaaggcattaggatagatagctcaggaatgtaaaggttcagaaaaggtctgttttctcagataacaaatatgatggattccatggctgaccttggtgcttaaaccaggaggtttcaatctagtcctagagttgtgtccctctgaaaggcccaatgccatgtaactaayaactggatatatacttrrccttacttaattcacagataagttgwvntaactcagtatttttatttcaattaatggaaacagtcctcttttcaaccccaggttgsttacattttgctggtctccccaagtgaccattggtggaga

SEQ ID NO: 32075 - DNA, 243 bp, Homo sapiens
  misc_feature 73: h=a or c or t
  misc_feature 74: m=a or c
  misc_feature 139: k=g or t
tactgtccagcatgtattgttccaaatatgactccctaaaatatatacactttgcagaagctctaggccctchmaaccttgccattggttgccgtatttcaaggtcaatatagtttccctcactttacacaatcattaktcttcaatagtggaccatatccttcaccaggtatcctatttctgttatctagaggttagcagaaaatgaaatgaaggaatttccctaagcagttgggaagaaca

SEQ ID NO: 32076 - DNA, 118 bp, Homo sapiens
cagatggttttcactgaggcatggtttcaaatttaaagaggattatggcccagaaatggatgccggaccagatgtctcggagttcatcgccgagaccaccgaggactacaactcgcat

SEQ ID NO: 32077 - DNA, 254 bp, Homo sapiens
  misc_feature 150: n=a, g, c or t
attctcgttttatatgtgattttagtttgggtgttattttccgtcagcccttagaagatctttattcactgatttttgtcggctattgttctccacgagaacgagttgcggaagttcatggatgttgcatttgcaaagattcaaaacacnaaatcaagctctaagaatgttgaagaaatttgaaagattgaatatacctaatcttggtattgatgacaaatatcaacttatccttgagaactatggggctgact

SEQ ID NO: 32078 - DNA, 212 bp, Homo sapiens
ttttgttttgatggaggagcagtggaacgatgttagagggaggcgctgtgcccatggggacagattgggagggcccaagcagtgggcagcgtgctgggaaaaaatcagctctcggaagaaatgccttgatccatagtgtgcagcagttctcatggagtagctactcccaccagggctgacttcaagccaccagtagtttaatagcccgctcc

SEQ ID NO: 32079 - DNA, 137 bp, Homo sapiens
  misc_feature 134: m=a or c
  misc_feature 137: s=g or c
tttgagacagagttttgctctttttacccaggctggagtacaatggtatgatctcgcctaactgcaacctccacctcccgggttcaagcgattctcctgcctcagcctccagagtaaactgaaattacaggtamccs

SEQ ID NO: 32080 - DNA, 131 bp, Homo sapiens
  misc_feature 46: k=g or t
acacgggaacccggaaccctgtgtgctggggaggaatcccgcagtkgccggggggcttgaggccgctgctttgtctcttcgtccagagccttatcccccaaagggcctccaggcaacatggggggcccagt

SEQ ID NO: 32081 - DNA, 299 bp, Homo sapiens
  misc_feature 142: r=a or g
  misc_feature 155: w=a or t
  misc_feature 158: m=a or c
tttacaagacagggaacaaatatgtgtcaatgtgcagcttaacagaggggacttgaatggataaaattatctttaattatctagagctacccagtactgggcttgaatttaatcatagtcaaatgtttcctctggcagcatratattaccaaatwccmccatattaccttataattgccattacagttccttatcaaaaatgttaattctttgcttgagcaaaaatcaataaaaccttatgtttgaccctaaagtatttgatcagggaacagaaggtgtgaattggacagatcccccgt

SEQ ID NO: 32082 - DNA, 287 bp, Homo sapiens
  misc_feature 2: n=a, g, c or t
  misc_feature 13: r=a or g
  misc_feature 77: m=a or c
  misc_feature 143: s=g or c
  misc_feature 170: w=a or t
  misc_feature 228: s=g or c
  misc_feature 229: r=a or g
anacaagtttgtrggtatgtggatatgtcttaaataagtcaggttgtgtcaaattatgatggatgatgatgactgcmaggcaggaaggaagatgaaaaggaggaggcattgaacactaatggtcacagggagcaccgggagcstggtgacgccagggtgagctgcttgtwctgtgagggtggagggaagagatttattaaccttagactttgttaaagtatacatgtsrcgtctacatgggaaactgctaaatgaataagtggaaggtgtaacttccacaccattaa

SEQ ID NO: 32083 - DNA, 372 bp, Homo sapiens
  misc_feature 112: m=a or c
aatcatgttgatgttctataattatttttatgggaaaagttttaaatgtttaatgaagaagatttagagcaatacattatttaaaagtggataggaggttgggcgtggtggmttacacctgtgatcccagcactttgggaggccgaggtgggcagatcacctgaggtcaggagttcgagaccagcttggccaacttagggaaaccccgtctctaacaaaaatacaaaaacaattagccaggtgtggtagtgcgcgcgcctgtagtcccagctactggggaggctgaggcaggagaatcacttgaacccgagaggcagaggttgcagtgagccgagactgcaccagtgcactccagcctgggtgacagagccc

SEQ ID NO: 32084 - DNA, 421 bp, Homo sapiens
  misc_feature 272: n=a, g, c or t
  misc_feature 273: n=a, g, c or t
caacttacccagagactagctaaacaaattatcctgcaatgcccagattgccagctcacaggcacgtcccctccttcaacaggtgttaaccctagaggactagaacctaatcagttatggcaaacagatgttacacatgtccctgaatttggaaaactaagatatatacatgtatccgttgacacctattctcacctaattagcgcacatgctcttcctggaaagtccaccccatctgtcattaaacatcttttaacttttatgtttatggnncagcccacaaaaattaaaacttaataatggtccggcttatgccagctcactcaacaattttgtcacacttggagcgtccaacattccacaggcatcccgtacaacccccaaggacaggccgtagtagaacgtgcccacttcaccctat

SEQ ID NO: 32085 - DNA, 392 bp, Homo sapiens
  misc_feature 114: r=a or g
  misc_feature 123: r=a or g
  misc_feature 124: s=g or c
  misc_feature 147: r=a or g
gaaaatctttattagtggcctggcacggtggctcacacctctaatcccatcactttgggaggccaaggtgtgcagatcacttgaggatcaggagttcaggactggcctggccgrtatgacgarsccctgtctctactaaaaatgcaraattagccaggagtgagggcgggtgcttctccagctgctcaggaggctgaggcaggagaatcgcttgaacctggggggcagaggttgcagtgagtcaagatcctgccactgcactccagcctgggagacagagtgaaactccatctcaaaaatgaagaagaagaagaaaaaaagaaactctatgagcaatatgatcaatttaaagtaaaaattattttcaatgaataagtatttatttaggtaaa

SEQ ID NO: 32086 - DNA, 428 bp, Homo sapiens
caaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacagaatctgaaccaaatttaccttactttccttccaaaatatccacattca

SEQ ID NO: 32087 - DNA, 127 bp, Homo sapiens
ttctgtatctgccaccttgtagctgttggctcttgaacaacaactaagcctctactttgaacatcaattttctcagtaaaatgagggaactagactaaatagttgccaaaattcttagtccacactc

SEQ ID NO: 32088 - DNA, 106 bp, Homo sapiens
tttgctccaagacatggctgcagcttcccagggaggagcccaggggcatctccaacactcagcctttccctccggacccttttaaaagattcaacagcaccgtcag

SEQ ID NO: 32089 - DNA, 138 bp, Homo sapiens
  misc_feature 122: r=a or g
aataagcataaaggtgaggctaaagaacaagagaggaaaaaggagaggagtcgaagtatagataaagataggaaaaagaaagacaaagaaagggaacgtgaacaggataaaagaaaagagaracaaaaaagggaagct

SEQ ID NO: 32090 - DNA, 406 bp, Homo sapiens
tttgaagaggattaaatgaaacaagtattcacaaataggtgggcagagtttagaaaatcaacaagagatattgtagtatcctgggctagcaacagagaggatgggaatattgccccatagaccttgaagtgcaaagagaaggagtgctacctcaaaaagagagctttgtggagaaggctgcctgatagcagctgtagtcccaggtagagggtgagccaccacgcccggcggttattacatagttttaaaagtgactcctcttaaggaaattttaattaagagaaaaatatcctagaactatgattagggtcaaaacagtatctatgttctttaggtattaaggaaaaagtgtatctgtcctaagaaagtgtttataaggagaagagtcttcctagaacactaactt

SEQ ID NO: 32091 - DNA, 121 bp, Homo sapiens
ttttttggtagatatggggtttcatcgtgttgcccaggctggtcttgaactcctgtcctcaagtaatctgcctgccttggcctcccaaagtgttgagattacaggcgtgagcgccgtgcct

SEQ ID NO: 32092 - DNA, 135 bp, Homo sapiens
  misc_feature 125: y=c or t
ccatcccactcaatattcagttatataaagactaaattgtaaagttaacttcagtaatttgtgtataaaataaaattgggaattagggagaaaaatatggttagtacagtcaattcttgttattycatggtggtg

SEQ ID NO: 32093 - DNA, 214 bp, Homo sapiens
catgcctactaacacatctattctgcagcccatagattgaggagtaattttgactttcaagtcttattgtttaagaaatactattttgtaacactataggtgccataggtagtgattcttctgatggatctgggcaaagtaaactgaaaaccttctggaaaggattcaccattccaaagagtcattaagaacacttgtgatttatgggagggcc

SEQ ID NO: 32094 - DNA, 82 bp, Homo sapiens
  misc_feature 3: r=a or g
aargaagcggcgccgccatcgcctcccggcgctccctccccgactcctaagtccttcggccgccaccatgtccgcctcggct

SEQ ID NO: 32095 - DNA, 374 bp, Homo sapiens
  misc_feature 119: r=a or g
tgcagactagataatctctattgacctgccttccagttcactgattctttcttctgcctgctcaaatctgttgttgagtctgtctagtgaatttcacttatggcactttcaactccagrattttctgtttgatgcttttaatcaccttattactattctctattcaggaagataaagttattgtaatttaaaattcttcacatatccttttctttatttttttgaacatatttataacatcttatttaaagtctttgttgtatggctggttagctcagttggttagcatgtggtgctgataaagtgtttgtctgttaagtcccaaatcttggcctcttagggacattttctgttggccactttctccccccgct

SEQ ID NO: 32096 - DNA, 337 bp, Homo sapiens
  misc_feature 258: n=a, g, c or t
ctttacccagagctaccatgagcaagcggaaccaggtatcgtacgtgcggccagccgagccggcgtttctggcccgcttcaaggaacgggtcggctacagggagggacccaccgtagagactaagagaaattcagcctcagcccccagatgaagatggggatcacagtgacaaagaagatgaacagcctcaagtggtggttttaaaaaagggagacctgtcagttgaagaagtcatgaaaattaaagcagaaataaangctgccaaagcagatgaagaaccaactccagccgatggaagaatcatatatcgaaaaccagtcaagcatccctcagaat

SEQ ID NO: 32097 - DNA, 231 bp, Homo sapiens
cttgcccatgcctatgttctgaatggtaatgcctaggttttcttctagggtttttatggttttaggtctaacgtttaagtctttaatccatcttgaattgatttttggataaggtgtaaggaagggatccagtttcagctttctacatatggctagccagttttcccttcatgctaaaaactctcaataaattaggtattgatgggatgtatttcaaaataataagagcct

SEQ ID NO: 32098 - DNA, 216 bp, Homo sapiens
caagagactatttagagccaaaaaggagcctgagtatattggtgggatatctgtcagagaccataacaagcctgctattagctggtaaaaagatacaaaatcttggcctgctttacaagtcccagtaatagcattcttggtcaatgatagtctgtgtgaatgcttctattgtcagagagctcatagctgcttgtaaacttccataaaccttggccc

SEQ ID NO: 32099 - DNA, 321 bp, Homo sapiens
  misc_feature 135: r=a or g
cagtgatgaaagagccagtgggcaaagttgtacattgcccaagcgttctgatagcgaacttaaagatgaaaaaccaaagagacctgaagatgagagcggcagagactatagggagagggaacgggaatatgaacragatcaggagcgcatacttcgagaaagagagagggtgaagcggcaagaagaagagcgccgtaggagaaggagcgctatgagaaagagaagacttttaagagaaaagaagaagaaatgaaaaaagagaaagacacacttcgggataaaggaaagaaggctgaaagtacagaatcaataggcagccga

SEQ ID NO: 32100 - DNA, 377 bp, Homo sapiens
  misc_feature 256: k=g or t
  misc_feature 340: r=a or g
  misc_feature 344: v=a or c or g
caccgtgcaacaacaacaaataaaacagtagacatatctccctgatctaattattattatgaaacaatgatcatctctgagatagttagttgaagggagataggcaagcgagtgtcaagaatcatgccaaatgatggaagggaatctaaactgaaatgaacacttcgcttagcacaatttccaaaacagaaaatctccagactttatgactaatgaactttacgccccaacttggaagatatgagaagccattagkcggataattctggaaagagaagaggaaaagtaaagtgtgacaagacacattcacatatagttcaagattgtgtcatgtttccarccavaaagagtcctatatagtgtttgatagaagtcat

SEQ ID NO: 32101 - DNA, 221 bp, Homo sapiens
  misc_feature 136: m=a or c
catgtcatgtcatctctaaaatttaagcatgcatctcctaacaataagaacattcttttgtatagccacagtatcattgttacacctaagaaatttaacattaacctaatatcctctaaaaagtatccatatttcmaagttttctcaattatcctaaaatatttttctatttaggattaaatcaagtatgcatatagtgtcttctctttattttttttttt

SEQ ID NO: 32102 - DNA, 278 bp, Homo sapiens
  misc_feature 191: y=c or t
  misc_feature 192: n=a, g, c or t
cacacacctcattgaacaattttccaagtgttggtttgctctcttccttactacatattaatgaggtgtccaagactgctgttcagcacgtatctaaaatgttgtttaactacatcagaaggtaaatctatagctgcctgaagcgaactaaaaagctgtgtcaatctggtgcagtggctcacacctgtggynccagtgctttgggaggctgaggtgggaggatagtttgaggctaggagtttgagaccagcatgggcaacatggaaagaccccccccc

SEQ ID NO: 32103 - DNA, 442 bp, Homo sapiens
catattcaactctgttcatattaaaccactgtgaagcaagcctctgttttcctgcttaagttgtaaatttagtattctttagtgtctaggatatgctgggtattatgcagaaatcatacagtgtggccagtgtcctgaggtaatgttttgcatttaaatttttttagaaagcagaatcttaacttatcttaatgatatttacctatcctttttgcaactcacaactgactttgtcacagaggtaatgcatctgcttgcaggaagtagctgtaggctttttatctcaactgacactgttttttttcccaaataaatttgacacaggcagaaaggtgggtgaactctcagaacttttggtgggtggatattcatctgaccagtgagctctgaaatggtttccctacacagagtgggttttggcaagggttggaatgaggggggt

SEQ ID NO: 32104 - DNA, 120 bp, Homo sapiens
tatttttagagacagggggtctccctatgttgcccaggctggtttcaaactcctgggctcaagtgatctgccctcctcagcctcccaaagtgctggggttacaggcaggcatcagccacc

SEQ ID NO: 32105 - DNA, 147 bp, Homo sapiens
  misc_feature 142: m=a or c
  misc_feature 145: s=g or c
caaaataaaatatctatcctggtttatgggaaagattcagcaaatttgctagttttttcattactaacatgatttaacccttgtgttttgggaaggtggtctgttggtaaaaagccctaaactcttgatttatttcacacamtgsct

SEQ ID NO: 32106 - DNA, 203 bp, Homo sapiens
  misc_feature 107: k=g or t
  misc_feature 108: k=g or t
  misc_feature 142: m=a or c
  misc_feature 167: k=g or t
tgagtagggtcaagtaatgtttctttttttagtataatagcacctctattctaatttgctttaaatacctaagctaacttaacactgatatttttctagtagggtakktatgctcctttagagacctatttggagctattamctacttttttttcccttttttgggkgttatattttgatgtgaacaaaagaatttttacatt

SEQ ID NO: 32107 - DNA, 120 bp, Homo sapiens
ccagactagtaaacacggcagccaggctcagctgtgacttccaaggctgtgcgggtgtggaaccgcggctgggctttaacatcaggctcctgaggaccgccccagtgacctgggagaccc

SEQ ID NO: 32108 - DNA, 189 bp, Homo sapiens
  misc_feature 144: k=g or t
  misc_feature 146: k=g or t
  misc_feature 147: r=a or g
tttttccttcttgtgtagccacagtggctcttattcataaagtaatacagactttttttaaaaaagtaggaaccatgtaaagatgatggggacagaataattgtgaagacctctctgctcctcttgcctgcacaccctatatakakrtataatcggagctaaagagctctgtgtatatttcaccccgta

SEQ ID NO: 32109 - DNA, 99 bp, Homo sapiens
  misc_feature 73: r=a or g
  misc_feature 99: y=c or t
aacaaaggtgtgtttgattttccaatttagagttacttcattgatagtaacatgcgcttatatcatgatctaraccataagttcagattgcttgataty

SEQ ID NO: 32110 - DNA, 82 bp, Homo sapiens
ctgcgcgtgtgcaccccgaggttgtctcacttcctgttcagggcgaccagcgctgcgccctccccactccacagatgaggaa

SEQ ID NO: 32111 - DNA, 165 bp, Homo sapiens
  misc_feature 116: r=a or g
  misc_feature 117: m=a or c
  misc_feature 128: k=g or t
  misc_feature 135: r=a or g
  misc_feature 136: r=a or g
ctttatttttctgatagaaatggtttcctctggatcgttttatgcggttcttacagcacatcacctctttgcccccgacggctgtgacgcagccggagggaggcactagtcaccgrmaagcgggcctkgaagacrragcaaagcgcccacccaagtcccccgtaa

SEQ ID NO: 32112 - DNA, 394 bp, Homo sapiens
  misc_feature 118: s=g or c
  misc_feature 129: r=a or g
  misc_feature 326: v=a or c or g
  misc_feature 327: h=a or c or t
  misc_feature 328: k=g or t
agctagacttacatggcaaagaggaaggtaaactcattttcttgagatcgtgcctattcctctttttgctgtctctgtactcagaatacactttacttttctaccattaacactttgstgccttccttraagaacagggcatgccgcatctctgaagccacaagccaagcaagcatagtacctggtacaagtataggccgaaatatttgctggatattagagtatatggaaacataatgaaagcttgtcatcattgacatttaaatgtgaaactgtcaccatcaatttggacaattagaatccatctcatctcgtttacatggcavhkcttcaatattcttcacagaataagtagcctttaaaagtgtgttcaaattacttcttactcaagagc

SEQ ID NO: 32113 - DNA, 443 bp, Homo sapiens
  misc_feature 50: v=a or c or g
  misc_feature 120: w=a or t
  misc_feature 130: k=g or t
  misc_feature 135: m=a or c
  misc_feature 141: r=a or g
  misc_feature 292: r=a or g
  misc_feature 346: m=a or c
gacctaaaaacattaagaagtactacaaaaataaacttgctagaaatgavaaataaatcattgatgttaaaacctcaatggacaggaaaagtaatggcatttaatattggaaatggaggwttacaaacckgtagmcagaaragggaaacaaacattgatgactgcctgcttcgtgacacgagctgcttttattaatgtttattttatttaattcttggaactactttttgaggtagttgaatatcccacttttagagagtgctgttatctacagataaggtgaaaacagtarattaagtaagagcagtgaggaaaatgatgaactcagttttgaatgtcttaaggmacatgtggggttttctagggagtgatccaggagatactttagttcaggagagagatccgggcttaaaattttaaactgcttaaattcccaaggttat

SEQ ID NO: 32114 - DNA, 273 bp, Homo sapiens
  misc_feature 66: m=a or c
  misc_feature 87: r=a or g
  misc_feature 113: m=a or c
  misc_feature 125: s=g or c
  misc_feature 129: d=a or g or t
  misc_feature 131: r=a or g
  misc_feature 135: r=a or g
  misc_feature 141: r=a or g
  misc_feature 146: w=a or t
  misc_feature 169: k=g or t
catgcctgtaatcccagcactttgggaggccaaggtgggcggatcacctgagggtcgggagttcgmgaccagcctgaccaatatggrgaaaccctgtctctactaaaaatacmaaattagcgggscatdgrtggrtgcatrcctgwgatcccagctactcgggaggctkaggcaggagaagcgcttgaacctgggaggcagaggttgcggtgagcccagatcgtgccattgcgctccagcctgggcaatgagtgaactccgtctcaaaaaaaa

SEQ ID NO: 32115 - DNA, 421 bp, Homo sapiens
  misc_feature 137: n=a, g, c or t
ttcaccatttgctaaatctgaaaatattcttggccttccccactgtatgtgacctcggttcataattgggatccaaaggtgacaaatatctagaataactttgtctcagaaatagtatcacttaactggggtttacnatagtagagccaagtattacctatctttctttacaactttaaggaagtaattttacttctgagttccagatttttcacttgttaaacagtagtcttcccttcctattctatggcattattaggaggagaaaatgagatatgtgctttgagaaagttaagcagtatagcaagatgaagatattttcaagcccttatcatccatatgctctactacctaccaaagatccagttcatacttttgtttatagtaattggaacttttaaaactctagggtatagttagt

SEQ ID NO: 32116 - DNA, 251 bp, Homo sapiens
acttgctctgcgctgaggtgctgggacagccatggtttcagacgttcactttatccaaatgcatagatgccgtgatggtgctgggaaattcgcatttattcatgaatcgttccaacaaacttgctgtgatagcaaagtcacattcaagaaagccgattcttatatcctggaaagaatggcagacttggagacttcttcggagaccctggcaaccctcctgaatttaatccctctgggagtaaagatgggac

SEQ ID NO: 32117 - DNA, 238 bp, Homo sapiens
  misc_feature 111: r=a or g
  misc_feature 117: r=a or g
  misc_feature 118: w=a or t
  misc_feature 123: w=a or t
  misc_feature 129: y=c or t
  misc_feature 134: m=a or c
  misc_feature 140: y=c or t
  misc_feature 199: k=g or t
ctatgaaatgagaattagttctggtgtatattcagatgtctgctttcaaatattcctagttaaatcagccagttgaagaaagtcaaactgtatattgcattaattaaattrttaagrwttttwatggaycttamcgtggygattttatgtgttacagttgaaacatttccgagacatgttgtatgcatatcttttcttkaagatcttgacatttatggccaagctacgtacccatttt

SEQ ID NO: 32118 - DNA, 341 bp, Homo sapiens
  misc_feature 124: w=a or t
  misc_feature 125: r=a or g
  misc_feature 126: s=g or c
actgcctgctgaatggaaggaaagcaactttaaaacatttagagttttgctgagtatagccaaatgcctgttctgaaacttataggaaattggaattttgtttaaaattttacactttaaggtwrscaaatgtcaattattagaccgagcatattgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaatt

SEQ ID NO: 32119 - DNA, 424 bp, Homo sapiens
  misc_feature 133: k=g or t
  misc_feature 301: n=a, g, c or t
  misc_feature 302: n=a, g, c or t
gtttaaacctccggggtcactgcacacatgcgatctgttttggatggcttctgttctgcaggctgaggggagcaggtgccggcttggcaaggtacccggggttgcagcttccctccgtgaggatgccgctgckgaaatcaaggtttgcttcatctcacaagaagtttaaccttggcaatgcgttcgctgacctactctttcagagtaatgtgtcctaaactctagtgtctttgtcaaccactgtgtatcttctgtaactctcctctgtaactctcttctgcaactctccttacgcttttcnntaaattgatctgcttctagaaacgtaagtacctattttagctttattcaaagcaattttatcttgtgtgatcaagggttagagatgctaattataagtttatatatatttttatatccttaa

SEQ ID NO: 32120 - DNA, 479 bp, Homo sapiens
  misc_feature 125: r=a or g
  misc_feature 126: m=a or c
  misc_feature 130: r=a or g
  misc_feature 137: m=a or c
tgtaatgtaaactattatacaactgtttttgcgactttataggcaggtaaattttgctattactattgaatacaaatgacaattcatttatgaccactcaaacagcgttagtaaccatttagtgrmcaarggattamaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagtcttttcagacatgcccaaactttgagaatttcttcaaccatctaatgctataaagatttttgttcttcctgttcac

SEQ ID NO: 32121 - DNA, 190 bp, Homo sapiens
  misc_feature 129: k=g or t
aaacatcgttatgcggcgcatgactgtatttgcacttttaaaagaaggtagcacttcattgagttagaattaagaaatttggtgttcttaattgttgtgaaagtaaatgtgtatttaaaagaccaactkgtatttcacttgcttttgtttactgctttagtatggactttctgtcagattttgagatgaa

SEQ ID NO: 32122 - DNA, 339 bp, Homo sapiens
  misc_feature 115: r=a or g
  misc_feature 189: h=a or c or t
  misc_feature 232: k=g or t
tcctttgttaacagttttaacagctttccatctcttcgctgcacctaaacttaaggttgcaaagatcaggtgctgatatatttagatgtctggaaaactttcatgctttcactgraaagttccatagagacagatatccaggaattatagcatgtggataaatatttttgtagcacagattcataaathcttgtatgcaggaagtactacaccaaactgttactgtggttakttgtgagttgctgaattatcggtaatatttcaaaatatttaatggtattctgaaaatatactagtaaatacacagaaaagcattatttaggtgatatttcttttaat

SEQ ID NO: 32123 - DNA, 429 bp, Homo sapiens
  misc_feature 159: w=a or t
  misc_feature 369: r=a or g
  misc_feature 370: k=g or t
aaaaatgtccaggcgcggtagctcacgcctgtaatcccagcactttgggaggctgaggcaggcggatcacgaggtcaggagatcgagaccatactggctaacacagtgaaacccgtctctactaaaaatacaaaaaattagctgggcgtggtggcgggwgcctgtagtcccggctactcgggaggctgaggcgggagaattgcttgaacccaggaggcggaggttgcagtgagccgagatcacgccactgtactccagcctggtgacagagtgagatcccgtctccaaaaacaagaaaaaataagtgcaaaagttttgatggtggaaataggaaatgtcagcttcaaagttatttagaacatttcagtrkttttcagttctatggatagcacaaacaaatgcctcttatatctttctcctagaagacta

SEQ ID NO: 32124 - DNA, 164 bp, Homo sapiens
  misc_feature 109: r=a or g
  misc_feature 114: s=g or c
  misc_feature 120: r=a or g
aataaagaagcctggagcgtgggatagaggcccgactgtatctggccggccagaggggaaagggatctttctagtagagtgggatagtgaggaagagagatctggaggrtgccsggcagratctgctaaggagggaactaaagccagtcaaatgaccctcttct

SEQ ID NO: 32125 - DNA, 355 bp, Homo sapiens
  misc_feature 134: k=g or t
aatgattgggggggctagaaaatataggaatatttgatatttaaaagatgatatggcctggtgcagtggttcacgcctgtaatcccagcactttgggaggccgagacgggtggatcactggaggtcaggagttkgacacaagcctggccaacctggtgaaacagtgtctctactaaaaatagaaaaactagctgggcgtagtggtgcatgcctgtaatcccagctactcgggaggctgaggcaggagaattgcttgaacccaggaggaggaggatgcagtgagccaagatcgcaccgttggactccagcctggaggacgagagcaaaactccatctcaaaaaaaaaaaaaaaaaa

SEQ ID NO: 32126 - DNA, 99 bp, Homo sapiens
  misc_feature 18: s=g or c
  misc_feature 68: h=a or c or t
ataatgacccaggctgasaagggtgatacggagaacggaaaggagaagggcggcgagaaggagaagghgcagcgcggcgtgaagcggcccatcgtgccc

SEQ ID NO: 32127 - DNA, 376 bp, Homo sapiens
caaacctcatgccttattcagcatcacaaaatgcataggaaagagaaatcgtatgaatgtaatgagtatgagggcagtttcagtcatagctcagatcttatcctgcaacaagaagtcctcaaccagacagaaagcctttgattgtgatgtatgggaaaagaactccagtcagagagcacatctagttcaacatcagagcattcataccaaagagaactcatgaatgtaatgaagatgggaagatatttatcaaattcaggcttcattcagcatctgagagttcacaccagggagaaatcatgtatgtactgcatgtggtaaagccttcagtcatagctcagccattgctcagcatcagataattcacaccagagag

SEQ ID NO: 32128 - DNA, 306 bp, Homo sapiens
  misc_feature 138: d=a or g or t
  misc_feature 288: y=c or t
catttagtcttgacaaccatttgaaataagagccactgttctttatcttttcacagtgggaggacctggttgtgtaaagaggttaagtaactttacccaggcactgtgagcagctgggaattagcccaaacagactgdcttcagcacctggaccagggagctgtggaattaaggctctggtttctatccagctgaatgacattggggagaatatttttaaaggcctcaatgtgctcatctgtaaaaataacggggttgtgatgggtgatctcaaagatccccgccaaytctctagcagctcacctc

SEQ ID NO: 32129 - DNA, 452 bp, Homo sapiens
  misc_feature 120: k=g or t
  misc_feature 147: h=a or c or t
  misc_feature 153: d=a or g or t
  misc_feature 161: y=c or t
tagatatagatatatagatatagatcgatatagatatatattagttgtgctgaaaggagtttcatgtttaatatttatttatatattattaatgtaatacagtatctgtggggtatatgkttccaagacccccagtggatgcctgahactgtdgatagtaytgaaccctatgtatactgtgtttttttctatacatgcatacttatgataaagttttaatttataaattaggcacagtaagagattaacaacaataataaaatggaatagttacaacaatatactgtaagaaaagttatgtgagtgtggactgtccatctcaaaatattttatttattatgctatacttgagtactccttgtgatgaatgaggtaggtggtgcaggcattatgaagtactactattgccccagagggtgggtagcatctacagcatagatacactggaccac

SEQ ID NO: 32130 - DNA, 330 bp, Homo sapiens
ttgaaacatgctgcagatttgatagaggtatattatgtcttaggaaaatacaatgaagaaggtccaaatccctattgaggctggatgtctgatctgcactagacttaagaggatatatcatttcatctgcatgtaaacacatagggctgaatgtgatgtcaaaagggtttgccgttaataattttcttcaatgtaaacattcctaataattttgattgttgctccttagtcaatcatttcccaaaacatgattatttttaatatatgtaaaatatttaaataataaataataaaaggtaatgtgtccattttaaattttgttcccagccc

SEQ ID NO: 32131 - DNA, 344 bp, Homo sapiens
  misc_feature 321: s=g or c
tcaagcaatgagctgggaacccttctcctctatctaatgaaagactttataagcttgttgtgatttcttccttaagtgtttgatgtaatttagcagtggagccatctgttttctattttctatttcatggatttccatttacttcctttcatctgtgtttttcctcacagatttatttattatttaaatattttaacagtagagataaaaatgagatatacaggctgcatgttttaaatgtttcggcacatgtcatgtatgtatgtgtgtgtcacacactgtatctgccacgctaatcaaggcagcaaacatgtgcgtcasgccacggtctccctcctcccaca

SEQ ID NO: 32132 - DNA, 275 bp, Homo sapiens
accgacatttctgttgattgattgattatgcagattgtaaatgggtaatatatgatataattagattttacccatgacctttcatagaggtatttatttcatgactttttcagtttattctatagttattggtcttctcaggttttggataatatgataatttgtgttttccttaagaattgtctgttttgttcagtttaaaaaaattattagcaaacacttatgtatagaattttcttatgatatttgacttccatatgtgacaaaacccccct

SEQ ID NO: 32133 - DNA, 372 bp, Homo sapiens
tactttaggtcccaacacatatttaggggtaattcagccagcctactgagttatactcctctgtcatgacattagctagatagttcctacctggcattaggtagataagaagcagaagtccattcttcttgattcatactataaagacacataaacatccagatgttacatagagatggcaatttccagttacagaattattaataatttagttgaattaaaacatattgaatgcctactctgtacatggcattctattacatgtaaaatttagtaaatacaaagatggatagatcctttaggaacatacggtcatatgagagttacataaatgtctaaataactgtaatataggcataatgacatcagcgc

SEQ ID NO: 32134 - DNA, 248 bp, Homo sapiens
tcaagtatgtttggattaactctttgttgtcaaatttagtatggatttattcctggtgatttggacagattactttgaagtttcattttactcacatctctatatattagtgataaaaatctcttttaaaaatagcaaaaaagtggttctgattttgtactttggaggtaatttttcttttttacgaatgtcaggttcattaacaatagcaggattatttttactatagcttattttgtagagttagc

SEQ ID NO: 32135 - DNA, 332 bp, Homo sapiens
  misc_feature 33: s=g or c
  misc_feature 34: s=g or c
  misc_feature 37: r=a or g
  misc_feature 38: r=a or g
  misc_feature 64: r=a or g
  misc_feature 65: m=a or c
  misc_feature 98: r=a or g
  misc_feature 110: w=a or t
  misc_feature 160: r=a or g
  misc_feature 163: y=c or t
  misc_feature 165: w=a or t
  misc_feature 179: k=g or t
  misc_feature 240: s=g or c
  misc_feature 241: s=g or c
  misc_feature 265: m=a or c
  misc_feature 280: k=g or t
  misc_feature 299: m=a or c
ttttccgggatttctctgtaggtgaggcgggassctrragggagctgagcccccggggaggggrmccgattccgcctcgccgcgcctctggctgctgrgccgtgggtttwtctcttgtcctgggagtaaggaggacgacggcccctaacccctgaattarccytwctatttccattagkgacttagaagctacccggcgcctcatctgggctcacctgagctgaggatcaggaaggggassgggcacagtcattccctcgcggamgcggcgggaccccakcggacggctttgtgcggamtttcggcaccgttatgcccccctagcccgacga

SEQ ID NO: 32136 - DNA, 304 bp, Homo sapiens
  misc_feature 155: w=a or t
taattccaccagttgaagattttcctgtttgttcacctaatcaggcttctgttttggaaaatctgaggctagcggtacgatctcagcttggatttacttcagtcaggcttcctatggcaggcagatcaagcaacatttggaaccgtatttttaawtttggcaagatcacgtcattctgggtcattggctttggtctcagcagatggagatgaggttgtccctagtcagagtaccagtagagaacctgagagaaatcatactcacagaagtttgttttccgtggagtctgatgatacagacaacg

SEQ ID NO: 32137 - DNA, 287 bp, Homo sapiens
  misc_feature 112: d=a or g or t
  misc_feature 158: r=a or g
  misc_feature 163: w=a or t
  misc_feature 165: y=c or t
  misc_feature 167: k=g or t
  misc_feature 170: m=a or c
  misc_feature 178: k=g or t
tgctcaggatgttcaggaaaaatattgggaaggcaatctaattgaataccaaatgagtagcacagaattgttatagtagttcagaatcttgggacgagcttgtcattttagdataaatttggcatgacattggcatttacttaaattgtaattaatgrttcawtyckgcmaccttgtkactacatgattgccgataacaactttcgaaagggtattatttttgtgagtcactttccagactgatcagagaagatttatccagaatattattcatgattgtgccaaga

SEQ ID NO: 32138 - DNA, 159 bp, Homo sapiens
acaaagttttgctctgttgcccaggctggagcacagtagcacagtctcggctcactgcaacctctgcctctggggttcaagtgattctcctgtctcatcctcctgagtagctgggattacaggtgtgagccaccacacctggccattgtttttttaaaa

SEQ ID NO: 32139 - DNA, 458 bp, Homo sapiens
  misc_feature 158: k=g or t
  misc_feature 161: r=a or g
  misc_feature 301: s=g or c
  misc_feature 302: k=g or t
  misc_feature 432: b=c or g or t
  misc_feature 433: w=a or t
aatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtkggraggccctgaaacgcgcggagcttccctctgcctccaggctttcccagcgagagtgaaattaaacttgaaactcggatcaactggcagtcgttgttggtagaacgccctaaggacccctccccgcgggacggagggaggaskcgggacagggaattggccctgggagaaaacgcgcggggggcgtccgagacgccccgtgaaagccgtgccgacccttgggaggactgacaggtctagagacacgcgctgtctgttgtggtgggcctccggbwataagtgaggggctctgtgtttcga

SEQ ID NO: 32140 - DNA, 369 bp, Homo sapiens
  misc_feature 139: m=a or c
  misc_feature 140: m=a or c
  misc_feature 143: b=c or g or t
  misc_feature 150: y=c or t
  misc_feature 227: v=a or c or g
  misc_feature 228: k=g or t
  misc_feature 299: h=a or c or t
ttctgattcagtagttctttttgtttttgatatataataattgtacatacttatggagttacatatacattagatacatttatacaatgtgtaatgattaaatcagggcagggcaattaggatgttcatcacttaaaammtgbaacattyctttatgctgggaacatttcaaaccttctcttgcaactgctttgagatatataataagttattaactatagtcaccvkactgtgctatcaaacactagaacctgttccttccatctaactgtatgttttgaaccattaaccaacctcthtccataccccgcctcccagcctctggtgaccatcatatggttctctactccgttagatcaactttttttt

SEQ ID NO: 32141 - DNA, 426 bp, Homo sapiens
  misc_feature 142: y=c or t
  misc_feature 275: k=g or t
aacagaatgtgaaggacactggagagaaggccaataggaagcaaacaaaaacaggccaaggaaacccagtacagggggctgcagggcccagggagtgggtccctcatctctcctccccacgcttggccaggtccccaacctycccgggagtgcgtgggctttgaggctgtgcaggaagtgccggtggggctggtgcagccggccagcgcaaccctgtacgactactacaaccccgagcgcagatgttctgtgttttacggggcaccaagtaagakcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggc

SEQ ID NO: 32142 - DNA, 154 bp, Homo sapiens
ctactgtgtgttgtggtggcctgttggaggcaaatagatcagatttttttgtacctacgtaagagtacttgaagttttatttaaaataaaatgttgtggaaaaggtagcattctttttttaggagtgttatttttcactatgttgtggcacaaa

SEQ ID NO: 32143 - DNA, 440 bp, Homo sapiens
  misc_feature 341: r=a or g
  misc_feature 410: s=g or c
attgcagctcaggagacaagttggagagaaattggagatgaagttagtgcgtgacatatgggcagtgtaacataggccttatccaaaaggatgaacaaagagagcaggaggggaaggaggatgagaatagtgtgtgagaaagactgcgtgagaatggcgtgtgagaatagtatagtgtgttttggggaggccagaggacctacccattgcttcacattcttggtgccaactgtgaccgttaaatatgtggattctgtacatgcttcaagattgttcctggaggtcaagccttgtctgatattcctctctttttaaaaaattttattttggttttaaatagrgacagggtcttgttatgttgcccaggctggtctcgaatcctgggctcaagcaatccctcccgccttggsctctcaaagtgctggattacagttgtgagc

SEQ ID NO: 32144 - DNA, 372 bp, Homo sapiens
  misc_feature 136: m=a or c
agatatgtgtgggcagcatatcccaagcagagggaacagtcatacaatcttggaggctacaaggtgcttggtatgttctgcaaagagttaagaggtcagtgtgcctggagaaggtgcagcaaatgggacagtgatmgccataaggccagggcggtggcagacagccagatggtgtggagtcttgcaggccacggtaagaatgtgtgggttttgcattttacttagagtgaaaagagaaggattacagattgttgtgcagagaggcaacatgatctgatttatattttttaaaaatttctctgtggagtatatattgggggaggggagcaagggtagaagcagggagaactattaggaggctattatactagt

SEQ ID NO: 32145 - DNA, 448 bp, Homo sapiens
  misc_feature 289: n=a, g, c or t
  misc_feature 375: s=g or c
  misc_feature 383: s=g or c
cagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgaatttctccacattcttgcaaacacttgttattgtccatctttttgattatagcnattgttgtagatgggaagtggtatattattgtggttttgatttgcatttccctagtgactaatgatgttgagcatctgttcatgascttattascatttgtatgtctgctttgacaaatgtctattcaaatcctcttccatttttgaattgagtcaatt

SEQ ID NO: 32146 - DNA, 494 bp, Homo sapiens
  misc_feature 296: k=g or t
  misc_feature 297: n=a, g, c or t
  misc_feature 298: v=a or c or g
  misc_feature 299: r=a or g
  misc_feature 344: k=g or t
  misc_feature 345: b=c or g or t
  misc_feature 432: d=a or g or t
ctcttagaatttcatgtaagtgggctgggcaaggtggctcatgcccatatttccatcactttgagaggctgaggtgggaggatctcttgagccaggagttcaaggctgcagtgggccaggatcacaccactgcagtccagcttagtgacagtgtgagacccggtctcaagaaaaaaactttgtgtgtgtaaatggaatcatactgtacatattctttaatgcctggctgctttcactcgcatgtttttgagagtcctccatgttgctttgtgttccagtagtttgttgccttttaknvrtgagtagtattcactgtggtatggctataccacaatttgtttctkbattcacctgatatttgggtttccagcttttggctattatgattaaagtggcaatgaacattgatgtacaagtctttttgtggacttdagtttttatttctcttgggcaaataggagtagaatagctgagtcatatggtgtatattttgc

SEQ ID NO: 32147 - DNA, 383 bp, Homo sapiens
  misc_feature 174: k=g or t
  misc_feature 175: v=a or c or g
  misc_feature 203: n=a, g, c or t
  misc_feature 382: b=c or g or t
cattcttagttgaatccacagatgcagatcctgagggccaactgtgctgtcttgcttaaaatcttactgtggttttctgttcagtgtttctcaaaggctgagtttaaggatttatgttgagctggttgtatgaagcttgcttagctacctttatctgcatgattttgatgtgtkvccatgtttgggaaccactggcctaacanggtaaaaacatggtatagaaggccttctaattctggctcttggttattttctcaatctgatcctgttgcttcctgttttatactctatacttaagcagtaccaaactgctggcagttctgtggattccttgcatttttatttttgtgttcatttgtattttctcatttcctggaatgcba

SEQ ID NO: 32148 - DNA, 460 bp, Homo sapiens
  misc_feature 65: k=g or t
  misc_feature 66: w=a or t
  misc_feature 205: k=g or t
  misc_feature 301: m=a or c
  misc_feature 302: n=a, g, c or t
  misc_feature 306: n=a, g, c or t
  misc_feature 324: v=a or c or g
  misc_feature 325: v=a or c or g
  misc_feature 326: n=a, g, c or t
  misc_feature 352: k=g or t
  misc_feature 422: y=c or t
  misc_feature 424: s=g or c
caaaattgaagaagaaatgtagcccccagccggtacccaccaaaggagagaagaagcaatagcckwggaacttggggggatggcgaatggttcctgcccgggcccaagaggtgcacaggggcacctccatggctccattattaacacaactctagcaattatggaccataagcacttccctccagcccacaagtcacagcctggkccgaggctctcctcaccagccacccagggagtcacctccctcagcctcccgcctgccccacacggaggctctggctgtcctctttctccactccamnggcntggctctttctacacctvvntcttgggcatgggctgagggctggakcgagtccctcagaaattccaccaggctgtcagctgacctcttttgcctgctgctgtgaaggtatagctcyasccaggtcctcctgcagtgcggcatcccttggcagct

SEQ ID NO: 32149 - DNA, 443 bp, Homo sapiens
  misc_feature 73: y=c or t
  misc_feature 129: m=a or c
  misc_feature 139: s=g or c
  misc_feature 326: r=a or g
  misc_feature 401: v=a or c or g
aatcataggagttagagatggaaaagacatttggggtcagccagttcattcctccgccttctcctgcccctgyatttcaaatcattccttacattatattttctcccccagctcttgtacagttttcamgggtcttcastcaaccctggctgtcacctttggggaatgatgctggaggttgtctccagtttctcctcagcaaagagagatattgctgtgcccccagttgacattcatggacttctttgttggtggtctcagctgagaggctgaaggataactggatgcttctctgttgcctggtgatggggtgtttttagacagarttgaagagcatttagtgtatgatgatattgggcaagggatattgggcaagggctggggtgtagggtagccattgvtgaatttgttcctagacttttgttgttcaagtctcttgacct

SEQ ID NO: 32150 - DNA, 327 bp, Homo sapiens
  misc_feature 206: r=a or g
  misc_feature 238: n=a, g, c or t
caacgaatgacagttcttggtgctccacatccacaccagaatttggtattggagacaagtgttttaaagacatagtttgattgaatctgcggatgtggtagatgtgggtgggagatgtaacttccatctgtgtattttgacttaagtgagaaactgaactgggctggcaaagactgaattgacatcaaccaaatcctaattttatrccaggattcttcatttagatatcctcattcangtttattgtttggccattctaatgttaaatttcaggatctatcttaaacaaaataaggaaaatgatagagttttccatttctgggcagc

SEQ ID NO: 32151 - DNA, 183 bp, Homo sapiens
gggcggaggctggaggagccgccgagcggagacccgggagcaggagctgggcctaggtctgcgccctggagggaggtgtagaaagaggtacatggagaacaagtttgtcaatccatctgaacttcagttgccttacctgtaagcagccgtgtctgtgtttttgtctcgcagaattagagccca

SEQ ID NO: 32152 - DNA, 278 bp, Homo sapiens
  misc_feature 119: r=a or g
  misc_feature 170: r=a or g
caacaggaggaggatgtagagcgtcttgctccctggcttataagattcaggaaaggtttcctggaggaggggataccagaattgagtcaggggagaagacagaggagggaggaagaggrcttccaggcagaggggaatgtggggcccagtgtgtctcggggaactgggarcaggctgacgctgccagagtgtagtatgccgggcagggagtcctggcagccaaggctggagccatcatcaggagcaggttaagaaggctcttgttgcgaaggggagcg

SEQ ID NO: 32153 - DNA, 292 bp, Homo sapiens
aaattgaaaattcatttgctgtttcaaagtgtgatatctttcacaatagcctttttatagtcagtaattcagaataatcaagttcatatggataaatgcatttttatttcctatttctttagggagtgctacaaaatgtttgtcacttaaatttcaagtttctgttttaatagttaactgactatagattgttttctatgccatgatgtgccacttctgagagtagtaaatgactctttgctacattttaaaagcaattgtattagtaagaactttgtaaataaatacctac

SEQ ID NO: 32154 - DNA, 158 bp, Homo sapiens
tgaaaataaaatatgaaaatactcatgtagacaaaaatgccaactaacaaatgaagagtatatgatgaaaataaacccaagggggtgaggattttcacgtctggaatggcagaataaaatgttcagcagaccttaacaaaacaaccatttaaccggta

SEQ ID NO: 32155 - DNA, 418 bp, Homo sapiens
  misc_feature 407: s=g or c
taagtgtcttatgtttttaatttttaatttttaatttttttaagaccttttttttccccttttttgagatgagttcttactcttgtcgcccaggctggagtgcagtggcgtgatcatagcgtactgtagccttgaacttctagggctcaggtgatcttcatacctcagtttctggagtagtttggactacagttgttcaccaccacacccagcaaagaatgtgacaaaaagtactaagtgtgttttagctaagtatcgataagaaaagagtgtctttttatttattttttatttgtttatatgtactttttgagacagggtctggctctgtcgtccaggctggagtgcagttgtgtaattttggctccctgcatcctcagcctctcaggctcaagtaatcttcccascttggcctccg

SEQ ID NO: 32156 - DNA, 109 bp, Homo sapiens
taatgattagtgatgatgggcatttttcatatgcatattggctgcttatatagtttcttttggtgagtgtctattcatgtcctttggccacttcttctttttttttttt

SEQ ID NO: 32157 - DNA, 187 bp, Homo sapiens
  misc_feature 37: k=g or t
  misc_feature 97: k=g or t
  misc_feature 140: k=g or t
cttaattttagacaatcatgtcactgtttttaatgtktatttttttgtgtgtgttgcgtgtatcatgtatttatttgttggcaaactattgtttgtkgattaaaatagcactgttccagtcagccactactttatgacgkctgaggcacacccctttccgaatttcaaggaccaaggtgacccgtac

SEQ ID NO: 32158 - DNA, 294 bp, Homo sapiens
  misc_feature 148: k=g or t
  misc_feature 164: k=g or t
  misc_feature 183: y=c or t
  misc_feature 184: y=c or t
  misc_feature 202: k=g or t
  misc_feature 203: w=a or t
  misc_feature 221: n=a, g, c or t
  misc_feature 264: n=a, g, c or t
ttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgtkttaggggaatgatgakccatcgctagcaagttttyyaagggggctgtgacccakwagagttagaatcacaatntcttcatgctacagagaggaaactgaggcctagatgtcatttnggacccttcacaaccattttgaagcccata

SEQ ID NO: 32159 - DNA, 405 bp, Homo sapiens
  misc_feature 161: m=a or c
  misc_feature 383: n=a, g, c or t
agatcccctgcacgaaccaacaagtaagacacttgtaaaatcccaagagggcaaactgcaaattttgtaaatttccacgactacttttaacagaataccagtctcattaacaccaagaagaaattagaaaatgacgtttcccaactccaaagtgaagtggmagaagtaatccaagaatcacgcaatgcagaagagaaagccaagaaggccatactgatgctgccatgatggctgaggagctgaagaaggaacaggacaccagcgcccacctggagcggatgaagaagaacctggagcagacggtgaaggacctgcagcatcgtctagatgaggccgagcagctggcgctgaagggtgggaagaagcagatccagaaactgganggccagggtacgtgagcttgaa

SEQ ID NO: 32160 - DNA, 50 bp, Homo sapiens
tgactcatctatttttccttttatttcctaagattttgaggttaaataaa

SEQ ID NO: 32161 - DNA, 383 bp, Homo sapiens
  misc_feature 135: m=a or c
  misc_feature 238: s=g or c
  misc_feature 311: r=a or g
  misc_feature 313: r=a or g
  misc_feature 333: r=a or g
  misc_feature 355: r=a or g
  misc_feature 360: r=a or g
ggatggttcgagctttctctggatacttagctacagatcagctcttgcttttatgggatagaatcctaggatacaactctctggaaattcttgctgtgctggcagctgccgtgtttgctttccggagcaagtgamcctgatggaggtgacatcactggctgcagctgaaaatctagctgcccacagtgaacagttctgcactgctcctctattccctgagctttacagagtccagatsccatgtactgctgaactcaggcagaaagaagagtgcagtttattggactccaaatctcattcaacagaacaargragttgaggttgcaaggaagracctataatgatgggtcatggrtatarcctagaaaagaagagaaataaaa

SEQ ID NO: 32162 - DNA, 387 bp, Homo sapiens
  misc_feature 122: s=g or c
  misc_feature 126: r=a or g
  misc_feature 129: v=a or c or g
  misc_feature 130: b=c or g or t
  misc_feature 166: y=c or t
  misc_feature 167: w=a or t
  misc_feature 298: k=g or t
  misc_feature 305: k=g or t
  misc_feature 310: k=g or t
  misc_feature 350: b=c or g or t
attccagatgtattgaacttgatgacttcaatttcaaatgtttgtcaaataattttctatccatatattcagcctagcgtaagagttaagaaaatgggttttacaatcaaacagaactgagsttgrggvbtgacctactgggtaaatctgagcaagttattacatywttttaaacttccctgtttacacctatcttgtcttgagtagcccgaccaaagctattactttcctccagttgcacacttttccttcttgtttatgaaaagatcactttcacacaagtatcctatttctagtkttatttkctttkaatattggaatgtggcaaaatgctttttattctctaagcbacttgcttcactacttcaatttggtcgcccccaatta

SEQ ID NO: 32163 - DNA, 395 bp, Homo sapiens
  misc_feature 102: r=a or g
  misc_feature 119: k=g or t
  misc_feature 124: y=c or t
  misc_feature 131: b=c or g or t
  misc_feature 132: y=c or t
  misc_feature 141: r=a or g
  misc_feature 155: k=g or t
  misc_feature 273: r=a or g
aaaaacccttaaacattctgcactttaatatatcctgcattgtctagcaactgccttttcctttctgtgaagccttctggctttggactcttggaaatctartatttaccctgacttgkttttycgaatcbyggaaatgtrtttattagcctgtkatcagtatcagctccacccttagctaaagcgctcactgtctacacgtgttactaacatctggcctaagacattcattgtggccatgttcttataatagaagatatcacctttttcagragtttgtctgcatcacatcagctctttccaaggaactaaagattcctcatctctttatattttgcattgctgactaatttcttgtttcatgtctgaggcgcctccagtttctgcttttattc

SEQ ID NO: 32164 - DNA, 267 bp, Homo sapiens
  misc_feature 124: s=g or c
  misc_feature 125: w=a or t
  misc_feature 130: h=a or c or t
  misc_feature 133: s=g or c
  misc_feature 141: r=a or g
  misc_feature 147: r=a or g
  misc_feature 182: y=c or t
  misc_feature 250: r=a or g
tccctgcctctacccccaccccttttgagtcgggtgactcatttttctgtgtagagactcggtggcccaggcaggaggtgaaagcagccatccggaaggccctggggacccttgtgcctgttgswcggchttsaggtcacragctgrgctgcgataggaaaatctgaatggaggcagcaaayagccaaaacaaacattccccacccggccctgtgcatatgaagtctttcttcccccaactcttgaacgrtgatgatattcagacgc

SEQ ID NO: 32165 - DNA, 432 bp, Homo sapiens
  misc_feature 298: d=a or g or t
tcctattcagtttgggtgactaatccatcttgacatatgttctattatcagatgtacagatttcatatattattttatgtaggcgtatctaacaagaataccagaagataattatctttccagtgctgaggaaaatactttcttaaaaatgtctttaatatgtttatctttgtccttgaaattagtcattaggaatgaatttcctttttcctctgctcctcagtattcagttcttaatttgtctcttgactgtactggaagagtataatatgcattggtatccatgctgtatagttadtgcaaacaaataattgctatcttcttcaattcaagacttctcgtgggattgatgctgagaaggtgaatctggttgtaaatctggatgtaccattggattgggagacatacatgcatcggattgggagggctgac

SEQ ID NO: 32166 - DNA, 399 bp, Homo sapiens
  misc_feature 191: s=g or c
  misc_feature 355: r=a or g
  misc_feature 370: r=a or g
catcgttcatgccaacctggcaaccagtttgaaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctscactcaaagcctgaagcatgttggggtctcttcgtctctgtacgtgcccatttcagagtccagtctggtgggagagggaacagagtgggaaagaaaactagggtaagcagaaacgatgaaaccttataagagtgagattatcatgtacaagagtgagattatcrtgtacaagagtgagrttatcatgtacaagagatccaggaatact

SEQ ID NO: 32167 - DNA, 483 bp, Homo sapiens
  misc_feature 149: r=a or g
  misc_feature 287: r=a or g
  misc_feature 299: n=a, g, c or t
  misc_feature 300: n=a, g, c or t
  misc_feature 328: v=a or c or g
  misc_feature 329: w=a or t
  misc_feature 417: k=g or t
  misc_feature 418: k=g or t
  misc_feature 420: w=a or t
  misc_feature 446: r=a or g
  misc_feature 447: d=a or g or t
  misc_feature 450: k=g or t
ctgcttttagaagtaatatggtgatcatcagtttagattcactgtaggaagggcagccctgttaaagtttgtcaggagaaaaagggaaggtatcactttttgtatgttcacccagttgcttctgtagttttcatacccctgttttctcrattttcttagaactgtctttaatggcccagctctaccagggcttgttgtctaaggacattaacttgtgctcccctcagggatgggtttactactagctgtcagaaagctattgggtatcctaatgtgttaatagctgraactcagctgtnntttctcctaaatacttcagcattttgcvwtctgtacattgtggtgctttttccaccttgtattgttgtaactgtaagctcctagggggcagcaatttggtcttaggcgtgtaccctkktwgtgcctggcaatgcatgtttatatcrdggkcttaatattacttttgagttatttctccactct

SEQ ID NO: 32168 - DNA, 207 bp, Homo sapiens
aaatgcaggaaggatgtgagtaaaaccagatttggaatcatgccacttcgaatccaaacacatactgaaagcaggctctacactataacaacaaatctcgttaatcataaacagcctagacattctccataattctgccatggaattcaccattagataagattcaaattatagagatattttaattatttaatcactcatccagcc

SEQ ID NO: 32169 - DNA, 336 bp, Homo sapiens
  misc_feature 123: w=a or t
  misc_feature 130: r=a or g
  misc_feature 136: r=a or g
cagagaatcagacaatgttaagtttagagtttcatcttcatggaggtaccagttacggtcggggaatcagggtcttgccagaaagtaactctgatgtggatcaactgaaaaaggatttagaawcttgcaratttgrcagccaatcagcattcagatgttatctgtcaatcagaacctgacgacagctttccaagctctggatcagtatcattatacgaggtagaaagatgtcaacagctatctgctacaatacttacagatcatcagtatttggagaggacaccactatgtgccattttgaaacaaaaagctcctcaacaataccgcatccgagcc

SEQ ID NO: 32170 - DNA, 266 bp, Homo sapiens
  misc_feature 68: m=a or c
  misc_feature 89: m=a or c
  misc_feature 129: s=g or c
  misc_feature 135: w=a or t
  misc_feature 159: n=a, g, c or t
  misc_feature 181: n=a, g, c or t
  misc_feature 198: y=c or t
  misc_feature 199: n=a, g, c or t
aagcagctggggcctgaggtttctcccccagtaccctgggtcacctcagcccagagctggcggcaagmccccagcccctcatgtcagamccccctgtgtactgtaacctggtggaccttcgccgctgtsctcggwccccacccccaggccctgcatgcnccctgctgcagaggctggatgnctgggagcagcacctgynccccaactctggacgctgcttctacataaattcactgactggctgcaagtcctggaagccccccgct

SEQ ID NO: 32171 - DNA, 471 bp, Homo sapiens
  misc_feature 126: r=a or g
ttaatgcggtttgtagaactctgcaaaatcctgacctctgcctattttgtctctcaccaccattatcttgctctgtcttaacctcattcatgcctttgctacactggaattacttctgttcctagracaattggctcccaagcatgctgttctttctggaactctcttggcctgacgcagctcagatgtttctgagaggactaggttcagatctctgatttacattcccagagcgctatatccctcccctttttgcagcagaggccacccttggaactgatacatcagaaatagttttcctcctggattgtaagttcttgagagcaaggggtgttctttacacatcactctgaccttgtgtctagaaaaatgcctggcacagagcaagaccttcgtaaatatttgttgaataggaagaaaaatgaacaagtgcatgaatgcgtgaatgatgtagaagacaatccagtaata

SEQ ID NO: 32172 - DNA, 411 bp, Homo sapiens
  misc_feature 299: n=a, g, c or t
  misc_feature 300: n=a, g, c or t
  misc_feature 301: n=a, g, c or t
  misc_feature 302: n=a, g, c or t
  misc_feature 322: h=a or c or t
  misc_feature 323: n=a, g, c or t
  misc_feature 324: n=a, g, c or t
  misc_feature 335: r=a or g
  misc_feature 346: b=c or g or t
  misc_feature 348: n=a, g, c or t
  misc_feature 349: w=a or t
  misc_feature 357: n=a, g, c or t
  misc_feature 365: d=a or g or t
  misc_feature 371: v=a or c or g
cattaaatgacagtggcaatttctttgtaatccccttttccccatctcctcctgggactcagtatatgcagggatgaaaggcagatgggcaaagatcagaaagactactgaggaagaggtacagttatttagatatctgcttcctcatcttctttgggggcagcttctgtgatgaaaacactttatgaaaggtaagacccccaaatacctgttctgtagacattggggatgaaaatgtacatcctagcagatgatctggttctgcattccagaacactgctctgactttagaagcagtnnnntatgcatagtatatctacthnnagctaaaacaragagagaaatbgnwtgattganaccttctdattgcvaaagtatgcagaattgacattcaagcaatcttatgtaaaa

SEQ ID NO: 32173 - DNA, 225 bp, Homo sapiens
taggaatccttgtcttgctcctgtgactgggccttactttgagggttttgttagcagaaggcgggggttatggcataaaggtaagtgctaggacttacacctggccaaagaacagcgcggtccagagtgtgctagaatagttggcgccactggatgtgtggtgtggctgcgtggaatgtgtgttggtgtatgtatgtggtggtgatgggtgtttaaagggcaccc

SEQ ID NO: 32174 - DNA, 319 bp, Homo sapiens
aggatttcattatgttgcccaggctgatctcaaactcctggactcaagcgatccacccacttcagtctcccaaagtgctgggattacaggtgtgagccaccacgcctggccccatctttcctttgatattttatattttcttccttccttctttttaaaaatttgttttgttctttcttttcagcagacacatattaaactatatatgtcatatagcacggtatttaagatggtatttaagatgatggactctggaaccagttttgccaagattcagatcctagctcatttacttaccatctgtatgatttggggccca

SEQ ID NO: 32175 - DNA, 358 bp, Homo sapiens
ttctatattgtgcatttgttttctaatttattaagttcttctcttatcttattttcttccttctactttgcatttaattttttacttatttattgaagtgtagtataccataaagataaaaaggcacaaatagtaagtatacaattaatgcattttcagaaaatgaacatatctacttaagaaatagaacttaacaatacaagcccctcattattctctgcagccattgacccctttctgtctggaagataaccactatcctgccttctaatactatagattagttttacctatttttgaaacttatacaaacgcaatcatgtaggtattcatttgtgtcttgcttctttccctgaac

SEQ ID NO: 32176 - DNA, 289 bp, Homo sapiens
  misc_feature 168: w=a or t
  misc_feature 169: w=a or t
aaatagaatttaaagacctgaacttcttttatgatctttaatgattatttgttctaatctttgacttggaaacccaaattattttcagtctaacgtacttgaaatttaactattaaaaaagttggaggaactcaaactttgaagttagggctccctttctccagatawwgcacattgcctggtttattgtaaggcacttagaacatgtaaccaaaaacactcaatttaggaataggaatgattgttttacagctaagtgcgctctcagagtcttttgttttacacccct

SEQ ID NO: 32177 - DNA, 327 bp, Homo sapiens
gaacagggagaatggatgcggaagaatctccagtcagctgcccataccaaaaaatgctttccttccttgattaaaaaggatgactatttctagtatttatagtctctgctcccaaatttggaggctatcctgatatacatcaagagtaaatgtcatttatcaaaagaacacttgagtgtgccactagtgtgatccctgctgtaacgtacaggaacacaactctagaactggaaaggaagagacatgggtttccaggacacacaaattttaaatgaagattaataggaaaaacaaagatacatcatattcttcacctgaccttcacac

SEQ ID NO: 32178 - DNA, 232 bp, Homo sapiens
  misc_feature 56: k=g or t
  misc_feature 57: d=a or g or t
  misc_feature 168: n=a, g, c or t
ctatactattacacaagaaggacaagcctcaattcgccttctctgtgccttctgtkdatcagagagagcctgtctcttgtgatcaatgaaaagttttattaccccaggcatgctcaacagtcctacgttatgtcagcattttgtaggaaaagcattgaaggagcctcngaatatgttttccaccacctacatcattcattatatggataatattgttttggccactcccaca

SEQ ID NO: 32179 - DNA, 332 bp, Homo sapiens
caagatagtatctcatctggtacagaaattgttttattgcagcagaaaaaattagcaacaggaaaatgtttcagtatgctgaaggtgtaaaaaaaacacataaagtggcaaaaatgggttttattaggttaggaataaagcctgatctaaatatcttagacttgtatatttttaaaagatatcttaaatacatgaaagacacgcagcactatgcttagaatgtgaactgttggcttggtttagaatcagtcgctaaaagcaagtagaggtttccagagccagtacttgtacttctgggaaattgtgcccttcacctaggtgtctgaattttt

SEQ ID NO: 32180 - DNA, 245 bp, Homo sapiens
tacaactatctgatctttgacaaacctgagaaaaacaagcaatggggaaaggattccctatttaataaatagtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcacgggcaaggg

SEQ ID NO: 32181 - DNA, 462 bp, Homo sapiens
  misc_feature 137: k=g or t
ctttttacccttaggaacagctttttgcccttagcactatgcttgggggccattttaaacagtgaaatcaaaaaaagaacagaaatgcaaaaaccatggcattagcgtaaaaaggacacgtttatagtatgaaagckggaacatggccttgttcaacctcagctcagaatatgtgtacagcaagttttttgctgtaccacaaaattttaggttaggcaaattcacaaatacggaatccatgaataacgaggatcaactgtactaactatatttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcactta

SEQ ID NO: 32182 - DNA, 426 bp, Homo sapiens
  misc_feature 131: s=g or c
  misc_feature 136: d=a or g or t
  misc_feature 138: k=g or t
taggagacttttctagttggaagatcttgcacaaatgtgtagggttgatttccatgaacaggttgttccctgaaaggtgagctgtcttccccggtccgttccatggggcttgctccctgcatgtaggcagsccttdgkttccttgcctttggcctacctctcatctctttaatgaggcaagaacaaaagcaaggcgaactgttactgtcaactactgtgatttaggcagatcctcaacaccatttggctttgtgtagatactgctttatttatattatttattgttcaacaaaaaatctgaaatatagaagtcatgatgcccattttaccaatgaggaaatctgaatcttggaaagaataccttgtgcccaaggtcacaaagtcaagaaggagagacacacaatttgcatccaggtctgtctgctt

SEQ ID NO: 32183 - DNA, 244 bp, Homo sapiens
ttttttagctgattagtgatcattagtagttagtgtatattacatgtggcccaagacaattcttctgcttccagtgttttccagggaagccaaaagattggacacccctgatttagatctttgtgtatatgtttaactttggttttcttgagcaaaatttttggactctaattattaaccacccttttgaagactacaggagtttctccctatcccgctttgcttttaggaagatcatcttaga

SEQ ID NO: 32184 - DNA, 90 bp, Homo sapiens
  misc_feature 12: m=a or c
  misc_feature 25: m=a or c
attttgcagggmagtaaatcaccgmaaactgtttatgaactggcatcccttcttcgaaatgtaaagcgcaggacctctttaagtggtggt

SEQ ID NO: 32185 - DNA, 119 bp, Homo sapiens
ctgaagggagatttcttgaggattctcatttttttaagtcttatctaataagccatgtactagtggatatattaagcaggattttaattatatttaaacttttactttttttttttcct

SEQ ID NO: 32186 - DNA, 256 bp, Homo sapiens
  misc_feature 166: k=g or t
aagaagctgtactgccaagaacttaaaaaggtatcttagcctaggtgattgaagcctccgatgttgtcctagaggtgttggatgccagagatcctcttggttgcagatgtcctcaggtagaagaggccattgtccagagtggacagaaaaagctggtacttatatkaaataaatcagatctggtaccaaaggagaatttggagagctggctaaattatttgaagaaagaattgccaacagtggtgttcagagcctc

SEQ ID NO: 32187 - DNA, 467 bp, Homo sapiens
  misc_feature 90: k=g or t
  misc_feature 91: s=g or c
  misc_feature 92: k=g or t
  misc_feature 164: w=a or t
agttctgtgggggcagagagagccctggcctctcatatttcataaaatatgaacttttcccggcccacatccctaggccttcctgatgcksktgcctgctccctggtctctctgcatggggaaggagtgttcccagcttgcaaactccagctttgcctgtgagwggaacaagtgtccctgatccagaaggtgttcggatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacgtacccaaggaggtgaggtggctgcggtccccattcccgcagcgctcccaggctgttcacatattccgggatgggaaggacaggatgaagatctgat

SEQ ID NO: 32188 - DNA, 283 bp, Homo sapiens
  misc_feature 106: v=a or c or g
  misc_feature 254: y=c or t
  misc_feature 259: k=g or t
  misc_feature 270: r=a or g
  misc_feature 272: r=a or g
taggtgctaggtatactcttggctagattgattcagctcagaattttgactttttaaagctaagtccttgtagtcacatggttgacttgaaggatgaggtggtgtvtgcatttatgagcttttcctacccccctgaagaaacttcattggcctcctggttactcaccttgaagagagtaccatccattttagtgaaaaacacatctgtcacctaggacatgacatggttgcagttgacaggaaaaaaaaaatcycattkagttgttttararttggtggccca

SEQ ID NO: 32189 - DNA, 339 bp, Homo sapiens
  misc_feature 5: y=c or t
  misc_feature 130: w=a or t
gttayggctaatacatggtcactaaatgttggctgtttttgctgtcattctcctgctactacgatgatcacaactactgtagtgatactggtgaaattcaatctcacctaggtgcatttcacaaagagtwaatatttcagcagggccctctggagaagaatcatcatttcatcagaggggaaaaaaaggaggagcattctaggtacttcaaaagataaagcttagccagtcaggaggggcaagaagtatgaaagagaagcagccagcaaagtgatctggggccagattttgaaaactttcctgggcactatgctgcattcactctgcagagaggcacat

SEQ ID NO: 32190 - DNA, 418 bp, Homo sapiens
  misc_feature 126: s=g or c
  misc_feature 130: w=a or t
  misc_feature 270: m=a or c
  misc_feature 271: d=a or g or t
ctgttttgaatacattacccctgcccacagttgaacctggtatccttcagtcaaagtatctctggtaaacttttagagacgaaacttccatgcctctttgggaaagagggaactacccaactgtgsaaawtttaaaggaggacctggcatattaactatttttgtaaaaacatatttaggcagcttcctggttcagtcttcccttcactccaactttcagtggtactcagtatgcccaaacccagagccatcaggggaacaagttggttmdttcttggtttcactcttctgctggcttaaacttccacttacttgggtatagttatacactcactgctcttccatttgctttccatgttccaaaaagtttcttgctgtcttatttgctcccattctctttgtcctatgagtttgttct

SEQ ID NO: 32191 - DNA, 404 bp, Homo sapiens
  misc_feature 194: n=a, g, c or t
  misc_feature 379: d=a or g or t
  misc_feature 380: k=g or t
  misc_feature 382: m=a or c
ctagttaaaagtaagtgggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgnaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccadkamcccgagtacttccagcaaccga

SEQ ID NO: 32192 - DNA, 264 bp, Homo sapiens
  misc_feature 153: d=a or g or t
  misc_feature 154: w=a or t
  misc_feature 165: k=g or t
  misc_feature 244: s=g or c
ataccggagcctgcagcggccctgttgcggtctcagtcttcagcccgacatcatgggggcgccaaagcacaggggctcaaaatggtgaggccggggaaccgggcgctcccatctctgtctacgtagatacctagtcaaaccgaaggggaagcdwcctagcatccktaagccctcctttccatccggtctgcatttccacttttcattgcaatctgcttctcttctgcaccgccccctctcctcscccacccttctcccgccgcc

SEQ ID NO: 32193 - DNA, 444 bp, Homo sapiens
  misc_feature 155: s=g or c
aaaatctcaagtgaatgacgaatacctcttgcaggtaatttaaatcctctggcctccctcccaaagtccttagatagcacgccccatcccatagcaccatgtccttgctgaccagcagagcggggacagattagcacacagtccctccagcgcasaatgtggggacacattagcaaggaggaggtggcaacatggacagaatagcttgctcctgtttctgagttttgtagcaggtgtgtttttgtagcaggtgagtaaggtatgtattttctcgctctatcagtgctttttttaagcattccagggttaaagacctgcatacgcaactaaaactcttgtctcctgggaaatgggagtattaattccctctgggctcctgttttttgttttgttttgttttgttttgttttctgtctgtaaaatgaggatgttggccaggcaccg

SEQ ID NO: 32194 - DNA, 459 bp, Homo sapiens
  misc_feature 125: w=a or t
  misc_feature 127: m=a or c
  misc_feature 136: r=a or g
  misc_feature 244: v=a or c or g
tctgtatatagtcttggaggttatgatttgccacagattggttggatcacatacatttaaggatcatattattaaataatatatgcacagacatggagagaattagtttttactaaaacatttawcmgaaaatttraatactctgcataaccagtattagcattagaaattagccacttttagaatgagaaaactgtgtcactcttcaatttttttataagccattgaggaaaacattaactcvtggatttcagcttcacttttaacctgcagactaaatttctttctcaattatgtcagacacacccaagtcaatcccaacccccttgttaccttgggaagaccgtgctgaaaaaggagatcttccacctaaacagtgttctcttatttgaagcaaatctttttgagaatttgtttacttgatttctttccacaataaactgacagagaacgctacta

SEQ ID NO: 32195 - DNA, 445 bp, Homo sapiens
  misc_feature 127: m=a or c
  misc_feature 129: y=c or t
  misc_feature 135: v=a or c or g
taaaaataatgttgagtttattatacttttgacctgtttagctcaacagggtgaaggcatgtaaagaatgtggacttctgaggaattttcttttaaaaagaacataatgaagtaacattttaattamtycaaggvctacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgctt

SEQ ID NO: 32196 - DNA, 297 bp, Homo sapiens
  misc_feature 128: m=a or c
  misc_feature 132: y=c or t
cctagtattgtaaaagctggccaagggtcaaacatttgtgtgctttcaagatagcatgtagtgtttaaatcccttccttaaccaaagttgccattgtactgtgaaggaggttcagagcaaaggtcacmaacytaaccgagacatcacattcccccttccctcttgatatgttctctttgacttgcttgatggtttttttgaaagaacatgagttagttgctagtaatagcaaatttcacaaagaaattgagatatctggcttttcttgaaagctcagatctggaaaacctagggcca

SEQ ID NO: 32197 - DNA, 428 bp, Homo sapiens
  misc_feature 324: n=a, g, c or t
  misc_feature 344: n=a, g, c or t
ttttacaatggtggaagcaactttctgaaagttcagtcttatgctacatcctaagtcatagacaatgaccttgttttcattattctgatagattgtatacatatgtacacatacatatacacatatgcacagtcaaggtcatgatgttgatttgctttcagctgtttctgtgattataaagcattttttaagagacaaattttaacttttaatttttattttggcaaaactgtcaaatgagaaaaatgattttaaaaacttttttttcaattgacaagactttaagtcagggataacagtattaatgttctctgttctgtttcnatgttaaatttaatttaacntggatagccacattaatgaattggtgctgtcaaaatatagtaatttttaaatttgttaataatgaaaacccttaagcatgcagt

SEQ ID NO: 32198 - DNA, 441 bp, Homo sapiens
  misc_feature 394: n=a, g, c or t
  misc_feature 395: n=a, g, c or t
  misc_feature 396: n=a, g, c or t
tagtttatagtactgagaggaagaagctagggaggcacccttttagtgccttctgtcctggtactgttttcattcttgaagtgctcttttatgatatacagaaacatttcctcatcctcttggtgatacaaagtttcttgggccactattttcagagaaaactaagctgtactaagctggaaatattggctgagggccattttgctcagatctctcctcccatctggacttcgtgcccccgtgcattcttaaacaccaaatcacaaccatttctcacctgctgaagtgagaaacagttttctggctgtttccgatgttagcattaaagatcagatttctgtatgtgacttgcctttctccaatggaaaaggtgcccatttctgatatttacacnnnctacagatatatttatagtttctcttggatttcgggtaatagcta

SEQ ID NO: 32199 - DNA, 295 bp, Homo sapiens
  misc_feature 71: n=a, g, c or t
  misc_feature 72: r=a or g
  misc_feature 73: h=a or c or t
  misc_feature 129: n=a, g, c or t
  misc_feature 148: d=a or g or t
  misc_feature 176: h=a or c or t
  misc_feature 177: h=a or c or t
  misc_feature 178: h=a or c or t
  misc_feature 179: h=a or c or t
ccagagtacttgttttcccgatgtgtccagccagctccgcagcagcttttcaaaatgcactatgcctgatnrhtgatcgtgttttaactttttcttttcctgtttttattttggtattaagtcgttgcntttaatttgtaaagctgtdataaatatatattatataaatatattahhhhggaaaatgtttcagatgtttatttgtataattacttgattcacacagtgagaaaaaatgaatgtattcctgtttttgaagagaagaataattttttttttctctagggagaggtag

SEQ ID NO: 32200 - DNA, 347 bp, Homo sapiens
  misc_feature 155: r=a or g
  misc_feature 328: r=a or g
  misc_feature 332: r=a or g
gaaaggaagctaagcagtgggtacctgggatctctctgaactatttttataacttcttgtgagtcttaagtatttcaaaataaaagtggtttaaagtaaattcatagattaaatgtatcattatctatatataaacccatgatttaaaactttarttttctaaacatagtattcaacttagttgaataaatatatgatagaagttaaatagaatttttatttcattcttaagaaaaactcatgtttgtaacaaatgatatctaaagatctattttgccttaccagaaaagaaaaaaaaaaccctaaaaccaaaaactccttttccctrggargtcaaaaatgctgta

SEQ ID NO: 32201 - DNA, 131 bp, Homo sapiens
catataatcctcactatcaccatccaggcagaaaatatcacatagcctttattttatagatgaggaaactgaggcactgagaggtcaagtctcttgcccatggttgtacagtttccatgaaatagcattca

SEQ ID NO: 32202 - DNA, 248 bp, Homo sapiens
  misc_feature 89: d=a or g or t
  misc_feature 142: k=g or t
  misc_feature 157: r=a or g
  misc_feature 171: d=a or g or t
catttataaatatttcagtagtttgggtacttaaaaaatacataaccacaatagtattatcatgcctaaaaaatttaacatgtaataadatattcagtcagtgctcaactttctaatcatgtttttagactgcttagcattktgttgtggagatggrtcataatatatttdaccagttcctgttgatgaagcttgaggttatttctaactttccaactgataaatagtgcttcaataaacatccttat

SEQ ID NO: 32203 - DNA, 417 bp, Homo sapiens
  misc_feature 151: r=a or g
  misc_feature 276: v=a or c or g
  misc_feature 388: d=a or g or t
  misc_feature 389: w=a or t
tatttttgttatcggtctttaatctgattgatttgtggtcagggcacatactttgtatgagttaaatccttctgactcaatcctttaattgagagttgttgtatggcctaaaatatggtctattttggtaagtgttccgtgggtacttggraagcatagtgttgttcaagtctattctcgctgattttctgccttcttgttctatcacttattgagtaaagggtattgaaacctcagattacctagaaattgtctgtcactttttgtagttctatvcactttggtctcatatattgtgaggctggtttgttattaggggcataaagactgaggattgttatgttttgttgattaactgaaccttttactattgtgacatgacctttgdwatttattgctggaatgtttttttttttt

SEQ ID NO: 32204 - DNA, 425 bp, Homo sapiens
  misc_feature 139: w=a or t
  misc_feature 153: k=g or t
  misc_feature 164: d=a or g or t
  misc_feature 324: k=g or t
  misc_feature 347: k=g or t
  misc_feature 382: k=g or t
agtctggccgcagtcgcggcagtggtggcttcccatccccaaaaggcgccctccgactccttgcgccgcactgctcgccgggccagtccggaaacgggtcgtggagctccgcaccactcccgctggttcccgaagcagwtcccttctcccgakagttgcgagadactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgakatgcccctgggacacatcatgakgctggacctggagaaaattgcctggagtacatcgkgccctgtctgcacgaggcaatggtggcttgctatccgggaaat

SEQ ID NO: 32205 - DNA, 186 bp, Homo sapiens
  misc_feature 133: k=g or t
tacaaaagttagccaggcctggtgatacacacctgtcatgccagctactagggaggctgaggcaggagaatagcttgaacctaggaggcagaggttgcagtgagccaagatcataccactgcactccagcctkgggtgacagagtaagactccaccaaaaaaaaaaaaaaaaaaaaaaaaaaaaaa

SEQ ID NO: 32206 - DNA, 215 bp, Homo sapiens
  misc_feature 133: r=a or g
tcatgacctcaggtgatctgccccaccctcggcctcccaaagtgctgggattacaggcatgagccaccgcgctgggccttattttatttttaagagatagagtgttgctttgttctccagcagaagtgcagtractcagtcatggtccactatagcctggaattcctaggctcaagtgatcattctgcctcggcctcccaagtagctggaactac

SEQ ID NO: 32207 - DNA, 464 bp, Homo sapiens
  misc_feature 132: w=a or t
  misc_feature 137: y=c or t
  misc_feature 228: r=a or g
  misc_feature 229: r=a or g
  misc_feature 266: d=a or g or t
  misc_feature 432: k=g or t
ttatgaacaataagtctgatgagattagcctgggagtggtgtcctgcagctgtctaatctagttagagtggcattaacattctaatctccttgagaatgccttttatagtctgttcaaagcaagtcattgawgggtycttcgaggtagtgttaactgaagtgttcttcagtttgtcaagataatgttcagtgcttggcacttaaataacattttttgcaagaactccrrggcacattattgaatgcctttaaccaagtgcattctdggaagtttgcttgactcattatcttgcttttctgcagcattctgtgatttgagtcatccatgaatccatgaataaaagttacattctttgattggtaatattgccatttataacaagactcactaatgagggtatcactttgactgactgatttgttaaagttttkaagcctctcattttcctaacccagaaatcaca

SEQ ID NO: 32208 - DNA, 321 bp, Homo sapiens
catgctcatgggtaggaagaatcaatatcatgaaaatggccatactgccccaggtaatttatagattcaacgccatccccatcaagctaccaatgactttcttcacagaattggaaaaaactactttaaagtcatatggaaccaaaaaagagcccgcattgcgaagtcaatcctaagccaaaagaacaaagctggaggcatcacgctacctgacttcaaactatactacaaggctacagtaaccaaaacagcatggtactcgtaccaaaacagagatatagatcaatggaacagaacagagccttcagaaataatgccgcc

SEQ ID NO: 32209 - DNA, 491 bp, Homo sapiens
  misc_feature 271: d=a or g or t
  misc_feature 386: n=a, g, c or t
  misc_feature 489: b=c or g or t
ggagtctgggcgtgaccttgcacctgaccagcctggggctctaggtccgccacatctggactaatctcctgtgtcctgagctcccaggaccccagaggcaagcatggaggggccacgctggcaggtaaagttgaaacccacagtggcttaggacgagctcctgcacagcggcctgtttcccaattgcatcgtgtatctctttgcctctcttggctcagccatggccccagccccaggccatccaaggggcagcctggtgaggtttcttcadctttgctaatgacttgacctacagtcttaagtcaagaaggtgtcgctctcctttgtgatggctggacgcacaggagctgtggtcaggatggggctagaggagctgaaatcccagngcaacaagggtatttaaaaacacatcgcagagaaacagctaaagagtcttggaaccaggaatcataagctgtttgatgggatgaactatcttgggagtgagcbca

SEQ ID NO: 32210 - DNA, 353 bp, Homo sapiens
aagagtgtgtagaagtggaaatacgtatgcctcctttcccaaatgtcactgccttaggtatcttccaagagcttagatgagagcatatcatcaggaaagtttcaacaatgtccattactcccccaaacctccctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccacc

SEQ ID NO: 32211 - DNA, 476 bp, Homo sapiens
  misc_feature 132: r=a or g
  misc_feature 133: r=a or g
  misc_feature 300: w=a or t
  misc_feature 301: n=a, g, c or t
  misc_feature 302: n=a, g, c or t
aatattcctagagaaatatatgtatctaattcatcgtagttaaatagaagcatttggttgtatatgtattgtctcataatttaatgaccagtaattttttatcagtaatttgtttatagtattcctctatgrrgaccatggtgttttgtttatatccttcttcttttttaatgtataatcaaattcttattattttctattttattactgtcttttcacctttcttttcctatttgtgtcagaatttttaaggggccctgagatagctttgcttcgtaagcgcctgcaacaactgaggcwnnagaaggctgagcagcagaggcagcaagagctagctgcacatacccagcaacagccttccacttctgatcagtcttctcatgagggctcttcacaggaccctcatgcttcaggttattaatgtcaagtgtccttaagcagctgatagaattgttttttaatactgctactgtgta

SEQ ID NO: 32212 - DNA, 141 bp, Homo sapiens
  misc_feature 138: r=a or g
tcatgcatgtctaacctgatttacctcttacctgtaacctaccttatcatgtggcttttaattggcagtcactcgccatttctaagcagatatagtactacctttcagaactcacattggcaagtgtaaaaaggatgrcat

SEQ ID NO: 32213 - DNA, 118 bp, Homo sapiens
cattagtttaagctgtataattcctttcccttcctacattcttgttttcattttttcggaggaagaggagttgctagtactggcattggttttcctttctcttttttttttttttttt

SEQ ID NO: 32214 - DNA, 91 bp, Homo sapiens
  misc_feature 21: y=c or t
  misc_feature 30: y=c or t
  misc_feature 55: m=a or c
gagggctgtgtgtagcgatgygtgtggggytcggagccgcgccggcacagccgamgggagcgggcgagcggcgacggcggcggcggcgggc

SEQ ID NO: 32215 - DNA, 189 bp, Homo sapiens
  misc_feature 141: d=a or g or t
  misc_feature 144: k=g or t
  misc_feature 147: k=g or t
aatagaggttacttgatttagggtgggctttgtttgtttgtattctaacacgaagttcatacatttggctcacctaggcagaactcttgagaggaacttggtaattgcattgatttgttatttttgcttttttgcattgtdaakgaktttatagttggaagacttagaaatagatacaaaaactggcac

SEQ ID NO: 32216 - DNA, 428 bp, Homo sapiens
  misc_feature 130: r=a or g
  misc_feature 131: m=a or c
  misc_feature 144: r=a or g
  misc_feature 148: s=g or c
  misc_feature 428: n=a, g, c or t
atgagatcctgtcttttgcagggacatggatgaagctggaagccataaacttcagccaattaacacaggaacaggaaaccaaacaccacatgttctcataagtgggaactgaacaatgagaacacatggrmacggagggggcaraaasacacaccggagcctgttgggaaggtagggggaaggagagcatcaagataaatagctaatgcatgtggggcttaatacctaggtgataggttgataggtgcagcaaaccaccatggcacatgtttaactatgtaacaaacctgcacatcctgtacatgtatcctggaacttaaaataaaatagaaaagacaaagaaggatattacataatggcaaaggcttcaattcaacaagaagacctaactatcctaaatatatattcatccaacacaggagcgcggn

SEQ ID NO: 32217 - DNA, 449 bp, Homo sapiens
  misc_feature 132: y=c or t
  misc_feature 254: d=a or g or t
gagtgtctgggccagagtcgaaagcagaggagggtcaccctcttagtgcatagagcaaatcgggggaggtaacgtccctgagtcacgcctcgtggaagaggggaagggctgctttctactttctcgttctcyttcaaagaaggatggcttctaaatctggttttccgatttttcccttctcctttcatgactcacaggcctctgtgtccaccaggtgttttgtttgtttttaaagagtttctaagctttgtgtdcttggaagaacctcatatgccccataaaggaacttttctctgaagtagaggatcgctttttgggcccagactcctttgagaaaatctggaaagccaaggttgttcttttaaagaattattgaagacgaaggtttttttctttttatttttttaatggctttacagaatcttaaatagaatacagtttgacatgac

SEQ ID NO: 32218 - DNA, 440 bp, Homo sapiens
  misc_feature 126: r=a or g
  misc_feature 132: v=a or c or g
  misc_feature 260: s=g or c
  misc_feature 301: h=a or c or t
  misc_feature 302: n=a, g, c or t
  misc_feature 306: d=a or g or t
  misc_feature 307: r=a or g
  misc_feature 312: s=g or c
  misc_feature 314: n=a, g, c or t
  misc_feature 332: y=c or t
  misc_feature 406: v=a or c or g
  misc_feature 407: n=a, g, c or t
aactgtgatcggaaaagaaaaaaaactgtgaagccaaaagtcatgttccctcagtctaccactgtaaaaacagagtctaatatgggaaaataaatatgaaaatagcatgaaatgctgtttcccagrttggcvagataagaccagaacttggtccaagagccagccacccagggagactcctgctttccacagaggagaccaggttcctgtcgtgctggttgttcgtgtcaggcagtcctgcaaactttgagtctgcgcasgtgccagaatagcttgtgtttcagtcctgtgtcaagaagchngtgdraccasangttggagaaaagcatcayacgtcgacttacactttctcatttcccacgttccagtctcctgggaagggcactctttcgccacgttttcctgvntcttggcaaatattaactctttgcagatcacta

SEQ ID NO: 32219 - DNA, 105 bp, Homo sapiens
tattgctccctgatgttgtgttatatattcatgtagtataatttgtcaccttcacaagaaccacaaggggtgacaccatttgtttacagctctatcccacccctc

SEQ ID NO: 32220 - DNA, 412 bp, Homo sapiens
  misc_feature 129: r=a or g
  misc_feature 372: r=a or g
ataacagaaattataacaaactatctctcagaccacagtgcaatcaaactagaactcagagtttaaaaacttaaaaactcactcaaaaccactcaactgcatggaaactgaacaacctgctcctgaatraaaagtgggtatataatgaaatgaaggcagaaataaagatgttctttgaaaccaacgagaacaaagacacaacataccagaatctctgggacacatttaaagcagtgtgtagagggaaatttatagcactaaatgcccacaagagaaagcaggaacgatctaaaattgacaccctaacatcacaattaaaagaactagagaagcaagagcaaacacattctaaagctagcagaaggcaagaartaactaagatcagaggagactgaaggaaatagaggcagcg

SEQ ID NO: 32221 - DNA, 331 bp, Homo sapiens
  misc_feature 136: w=a or t
  misc_feature 137: r=a or g
  misc_feature 141: r=a or g
  misc_feature 152: k=g or t
  misc_feature 154: k=g or t
  misc_feature 158: k=g or t
  misc_feature 246: k=g or t
  misc_feature 253: v=a or c or g
agaaaatttgtttacttacccattagtaagttcctgcatattcattataagatggcaaatcaaacttttctaggatgaagacagcttatttttaagttgtatagtcttagttggtttagggtctcaattttaaatwrgtaraatacttggtktktatktgcttgtccttttgaattcctgttttaataattttaaaatgagcacaaagaatgttgaagttcagattaatctcttctgaatgatgtktttttcvtctgtgatgagttgtttctgacttttttccttttgtatttgtaatgttgattaagatgtaaaataaaaagtgtgccct

SEQ ID NO: 32222 - DNA, 182 bp, Homo sapiens
aaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacatc

SEQ ID NO: 32223 - DNA, 297 bp, Homo sapiens
  misc_feature 43: r=a or g
  misc_feature 51: r=a or g
  misc_feature 135: r=a or g
  misc_feature 136: w=a or t
  misc_feature 179: r=a or g
cttagtgaccttgggtttttccatgacaaagaaggagcctgtrtcgggggraggttacagcacctcatgttgtagccatcaactgtcagatctggaaaactcaattttgttggtacctgagaaatgctatccaarwcatgctatccaaatacaagacttggaaatataaattagattaraacacgatgtactgatttacaatgaaaattataactcgtacggatcagaattcttctgtgtttcatgctgttctcaagtctgtttactcagtctttctttggataagaaatactttta

SEQ ID NO: 32224 - DNA, 220 bp, Homo sapiens
attttcctttttgtttttgttgttgatgtgaccgcgtgtccacaaccctgggattccctcgccctcagattccagaatccaatttcttggatttcagtgtttttaagctactcgggaggctgaggcaggagaatcgcttgaacctgggaggcggaggttgcagtgagccgagacaccattgcaccccagcctgggcaataagagcaaaactccgtctggg

SEQ ID NO: 32225 - DNA, 153 bp, Homo sapiens
atttaaaaccattatagagacagttagagtgcctacttttttttttatttttttgagacagagtctcgttctgtcgcctaggctggagtgcagtggcgctatctcggctcactgcaagctccgtctcctgggtttaaacaattctcctggatg

SEQ ID NO: 32226 - DNA, 223 bp, Homo sapiens
ttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcaga

SEQ ID NO: 32227 - DNA, 197 bp, Homo sapiens
  misc_feature 128: r=a or g
tgcgattgctctgtagcacccagagatggatttgagggctgggctgtgaaacccagtgactttggcagacatatgataagtctgtacctttacacaaaagttcaaagataagattgttgcaaataggrtatattggaatgaagacatgtatgtaaatgccagggagttaggaccatagatcgttttgagcagaaggg

SEQ ID NO: 32228 - DNA, 409 bp, Homo sapiens
  misc_feature 303: n=a, g, c or t
  misc_feature 304: n=a, g, c or t
  misc_feature 347: h=a or c or t
  misc_feature 348: n=a, g, c or t
  misc_feature 352: n=a, g, c or t
  misc_feature 370: n=a, g, c or t
caaaataaagtggaagaaggaaaacaacaaaaaatattaaatcaaggaaatagaaaacatagatgaaaattacgtcaatgaaatagaaaacatagaaacataggaagaacaaaaatgcaaaaacttggttctttgaatagactaacaatattgataaatcttttatataaggttaatcataaaaacccatgaataactctatcgagaataaaactatatcaggaataaaaatcatataaggaataaagaaacagagacttccctcagattctacagaaatttaaaagattgcaagataatatnnacaactttgactaaatgtgaaagtaaaatgggctgttactgghnaagnataacttaccaataatgncccaagaagaaatagaaaacctgagtagtcttatatcca

SEQ ID NO: 32229 - DNA, 210 bp, Homo sapiens
  misc_feature 134: m=a or c
  misc_feature 160: k=g or t
gtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagmaccagggccgggtatcaattattgcktgctgtttgcaaccaggcataaaatcactttctcaaatcatccaccgcat

SEQ ID NO: 32230 - DNA, 183 bp, Homo sapiens
tttccggagtagagcccttggaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggagt

SEQ ID NO: 32231 - DNA, 299 bp, Homo sapiens
taggctgggtgcggtggcttacaccctgaaatcccagcagtttgggaggctgagttgagcggatcacctgaggttaggagttcaagaccagcctggccaacatggcgaaaccccatctgtactaaaaatgcaaaaattaaccgggcatggtggcactgcctgtcatctcagctactcaggaggctgaggcatgagaattgcttgaatctgggaggcggagattgcggctgcagtgagccgagattgcgccactgcattctagcttgggcaacagagtgagactctgtctcaaaaaaaaa

SEQ ID NO: 32232 - DNA, 469 bp, Homo sapiens
  misc_feature 130: r=a or g
  misc_feature 133: m=a or c
  misc_feature 134: y=c or t
  misc_feature 135: k=g or t
cagtataaaaatcacttgatgtgctttgtgcaaaatttccaggaccttatgttttatatgggtgtcatgaagtgaatggctgaaagctcttcatagaaggaaggtggtttacatctgtgtgcctaggtgraamykgttttagtaggtttcatagcagagtaacaaacaggagaaaacagcttctaatatttgtcatgatgtagtcttatcagtttaacttcttagcattttgagtttatccagttttctcaagtaataaaaaatactgtctaaaggtttatttggttttctcttgagagagaaatagtaagatatgcatagttaattctacacttccactatgattgaatgagaaaagacctttatcaaaactatttgataggttacgggcacaaatagattagcttttagtacaagttgaatacttcatgctgctgatacggaacaatggattatttgattcgggatc

SEQ ID NO: 32233 - DNA, 426 bp, Homo sapiens
  misc_feature 124: k=g or t
  misc_feature 126: k=g or t
  misc_feature 128: r=a or g
  misc_feature 132: r=a or g
  misc_feature 141: m=a or c
  misc_feature 384: k=g or t
  misc_feature 385: d=a or g or t
  misc_feature 386: k=g or t
taataaatatttaaggtgtatcctgctaggtgctggcaatttgaggatgaagaagtcatggactgcctttagtgagctctctcataggagagactgatatatgagctagtaattgtaatgaagkgkgraaargtgctgtamctattgtatgatgagttaagagagtatgaaattgaaaccagggaaaatttgctttcccctccaaaacaattgcctggtctttttgccatctctgaatcctatacatacagattacaatcaccataatgtattgtgaggctgtatctttacccccaaagacctcagtttagtaggggagaaattttgcatcttctcagctttgtatatctaagtatttggcatatacttaggtgaatccattgkdkatttgaattgcatgtgggtcatttccagcaaaagggatgc

SEQ ID NO: 32234 - DNA, 255 bp, Homo sapiens
  misc_feature 131: k=g or t
tgtgaattaaatatatgtcaaactttttttgtacaacagattcatacctctttcctgtttgaaattattttactgtgtttcatcaatctaatgtttatttttattacaccagtaatttcctcattgtggtkgaatcttacagtggcttataaatctacatgtacctagaaatgtttagccagtccatgtatatttgatgtggcacattttttcctttgaatcacatactctaagagaagtaacttcctcttgcta

SEQ ID NO: 32235 - DNA, 209 bp, Homo sapiens
tgaatcagatttaaaatgaagcatgcattgagtgtgccaaggaactaagtggtccatagcagcagtaatgttcatagggtgcgagatgcctgctatgaaacagcaactctcaaacatttttatctcaagaccatttgtttatgtgagctatatatattattatattaaatattaaatttttaaaatatttatttatgggccaggcacgg

SEQ ID NO: 32236 - DNA, 163 bp, Homo sapiens
ctgctccttctccctggaatgtcctttcgccagatagctttgcagcttgctccctccttccttcagatctgtactcagatatccccgctgtggccaggctgtccatggcagtcttacgattccagcccctctcctgcaactttttctccttagccctctacga

SEQ ID NO: 32237 - DNA, 244 bp, Homo sapiens
tgtgattgacgttaaaccttaacatgggaatgggttgtatgtgggtttttttgtttttttgtttttgagacggagtttgcactgtcacccaggctggagtgcagtggcttgatctcagctcactgcaagctccgcctcctgggttcgcgccattctcttgcctcagcctcctgagtagctgggactacaggtgcccaccattatgcctggctaattttttgtatttttagtagagacgggtacc

SEQ ID NO: 32238 - DNA, 298 bp, Homo sapiens
  misc_feature 172: n=a, g, c or t
tcttcaaagaataaaagctggtttaggggacagcaagctggcatacaaatataccagtctactccaagaaggtgactctctaagaaaaacaaagtaattggaggcagaatccctgtgttgcaattaattcaccaggttaccttgaacaagagctctgcagccctttccctgnccctcagtacagcttgagcatccctaatcccaaaatccaaaacccacaatgctccaaaatccaaaactttttgagcacctacatgacgccacaagcagaaaattccacatctggcctcatgcaact

SEQ ID NO: 32239 - DNA, 483 bp, Homo sapiens
  misc_feature 192: r=a or g
  misc_feature 193: h=a or c or t
ctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttrhtaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggacagaatcaaaagaataaaaatctgtgaagagatctactactcttccttctatgt

SEQ ID NO: 32240 - DNA, 239 bp, Homo sapiens
  misc_feature 149: k=g or t
aaaagaaaaatgattctggacatttagctccatttgtactaactagcaaataccctaaatacccttaaagacctactgttcgaatttctgaggtttttttgttgttgtcttgacttttagcagcatttaaaacattctcttaaattagkatctttaggatcttcattgggatcattacatcttttgtataaggtcaaggaaaaattccaaagtttaaggccagcctaggcaatactatt

SEQ ID NO: 32241 - DNA, 348 bp, Homo sapiens
  misc_feature 133: r=a or g
  misc_feature 135: r=a or g
  misc_feature 253: y=c or t
  misc_feature 254: w=a or t
  misc_feature 258: w=a or t
  misc_feature 259: y=c or t
  misc_feature 296: k=g or t
  misc_feature 319: h=a or c or t
ttttggcttgaggctgtattttaactccagataagtgagatatctattactacattttttctcatagatcttctttgagaaaccagtgatactgaaagacaagggggtctacactcttgcgttagggtttcargraagtagaattgggtcaggaagagaaagatcactttcaggctgataagttgcaatcacccagagtggtagagtgtagatttgggagttaaattacctagtgctgcataacataatagaywcggwyagaagtggatggtggcttaagaataagtatgtgagtkcttttctcagtgatctttgtgchagtagagcactggattagccaggagctat

SEQ ID NO: 32242 - DNA, 208 bp, Homo sapiens
  misc_feature 126: s=g or c
attctctcccgtgccccttctcccagctgggtctgagcccccgcccccctggctcctccgttctgcttctcccagcttctctgtccatctcccccaatggcctctctctacactctctgcctcagsttccaagtctctgctggtccctaggaagcactttgacctctgcttccccttcaaatgctgtggatcaagcctccccaacccc

SEQ ID NO: 32243 - DNA, 89 bp, Homo sapiens
  misc_feature 17: w=a or t
  misc_feature 18: k=g or t
  misc_feature 56: m=a or c
ataatgacccaggctgwkaagggtgatacggagaacggaaaggagaagggcggcgmgaaggagaaggagcagcgcggcgtgaagcggcc

SEQ ID NO: 32244 - DNA, 176 bp, Homo sapiens
  misc_feature 127: s=g or c
  misc_feature 156: r=a or g
tataatcttaggtagaacaacttttttataagaagtattatttgaccacttcaggtatacattcaatactgggtaaaaatttcagacctatctcaggaacacagaaatatttggtgtcctgataagsactttctagactattgatgtggccaggartttggaaagacgacacactg

SEQ ID NO: 32245 - DNA, 161 bp, Homo sapiens
ttcctcctatcattgtttttaatagcaaaaaattggaaatctagacatcagtcaacaaattctggtgtatgcaaaaaatggaaaaacagaagccgtttataaaggatctataactttttgtagcaacgtgggagaaatcttgatagtaatttttttttttt

SEQ ID NO: 32246 - DNA, 175 bp, Homo sapiens
attcacaacactgtgtagctgcctcctatactgaataggattaacttgtatagcaataaggtactgcggaaatgatagagtatgagatagatataaaagacactgtggcttccagcttatgcgttcttgctgtccttttgctctggagaaaaccagttgacgtatcacagggcgt

SEQ ID NO: 32247 - DNA, 375 bp, Homo sapiens
tgccatcataaactcatatattcatcctcaaactcccttgtttaatgctaattggtggcctggaacttcactgagatgcaaaatcaagaactgaagcctagttgctagataacaaaaagctataaatgttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggct

SEQ ID NO: 32248 - DNA, 331 bp, Homo sapiens
  misc_feature 132: v=a or c or g
  misc_feature 216: k=g or t
  misc_feature 279: n=a, g, c or t
ttccggccctgctgtctgcctccccggctgattggattcgttactgctttgcaacgcgcacctaactccagacggggtctcactctgtcgcccaggctggagtgcagtggcacaatctcagcttgctgtgavctcagctctctgcgacctctgcttgctggactcaagcgatcctcccaccacctcagcctcctgagtagctggaaccatcatatkcaccagcacgcctggctaagtattttgtgttttctttttttttaatttctagagacaggatcntgttatgttgcccaggctggtctcaaactctaggactcaagtgatctacccc

SEQ ID NO: 32249 - DNA, 258 bp, Homo sapiens
ctatatatgctacattttatttatctattcgtctgttgagggacacttaggctaattccctatcgtggcagtggtgaatagtggtgcgataaacatgggcatgtagatctctctttgatatactggtttgttttcttttgggtgtatacctcgcagtgagagtgctggattaaatggtggttgagaaatgaccatgctgttttccgtaatagctgtactaatttatattcccatcagcagtgtaccagagtgtccctc

SEQ ID NO: 32250 - DNA, 267 bp, Homo sapiens
  misc_feature 183: n=a, g, c or t
gaaggggtgtcaaactccaatggaaaaggtttaggaaaagaccttttacaaatccaaagatgtttcacagtgggcgaggctggtgtggcgacagtagtggcccacatggctgggttgggagccagctctgcccatgaggtgccgtgtggctttgcagtgtggcctcacaatcccagctttgtntcttccccagggagatgaggctggtgatgctcaagatctcagaggccctgcccaggctgagtatctgtatataatatccccctc

SEQ ID NO: 32251 - DNA, 478 bp, Homo sapiens
  misc_feature 313: w=a or t
actattgactaactgtccatacaaaaacatacaaaagtccatattcatagaatttttgaggtgtgtaatggggattatgggaactacaagatgagatttgggtggggacagtcaaaccatattagtatagaaggaattaggtatagaaagaactgatctatgtggttgatgcctattgtagtccttacatcctgtaattcctgcattagaattcagtggaattattgttaccattatattattgctatggtcattatttattgttttttattgcctttgtattaaaggaggtgcttgttatggcatgtcatawattattatattatgagaacacttcagagcttcaggttagatacccaatttttgacttgatctctgtactcagttatttcacaagccctacaacctcaaaactggagttcatggttttcctctaaccaaacccatgacttccaaaccttatgtctcctccagtgtt

SEQ ID NO: 32252 - DNA, 343 bp, Homo sapiens
  misc_feature 138: m=a or c
aggtgggaaaacagggactatggaacactgcaaatgcaactgaatcaagcactattaacgtaaaattttttgagcctgcctaaaggccagatgctatcagcagctgaacagcatctacaaaaaccagctggaaaagamcagaagcagaacaactggtttgttggagagatctgataacaaaaatttgggaaataggtaacataataacttggggtagaggttatgcttgtggttctccaggactgaatcaacagccaatttggataccatcgagacacctgaaaccttatcatgagccagatgctgaggaagagattccaggaggatcctgaggaccccccgt

SEQ ID NO: 32253 - DNA, 142 bp, Homo sapiens
atgattattataatgtattttaaaatatgacactatattcaaacataccattataatatgtcaaatgggaatatggacagaatatatgagacaacctgttcacaactgtttaatgaggaggttatccaacattaaggaataa

SEQ ID NO: 32254 - DNA, 387 bp, Homo sapiens
  misc_feature 120: s=g or c
  misc_feature 134: w=a or t
  misc_feature 136: s=g or c
  misc_feature 138: s=g or c
  misc_feature 142: y=c or t
  misc_feature 161: m=a or c
  misc_feature 170: y=c or t
  misc_feature 319: y=c or t
  misc_feature 373: y=c or t
tgttttcatcaatgaaatgtgaacagaagagccagggaagtattaagagcttgtgtgcccttccttctgtgttggtgagaggtttttcaagacggaggctttgtcaccttgatccttgastgactagactggawastscccytctgctgactgctgttggmcacattggytaattgataaacttctgagattcaaggcatggttggaggaaggagactatttgtaaccacacgtaatcttgtctaacttaatttgcctaaatatctttcacacactcttaagcttgttggtgccaggtatttatctggaatcgagggcyctctgacttaacaatccatggttttttcatttatttcctctcttttggtatcayatgacctgcaggaa

SEQ ID NO: 32255 - DNA, 448 bp, Homo sapiens
  misc_feature 130: y=c or t
  misc_feature 135: s=g or c
  misc_feature 141: k=g or t
  misc_feature 204: r=a or g
  misc_feature 397: w=a or t
  misc_feature 442: s=g or c
acagtggctcacacctgtaacctgaggactctgaggtggagacgggcagaccacctgagctcaggagctcaagaccagcctgggcaacatggcgaaaccctgtctctactaacactataaaaagttagcygggcsgttgtkggtgcatgctgtagtcccagctactcaggaggctgagccacgagaatcgcttgaacctgggaratggaggttgaagtgagccaagatcgcaccattgcactccagcctggggaaaaaaaaaagccaggcctcctaatgtactcatttaaacatcacttgtgtccacctgggttcagaattgtgctggacatgggatacacaaagtttcaattggcctcttggtgccaaagcaccatggcgtgttacacctatcagwtcgggcacactgccccttcttcccaacctacgagctgaaatggcsagcact

SEQ ID NO: 32256 - DNA, 235 bp, Homo sapiens
  misc_feature 135: w=a or t
  misc_feature 139: w=a or t
tccagtataatgttgaattttacttaaaacccctctcgaaagtaatgtttgactttaaatatttattggcatgaaaatcattgtctaggttctaaaacctgtagattgggtaatgatttggcatttaagtgaatwaaawtagatggattttgaagaaaatgaactttcattttttaccaaggtccatatttgactatttcacatagttactttaaatgcttataagcagatcgcc

SEQ ID NO: 32257 - DNA, 305 bp, Homo sapiens
  misc_feature 142: w=a or t
  misc_feature 150: k=g or t
  misc_feature 278: k=g or t
cacattttcctgtggttgatttcagtcacagattactttgattaggttttgtcatttaaaaaaaatgctattggcaaaatgacaagtacattgtgaatttcaattagttttatctggatctcgttgactactttttgtaatwagtttttkcctgcagaagtacagcatataactgaaaatacaacaatgaaattggatttaaaaaaaacataagaatgcacggccaactggagtcccagaaattgtcttatacatcttattagtgaaatcaccttttkattcattggattcactgtaacaccaat

SEQ ID NO: 32258 - DNA, 108 bp, Homo sapiens
agtattttcagttgttctttctcattttttaaggcaaagcagagagcagaggttcttcagtccacgcaacggttcttctctgaacagcaacagagcaaacagatagga

SEQ ID NO: 32259 - DNA, 415 bp, Homo sapiens
  misc_feature 148: k=g or t
  misc_feature 150: s=g or c
  misc_feature 201: b=c or g or t
  misc_feature 414: m=a or c
gatggtgatttataatgtttccttttaggtgtctgctgttttataagtaagcaggaacctctagtagtggagccataccttccccttcctatttatatttcagtacattaattgctttatcttgtcaacttcattttggggtccttgktsctccatcagttagtgaatgatgaagaattaacagcacaaaattatatccgbactgtttcttttcctttctaatatattaagattctattatgtgttgtttttttttaaacctaggttttatttttccttttgaaatggagtcttgctcagccgcccaggctggagcagtggtgtaatctcagctcactgcaacctccacccccgggttcaagcaattctcctgcctcagcctcccgagtagctgggaatatagttacgtgccamc

SEQ ID NO: 32260 - DNA, 181 bp, Homo sapiens
  misc_feature 139: k=g or t
  misc_feature 141: k=g or t
  misc_feature 145: k=g or t
caatttgtgtagggatgtcaaatttcagggtttttttgttgttgttgtgttattttgtggtattgtgcttgttttgtgaaagaatgttttgacagggccccttttgtataggactgccaaatcatgggttttgcctttkgktgtkgtattttatcctctgttggtaatactgaatggtagt

SEQ ID NO: 32261 - DNA, 317 bp, Homo sapiens
  misc_feature 28: s=g or c
  misc_feature 154: k=g or t
  misc_feature 155: w=a or t
  misc_feature 266: y=c or t
  misc_feature 267: v=a or c or g
gatggccacctcccaccgagtggcgaastggtggcctccagtctccagaccccggtaaatcccatcactggagcgcgggtcgcccagtacgaacgcgaagaccccttaaaggccctggcggcagcggaggcgatcttggaggacgaagaggagkwgaaagtggcgcacccgctggggcatcggctgatttgaacaccagcttttctggggtggatgaacatgcaccgataagctatgaggactttgtgaactttcctgatattcayvactctaatgaggagtatttcaagaaagtagaagagttgaagactgcccac

SEQ ID NO: 32262 - DNA, 412 bp, Homo sapiens
  misc_feature 50: y=c or t
  misc_feature 69: b=c or g or t
  misc_feature 70: n=a, g, c or t
  misc_feature 71: n=a, g, c or t
  misc_feature 135: m=a or c
  misc_feature 177: b=c or g or t
  misc_feature 178: h=a or c or t
  misc_feature 298: n=a, g, c or t
  misc_feature 369: y=c or t
  misc_feature 370: n=a, g, c or t
  misc_feature 375: v=a or c or g
gaagaattgtaatcatttatgtctctgcatttcatttcagtagtgctcayatgcactatcaaagttatbnnctatttccctggtaatcacttgcgtatttgtcaaataagggtgtatgttgaataaacatgtggmttttatcaatttggtaaacatttattgcataccctcacaggbhtaaagaaggctacaaatcagtacagcagaatgccttcaaaaacttacaggacacacccaccaagtgctgcagagcagtcagaagttccctatgagatataagtggaaaagaggttcagangatcaaaaatgtacatgtgattataggaatgagaatttgatatgaataccctgaagaatttcaggtttggynttggvcattggcatctgttttttctcagttgatcttttgttt

SEQ ID NO: 32263 - DNA, 247 bp, Homo sapiens
tttacacatgctggaatgactgtaattactctagaattccaagtagaatacaataacttttaatattgagaagaatgttcatgctaattcttcttacattacaaaaggcctttgaggatgcctacgtctgaaatttgctcttacgaactttaataaaatagttagctaatagaaaaacaggtaagaataaagcaatgttgccttaatttcaaaagctgctattttagaatttgaataagtactccgt

SEQ ID NO: 32264 - DNA, 460 bp, Homo sapiens
  misc_feature 26: s=g or c
  misc_feature 188: r=a or g
  misc_feature 193: m=a or c
  misc_feature 194: r=a or g
  misc_feature 311: n=a, g, c or t
  misc_feature 352: n=a, g, c or t
  misc_feature 353: d=a or g or t
  misc_feature 458: y=c or t
  misc_feature 459: k=g or t
  misc_feature 460: y=c or t
attccttttcttactgattttgtggscatcgctggaaaccccttgggaagccgtgaatgcatctctcaatgacttccaggtcaggaaccatggtagaccattacgaggtcacctggcctgaccattgagctttgcctgctcccaactgacccctcactgatggctcagggagagttgatgagggggaraagcmrcctttatagggcagggtctctgggggaggactgcttgctgccctgcacttggctatgtggcagatgctggccttgatgggagtccacagaaaatggggcctcactgactgcttgtcnaggtatctcagtgggagggaatgggagtgggaaatggagtndtcaaggccacaagacaggccgccatagaactttggccttggggaatgaaccaaagctagtttggagagtagggtgattggggtgatcacttttccctttaaagcyky

SEQ ID NO: 32265 - DNA, 472 bp, Homo sapiens
  misc_feature 209: r=a or g
  misc_feature 217: y=c or t
  misc_feature 225: y=c or t
  misc_feature 235: w=a or t
  misc_feature 237: k=g or t
  misc_feature 251: k=g or t
  misc_feature 258: r=a or g
  misc_feature 379: n=a, g, c or t
  misc_feature 380: n=a, g, c or t
  misc_feature 382: h=a or c or t
  misc_feature 383: w=a or t
cattttatcagatgatttttcagcattttatatttcaaatctatgtagtataagcactcctgtttaatttttcgattaataggaggcaagaaacttgtttgtttgttggctttttatattttcttaggtatatatcctaagaagtgtaatacaccaaacatgattggacatcctgcagtgctctgatatttttgtctgactctaagtgrtctagacyaatttgtycctaaacatwakctatacactttttkaaaaaarattaaaggctttcttggctctttccccagagattctaatacactaggtctgagaggaatcctattgtattttcaaaagctctccaaattttgtaaccactagtatagactaagatataaannghwcaggacattgtgaactaagcccagtacatttcctggaagttggctgttgttttaaatttcacaggagctttcattatgattagacactc

SEQ ID NO: 32266 - DNA, 211 bp, Homo sapiens
  misc_feature 142: s=g or c
aacacaactaattaccttagccttggcgagcagtccctttctctgagctttgggattttcagtttatacaaacagcttatatagaaatgcaactgggcttcctctccctaactaaaaagtgctgtcatgctgtgctgttccsagcattcacagagactgcacaagtgccattggtttggggcaaatctgcttctaccgaaaagatgaaaaa

SEQ ID NO: 32267 - DNA, 312 bp, Homo sapiens
  misc_feature 33: k=g or t
  misc_feature 130: r=a or g
  misc_feature 131: r=a or g
tgtaccataattcagcccttgccccaaatttcktccaattggagataactgtatcttactctaaaatgaatatcttgcagaaatgaaagttgaccttagtggcagttggcctaaggcacataggatatgrrcttttgcaaagtataccctgtgcaaagacaaatgaagacaattctgattgagacctgattttaggtgttggaaaaaatcatagcagtatattgaagatggggaggacccatggaaaccacctagtccaaccccatcatttcagacataaaactcaggttgctgagtcccataatggcctca

SEQ ID NO: 32268 - DNA, 118 bp, Homo sapiens
  misc_feature 70: b=c or g or t
  misc_feature 71: m=a or c
  misc_feature 72: s=g or c
taatgagtctcaaaatgattttcggttttacttagtcatcctaaaggcaaaaagaaggacccttgctaabmstttccagcaggggaaagcatatttcttgctggtctttgaagatttt

SEQ ID NO: 32269 - DNA, 378 bp, Homo sapiens
  misc_feature 129: r=a or g
  misc_feature 151: r=a or g
  misc_feature 300: r=a or g
aggtttcaagtttagaaggtttcaagtttagaagtttcaagtttggaaggtttcaagtttggaaagaaatgaaattatgtgatgaggtttctaactgggcccaggagggggcgaggtaggcaaaacagrgactagctctgcctggaggaaraaaaaagcaacatttgtgaccagcctaggcgacatagtgagacctgtctctacaaaaaatatataattagctgggcgtggtggcgcgcgcctgtggtccaagcttctccggaggctgaggtcgggggatcgcctgagccctggaggtcrttgctgcattgagccgtgaacgcaccactgcattccagcctgggcaacagagcgaactctatctcaaaacaagacaaa

SEQ ID NO: 32270 - DNA, 309 bp, Homo sapiens
  misc_feature 160: r=a or g
ttatatttatttatttattattttttgccactcagctgagtgaaaactgtcatcttgttttaatttgaaactcctggccgggtgtggtggctcacgtctgtgatcccagcactttgggaggccaaggtgggcggatcacatgagatcagggagttaagargaccagcttgaccaacacggggaaatcccatctcaactagctgggcgtagtggtgcacgcctgtagtcccagctacttgagaggttgaggcgggagaatcacttgaagctgggaggcagaggcttcagtgagccgagatcgcgccactt

SEQ ID NO: 32271 - DNA, 110 bp, Homo sapiens
ccaggttcaagcgattctgcctcagcctcccaagtagctgggactacaggcgtgggccaccacgcctggctgatttgtgtgtgtgtgtgtgtgtgtgtgtgtgtgtgtgt

SEQ ID NO: 32272 - DNA, 389 bp, Homo sapiens
  misc_feature 167: m=a or c
  misc_feature 341: r=a or g
  misc_feature 355: r=a or g
tcattgttcagctcccacttataagtgagaacaactggtgtttggttttctgttcctgcattagttttataatttttaaaaccagatctttagtgcctatacaaccatctccgcttctgcgttcctgacctagcgtttactcacagctttcccaggggctcattgcmatcccacacctctcttttcttagataggatcttggctgctcactacattcctctactatctatcttccccttcccccataagccctggggataaagccattataatatctaatgttacatgatacttgacatcttatagaatagttcaactacaggattttgtttagatcttgrcaatactctggaargagagagggcagatgttatgtatttcccccattt

SEQ ID NO: 32273 - DNA, 133 bp, Homo sapiens
aggcattgaggcagtcagaagcagaggctgcacaggtgctcatcttgatgtcttatcaggcacccagggaacctgtttagaaagggatctactccacccccttggaatgcagcaaagagaacgaaccagacat

SEQ ID NO: 32274 - DNA, 480 bp, Homo sapiens
  misc_feature 143: s=g or c
  misc_feature 149: r=a or g
  misc_feature 154: s=g or c
  misc_feature 156: w=a or t
  misc_feature 163: d=a or g or t
  misc_feature 345: w=a or t
  misc_feature 371: m=a or c
aatcgagtaagagaaggtaagtcaaatgcatgagatacattatcttttgcccttacaggctgactttaaggagaattttgcataagaaaagaggatttaagtcacctgaaatatgcgtgagttcgccctggatgagctgccgstgccargtggscwtcacagdtagagatcagggactgtaaccggaaaatagagaaaagagtcttttccccttctgggcagggcagctatccccatttacgccttggccttcaggcaacaccagagggtggccctggccagctgccctcagttaccaaggaactagtaggaaacggcagctgaaagattttctgaaaaagagawaaaggaaaaggactaaggtccttcamccgaactgggtggtagcggtcaggcacttccacacagaaatctttccgtttcaccagagagtggctccggccagaaacttacagttgcttgcatgcttatgtgctgtca

SEQ ID NO: 32275 - DNA, 137 bp, Homo sapiens
ttacgggctccatagggttgtattgaataattgaacgaattgtgagctagtgttttccccaactttgactgacagatagtgggcttgcactttgcttagggaaagctggtgctgccacctgccctctcacccctcca

SEQ ID NO: 32276 - DNA, 131 bp, Homo sapiens
cagatagccctctaagtgtggatagtaaatattttgatttacaattaagcctaccttgaggtgcaggccctaaccaacggatagttgagtaataggggcctagacgccaatggaaagaaaatgggactacc

SEQ ID NO: 32277 - DNA, 418 bp, Homo sapiens
  misc_feature 137: s=g or c
taaaaatattgatcacaactctgaattgactttatagcctactgataggtcacagtttgcagtttaaaaagcattctgggggctaagcatggaggcttgtgcctctagtcccagcactttgggaggccaaggtgggsagatcacacgaggtcaggataccagcatgaccaacatggtgaaaccccatctctactaaaaatacaaaaatgcccggtgtggtggtgcatgcctgtggtcccagctacttggaaggctgatagaagagaatcacttgaggctggcaggcggaggtagcagtgagccgggatcacccccactgcagtccagcctgggtgacagagtgagactccatctcaaaataaataaataaatggatggatggatagatagcattctgggatgttatgtcagtgatcct

SEQ ID NO: 32278 - DNA, 220 bp, Homo sapiens
  misc_feature 132: y=c or t
  misc_feature 137: k=g or t
  misc_feature 143: m=a or c
cccctaagtccagagcctctgctaatgtctcaggagacttcctttactgtcttctgtgttggtggatgcagggacctggagagcagtgctccatattgaaaccttcaggacagcaaggtccacagctctttyccctkggtgtmaaccgctgtctgcactaacctctctgtctttaatctcttagctgctctcatgccttttaaaaatttttctcccaatt

SEQ ID NO: 32279 - DNA, 210 bp, Homo sapiens
catacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaacac

SEQ ID NO: 32280 - DNA, 316 bp, Homo sapiens
  misc_feature 121: r=a or g
  misc_feature 126: s=g or c
  misc_feature 130: s=g or c
  misc_feature 131: y=c or t
  misc_feature 132: k=g or t
cacgggagagagttgggataaggacaacataaataggaaagcttgatcaagaattcccttacttcacagttactgcctaaatgcagatattaacacttaaagtcagcggatgtgaaactaracagsaagsykgagcccagccactctcacagtttgctgctgtctcaggtctcctgacatgacagtgctcacgtcatttgcagccagagaagccccagcctcacccagcaccctcctcaacccagtgcttctcccatccactcatttccccaccaccggggacccaagcagcctacttcctctgaattaccatgcg

SEQ ID NO: 32281 - DNA, 337 bp, Homo sapiens
  misc_feature 148: m=a or c
ttatagtaagaggggaaaaaaatcttttaaaacttggctgttggccgggcacggtggctcacgcctgtaatcccagcactttgggaggctgaggcaggtcgatcacgaggtcaggcgtttaagaccagcttgaccaacatggtgaaamccccatctctacaaaaattagctgggcgtggtggcgcgcgcctgtaatcccagctactcaggaggctgaggcagatgaattgcttgaatccaggaggcagaggttgcaatgagccaagattgtgccacggcactccagcctgggcagcagagtgagactctctctcaaaaaaacaaaacttggctgtat

SEQ ID NO: 32282 - DNA, 138 bp, Homo sapiens
gtgtccacggctgtcgcgagagcccggggcgagtgggcctctgctcgtgggtggttctcgtagaggtcagctcccgcgtgtctccgctcgacagggtgcttgggcaggtaagggtccgctcagtagcccaaccctctt

SEQ ID NO: 32283 - DNA, 261 bp, Homo sapiens
attgattgataacaacattaacaagggaggtgtcattagcagataagaaatttcaaaaaatttctagaagccaaaagcagagacattggacagaataaatggaaactactaaagcccagatgtaaatatcataaaccttgacagtgatggaatgatgaagctgagagaagtctgaagaaatggaaggagtgtgtaggtgttctaacatccacaaagcacacagcagggtaccagtattttctgggtaaggttgaggggcaa

SEQ ID NO: 32284 - DNA, 258 bp, Homo sapiens
  misc_feature 144: r=a or g
  misc_feature 147: w=a or t
  misc_feature 150: w=a or t
  misc_feature 151: v=a or c or g
catatatttccctcttacaaaacagcatgtcatgaagttcttatgtggtaaagattcaactagtaaatatttttaggttaaatacctgaactagttaaaattccacctaagaatagtcttaaaatatttaaaaagcatctctcrtawctwvcttctttgtcattgctgccattttaactgaagcaaatctttatgacatctgaaatgatggttggatgcaattaaaaaaaaatctatgttggtgcttttctcaggcat

SEQ ID NO: 32285 - DNA, 438 bp, Homo sapiens
  misc_feature 2: n=a, g, c or t
  misc_feature 153: r=a or g
  misc_feature 156: y=c or t
  misc_feature 375: m=a or c
  misc_feature 411: w=a or t
tncaaatatctttgagtgcttacagacttcgtgtcagtacttacggactttatttatttatttatgtgagacggggtctcactgttgcccaggctggagtgcagtggtgtgatctcggctcgctgcagcctctgcctcctgggctcaggtgartcytcctgcctcagccttccaagtagctgggactgccggcgcatgccaccacacccggttaatttttgtattttttgtagagctgaggttttgccatgtcacccatgctggtcttgaactcctggacttaggtgatccacccgcctcggcctcccaaagtgctgggattacaggtgtcagccattgccggcctggccttcatttatttttaatagctgcagmttatcacattgtatggatatatcatacatatatatwatcattcatatgtgtgtgtgtgtgtgt

SEQ ID NO: 32286 - DNA, 357 bp, Homo sapiens
tttgctgcaaatgtaaggacttcattattttttatggctgaatagtattccattgtgtatatataccacattttctttatccattcatctattagtggacacttagggtgattccatattctggctattatgaatagtgcagcaataaacactggagtacaggtatctctttgacatactgatttcctttcctttggatatatacctactagtgggattgctggatcacatggtagttctatttttagttttttgaggaacttccataatagctgtactaattcatattcccaccaacagtgttcaggcactgtttacttatattaatcacaatgatcatgctaatatcctgtaatc

SEQ ID NO: 32287 - DNA, 183 bp, Homo sapiens
  misc_feature 141: r=a or g
tgttgtccaggctggtcttgaaatcctggcctcaagcaatcctcctgcttcagcgtgggattacaagcatgagccactgtgcccagcctatacagccatttaaaatgattgtatagctctataataaatgaataacatacrtaccataattaaaagaataaagcaggatatgaagtagcacgg

SEQ ID NO: 32288 - DNA, 331 bp, Homo sapiens
  misc_feature 247: n=a, g, c or t
aataaacatgagaactcattcagtataattaataattattaaatgtaaataaaaacatctatgtacaattaggcatttatttaagaattatttgaaaaaaaaacaatgtggaaacagatattttgatatattgctagtgattgaaattgataatgttcttttgaagagtaaagtgaccatatatattaaagttaaaatttaactcagcaatcacacgcctggtgagttatcttaaggaaatcagttngaaagtaaaatcaatatatgcacaaagactttaacatttatcataaaccagaaaaatcgagtttcaaattatatcctatggact

SEQ ID NO: 32289 - DNA, 430 bp, Homo sapiens
  misc_feature 72: s=g or c
  misc_feature 73: s=g or c
  misc_feature 187: s=g or c
  misc_feature 201: s=g or c
aaccccaggccagccggccctgctctggcgcgtccaaaatactacctagcacaggcctctgctcgaggcacssccaaactacctatgtatccagccccagagggcctccattcccaggaagtccctatgtatcccaacactggcagacacccagcaccaccctcccagacccgcaagaaagtgaatstcactactacctastcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatcccccc

SEQ ID NO: 32290 - DNA, 501 bp, Homo sapiens
  misc_feature 352: b=c or g or t
cttaatacctagaaccgcaaattctcctagtctttgccagaggcatttgtgtaggggcacactttgaacacacggccagtcagtttacaactctggcttagccttcaacttcctacttctgcaaattctcaagatcaaccagaggtgagaactctgggccttctcaggtctttcctgagtatgtgcacaatgctgggcatgcatgtggccttctgactctcatgaatatatcagagcttaccaatgcccttatggacatacatttccctagcttttttccctggcttctcttttaagctttttggttagtttattatctgtccctcagtcagcagtgactaaaacatttgcbtataaatatttttgacaaatgcagggtacctactttagcagtaggccagttctgagacaatataaagacaaacgttttgagctggttttccagggagcaccagacaggttaaaacaaatcattacagttctttgggaatcagatctgtt

SEQ ID NO: 32291 - DNA, 213 bp, Homo sapiens
ctttgtttctaaagtgagaggaaagtgcttggtatcttgctttttgctgagggcaaaataacaacatgaagacaaagtgctttttgttgtctattcatgaaactgtagaagaatattttgagtttttattcttatattatgaagggattctttgcctagcagtggccgtcaaactgatgtagcattgtacttctcaacagtgaagcctgcact

SEQ ID NO: 32292 - DNA, 403 bp, Homo sapiens
  misc_feature 128: r=a or g
  misc_feature 320: r=a or g
  misc_feature 347: r=a or g
aataacacagatgttagaatagtacagatataattttgaaaagctacaggaattatcagataaggctgagaaagatcatcagacttagtgacctcttgacatttgggagactgacttctccagagttratgagggtgaaagtactctgaactctctgaattatttcatttatctttagtattaaatcttgtttttacaaacctatgagttatgtatgatacaggagacaaatcagttaactagaatgcttaattgactacagttttctctcaatatcctggggacaggcaagttgattccaggaccctcccagataccaraatccatggatactcaagtcccttacrtaaaatggcatagtatatagcctacatgtatccttctgtgtactttaaatcatctc

SEQ ID NO: 32293 - DNA, 94 bp, Homo sapiens
  misc_feature 85: r=a or g
caccctcattgtaatcttaaacttgaggtttcagagaaaccttaatatcaaccattaaacacatttaggagatgcggcctaatgrataatgaga

SEQ ID NO: 32294 - DNA, 292 bp, Homo sapiens
  misc_feature 119: r=a or g
  misc_feature 128: y=c or t
cagaatggactggaataatttaactttcgtactttcccaggctattagtattatctaatgagtggcttaaagataccagaaacactgactgaggtctccacctgcttctggctgaatgratgggagcytcttagccattgaataagaggcagtagccaatgtttcttattctgaatggtccaggttgacttttataagagaaacactcagccttttaattgctgaaggtctgacccatagactaagattgcacattcttagtctaggttacacttgaactagactgcacaga

SEQ ID NO: 32295 - DNA, 282 bp, Homo sapiens
aagttttaacgactgctggaggcaacatgcttccacactgacagaaatcatctttcaaaaatcctgcacatatctcaggcttatgaacaaactaattcctaatagttggaaatgaattaaaagcttgccggtggagataaaagatagattttggctggatgtgatgactcatgcctgtgatccctacactttaggagggcacagcaggaggatcgcctgagcccaggaattcaagaccagcctggtcaacatagcaagactctctctctgcaaaaaaaaaga

SEQ ID NO: 32296 - DNA, 98 bp, Homo sapiens
  misc_feature 7: h=a or c or t
  misc_feature 20: m=a or c
  misc_feature 49: r=a or g
  misc_feature 73: m=a or c
  misc_feature 75: s=g or c
taactghtggtgagtgcagmtcactaatctataaacctcttgatggagratggggtaccaatcccagggatgmasaatgcgaaagaattgtggcagga

SEQ ID NO: 32297 - DNA, 208 bp, Homo sapiens
  misc_feature 129: w=a or t
  misc_feature 156: y=c or t
caagtatacaattgttgagtctggaatttaggagagagatgtgggttcaagagtaaaatttgagagcctcaagcatatagaagatatttaaatccatctcccatactctgcaatagccacataactggwctattaagttctattcttttccatatyccaatgcattttccatcctgccaacatttacgttttcaaagcaaaccctgcc

SEQ ID NO: 32298 - DNA, 279 bp, Homo sapiens
  misc_feature 103: h=a or c or t
  misc_feature 105: b=c or g or t
  misc_feature 106: k=g or t
  misc_feature 142: s=g or c
  misc_feature 143: s=g or c
  misc_feature 144: w=a or t
  misc_feature 150: r=a or g
  misc_feature 165: r=a or g
  misc_feature 190: n=a, g, c or t
  misc_feature 191: n=a, g, c or t
  misc_feature 213: w=a or t
  misc_feature 214: b=c or g or t
  misc_feature 236: n=a, g, c or t
  misc_feature 237: n=a, g, c or t
  misc_feature 258: k=g or t
  misc_feature 259: k=g or t
gaggtcacaggaaggggctgtgtgaagccacgggaaggggcataggaagtcacaggaagtggctgtgtgacgttacaggaagaggcagtgtgaagtcatagghabkggcagtgtgaagtctcaggtagaggctgtgtgaagsswcaagargggaaagtgtgaggrcacaggaaggggctgtgatgacagnnaaacaggctgtgtgaagccatwbgtaggggctgtgatgacagtannacaggctgtgtgaagccacakkcagaggcagtgtgaacatgc

SEQ ID NO: 32299 - DNA, 238 bp, Homo sapiens
  misc_feature 138: k=g or t
  misc_feature 154: r=a or g
  misc_feature 155: s=g or c
cgtacatcatattttcgcgttcttctgtgttaccgtacatttaattcccatacgtgtcttactatgtgttaaacttccaatttgtttgaatctcttccttgctctattctgttccagggagttattaggtcaaaacakttttatgggagaagarstagtaagcgcagtatatggaactaaatttaaaataatttgaaaaggatactgtctaagggaatcaaacaagaataacaggggc

SEQ ID NO: 32300 - DNA, 463 bp, Homo sapiens
  misc_feature 320: n=a, g, c or t
  misc_feature 321: w=a or t
  misc_feature 404: d=a or g or t
cagttgtgtacataaaagaggttgggtggccttgaggattgggcttctcaaatttttaatagaacctgcttatctggttttcaaagcacatggccgtactcttagcaattctaggcctttgaaaaaagagtagagttgtctgctattcatttctcgtcagaagtctatccaaaaagtgataattagagacaacaatctaaagacatgtaggtccccttccttccaccaaaaactgctcaccccacagtttttcctagctttgtaaataccagttccatctttctagttgtttatgccagaaatttttagtcatttttggnwttatttttcctatatccacatcgagttatcagcagaacttcttgaccctcccttaaaaatatagctagaatctgacgtatcadtttcatcactcccaccctggtccaggccaccatcatatcttgcctggatcattacaaaa

SEQ ID NO: 32301 - DNA, 472 bp, Homo sapiens
  misc_feature 129: r=a or g
ggttccggagtcagccccggcaggatggcggcggacacgcaggtttccgagacactaaagcgttttgcagggaaggtgacaacagccagtgtaaaggaacggagagaaatcctcagtgaacttgggaartgtgttgctggaaaagatcttccagagggagcagtgaaggggctctgcaaattgttctgcttgactctgcatcgatataggtgagtcccagccaaaggccccatatgtggagcactttgtacagagaggggatttagagtagtggttagagcccagattagagccagactgcctggtgccaaatctgggctatgtcacatcctagccattagatcctgggcaagttacttaacctctctgtgcctcagtttccttgtctgcagaatggggatggtgcattctctatctcatgggtggttgttagtaagcgtgaggtgctggaacagttgctgctgtgcatagt

SEQ ID NO: 32302 - DNA, 309 bp, Homo sapiens
  misc_feature 139: v=a or c or g
accctattttagaaactgtcatatggttttatattgaatgttcattatgtaccaggcgctgtttagtgcttcctttgcattatctcaactttaaaatactgattatcctcattttactcacaaggaaattgaattttgvgaaactaaatagagtaacttgtctggtctcacattgctaaaaacgacagagccagcattcaaatccaggacttggtgaatccagtactttaaaatatcactgatgaaatgttcctcacatttgtcttttgtgtatattgtaagtttcttgaaggcttcttttaatctttt

SEQ ID NO: 32303 - DNA, 174 bp, Homo sapiens
  misc_feature 129: m=a or c
  misc_feature 131: y=c or t
agagtccctcgggtctcaggtcatggcggtcgcggggcccgcgcccggagctggcgccagctgaagagctttgatcagttcacctgcaacctgctgtatgtgagctggaggaaggacctcactgagcamcytccaccgcctctacttccggggccgtgcgtactacacccaccg

SEQ ID NO: 32304 - DNA, 181 bp, Homo sapiens
  misc_feature 141: k=g or t
caagaactaagctgaaaatgaaaaaagatgtgctagtgtttcagaaatcagagatagagatatgttatgttttgggcagaagaaattgtaaagaaagatgcagggagggaagcacttgtgtcaaaaaattgtcagcatgtkgaaactgagtcacttaaaaaattgagtagagggcataagg

SEQ ID NO: 32305 - DNA, 429 bp, Homo sapiens
  misc_feature 136: k=g or t
gaatgggttttggttccagtgtgtgccttcagaacggcctgcccccggtgccaccgctcagggcggcctcggcgtgtgcacattcacatagccaagagtatgatcagacgcattaggagagcctgtttggtttctkgggggtgacattgcacagcgtgccagctacaggaggagcagcaggcctggctcctgcccaggaggcacctggcctagatctcagcgtcactgcggagttaaccaagggaagcggcaccagcatcacaccctgttccagcgaacagtctccagcgtccctgacagatgtcgggaagttcttttccccgtaagatcccggagaatgtcctgaggctgccgtgtggaagctctggggcctttctcgtctcccactgccagcttaatgagctgtgctggtagcaacagatggcgttc

SEQ ID NO: 32306 - DNA, 183 bp, Homo sapiens
ccacacattaggctgagcgtcgaggagtgaagctccgtgaagtcggccaacaaggctcaagaccggagttcaagtctgtgctgaggctgggtgaagctgttggatataaaaattttgttttagatttgttcatcttaacatttatttttctattggagaaaaatatgtgcaatgtaatccaca

SEQ ID NO: 32307 - DNA, 224 bp, Homo sapiens
caattctttgttcttatcttgcttaacctatcagcagcatttgacacattggatcacttctaaatacatggtttctgggataccacattctcttgttttgcctcttatctcattaggcactcttcattctcctttgctaatttttcctcttttcttccatgtcttataagatggtttcactgcaatttgaccctgttttattccctatatatgcccactcccat

SEQ ID NO: 32308 - DNA, 314 bp, Homo sapiens
ccatagagtcctgtttgaagcttcacttctattttggttgaaggcatgatgtatgatgtcagaaaaaaaattgaatgaattatttctacatccaaactcaggtttcttctacattagattgaattgaaattttggtgatggtttgggtagactttttttttatatcaagtataatttaaaacatcagattaaataattacactgttcaggcttttaaaaaaataccactgtgagaataaagcgctagtaagatacatcacttactgattttaaaaatacagaaagattttgagtaaattttgtgcccagcaagc

SEQ ID NO: 32309 - DNA, 200 bp, Homo sapiens
tgtatcttgttgccctccttcagaagtttcaaatgtcaggtattggcaaataaattatctaggtggggagggctttatagaatgcttaaacaactggaagcagagatgcttttcaaggacacctgagcactattttgctttctccaccaggatgaaaatatcacttttttaatagtatatttggttcaagagccggtctg

SEQ ID NO: 32310 - DNA, 268 bp, Homo sapiens
tattaataaccaataaaggactcaacacattttcattgcgtgttcttctttaagacacctaaactcatatctcataatttctgaatccgcaatccctattcattaattgattacagtttttgagttgttggaaagcctagccctctcagattcagggttcagaaagaattaccaggtctggtaaaattgtctgactagcccttagcctcagaatggtcaacttcatagtataagcaaagaaagtggtgatctcatatagtcagctttt

SEQ ID NO: 32311 - DNA, 186 bp, Homo sapiens
ctaaaaaaatacaaaaagtagccgagcgtggtggcacacacctgtaatcccagctactcgggaggctgaggcacgagaatctcttgaacccaggaggtggaggttgcagtgagcagagatcatgtcactgcgctccagcctgggtgacagagtgatactctgcctcaaaaaaaggaaaaaaaaaaa

SEQ ID NO: 32312 - DNA, 165 bp, Homo sapiens
cacatgtctaaattatccttttaaatctggatttcaatagtaaattgctatcttatgcaattttgttccctaagctttataataattaaagctagtaactaatttcaagaggatgaattgaattctctttgcttcctaaagaaataatactaccaataccaagta
